United States Patent 8,781,750 (CELL-TYPE-SPECIFIC PATTERNS OF GENE EXPRESSION) - sequence listing, part 19

SEQ ID NO: 36531 - DNA, 631122 bp, Homo sapiens
gcgactcggtcccaggtcggcgggcggcgcacggcgggctcgcgcgggggccccggcgcgccgggcggcgcagtacgcagcgcgcggacccacgccacggccaggagcccagagcagcgcggccacactgcccaggggtcggccctcggccccggcgctcggagcgcggcggctgcctgggctttaatggctgctccgcggagcagcgcctagggctggaaggcggctgcggctcaggaagtcacccgagcaagcctccttcggggccggccgcacccgccgcggcgcgctccatgggggcgcgctccccccgggcggcccgctgacccgggacgccggggcccgctcgctcgccggccgcgcgtcccggccatgaactgagcccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctgcaccatgaactaccagcagcagctggccaactcggctgccatccgggccgagatccagcgcttcgagtcggtccaccccaacatctactccatctacgagctgctggagcgcgtggaggagccggtgctgcagaaccagatccgggagcacgtcatcgccatcgaaggtgagggccgggccgccttggggcctcgggaaggcacggacgcccgcggcgcggcgggggtgtgcgctgtgtgcgtgcgggtgtccacacacgccggccggggcacgcggctgctccgccgagggagcactgcggcgctgcttgtcttgcaaggccgggcgagcgtcgcctgcgccccgccgcgccgcgagctccgccaggaagatagatcgtcagcgttaatttgatcgtggacaatagagtctctcctgcgggaaagtggctcggtgcctccgcgtcctgggctgccggagcgtcccggcccagcagacgcctgggggcagccggcggggtcggcgccacccgacccctgacaggttaccaggccaggcctgggcgtcttgctggacgttgaagacgtgttctgagaagtgctgccgctgggggcgaggcccgggccggcgtgtttgggcggtgcagggctgccctccttagtgtgtttgcttaattcaggggtgcagttgaacttagtggatgccgagagccagccctagccgcgggagcatcgtgtccaggtgcccctgtgcaaacgctggaaccggtagtgtgctttgtaccaaccaaaagtccggggttggattagaggaagaaccctaccaggagggcagggcgtcctccagcggaagggtctcgctttcatatgtctgcagttggaggccactgaagtggagggtgctgtggttttaagaggggcaggatgcttgggcagaatccccacccgcttccctctgcatgtcaggcagggccatggccttccaggagagctacagcagcagtctgccttccggggctgtgccctctggatttctggtggctctcatttctctgtttccaggctgctgatttattttcttgcttcatccctttggtccggccaagactcacctggggcaccaggtggcatgtgcgtggacagtgtggagtcatatcttagccacagttgatcagcactttctcccttctcagcgctgttggccagtgatggtaaaaagcctgcagagtggcttgtccataatacagactggccggtaagacctctattgaggaacattgagaatggcccaaagccggcaggaatgtgcctgaaagcctggtgctggcgttgcccagcctcctccctctgtgagggagagggtatcagcccacagagaggctttgccttggcactatgtagtctgaactactaaccccgaagtgctttggtttgaaacttggccagttaggtggagaaagtggatgttgtgttgctgagcccttggcatttggcagccctgtagacttgaaccatgtcccagccaggctggatgactggcagactatacccttgggggacttgttaattccaggggaggatccgggtggagctccagccttatggggtcctagccctttgtgtgtatctgtctcccatgaggtcacctggctgccttgttggtgacttaagatgctctgtggattcctcaagagatgggctctgtctgcctctgcatgactcgtgatgagtggcggtgggacctggacccatctgctgatgatcaggtggtgttgcagcaaggttcctccagagctccagctctgcgtctgttacgggagctgtgaaggctgcacggtgctcatttcagatggttcttcctggctctctggctgcatccacagaagtctgatgaaacactgtgaaagccggcgtcaggtattgaaggcacctggctgagagcctcttttgctgcatgaagacctctggctgagtggggttcacaacacctcgtttttatttcccattcttgaagctgagctctggggctcaagcacttccagcaaagcagtttgactttctagcaagaggatgtggttgcattttcctttctcccttaaaagaaaaaaaaaatgcgtcgttcctagatgatggttttttttgacagcacgatgcctacctttgcgatttgagattttaggccccttcttggccgggatccttgtcatttttaataaggcttagaatcattgggtgaatcctgtttgggactggggtgatgctgttatttttctcttagaaatagggatgtctacattatgtggagctgtagttaatttagtgaggcttaagaaccactcagacatgctgctgttctttgcatgttcttctgttatcaataatgataccacttttcatttctgtagaactttaacagaaatatttttgcatgtatagtctcattgtgtggcttcaccaaccctgtgagggtgggtgggtagcttcctcatcctcattttatggaggagcgggtggaggttcagggagggataatgacctccttaacatttgactgaggtggtttgaagtctgatctgaaccaagggatcatttgaatggagtttctgtctccacactgcatgtggatggcaggaacccagtgctggcaactaagcctgcgctggaacatcacagtaactgcagagggctccctgcaggggcagagagctgcccctgcctgtgcgtgcaccttggaggttttaaagtctaactgtttccaatcaggacagcaggtgcacatcataacaaatggctcaaaaagtcacttgtcccaccaaatagaaagctggccacattttagaagatttccagctagggattttttccccttcctctgtatgtgcatacacagaattggggtctgacttcccaagcttctggactaccgtgatgtgggcacttctttttttgttttgagacggagtctcgctctgtcgcccaggctggagtgcagcggcgcaatctcggctcactgcaggctccgccccgggttcacgccattctcctgcctcagcctcccgagtagctgggactacaggcgcccaccacctcgcctggctaattttttctgtttttttagtagagacggggtttcattgtgttagccggtatggtctccgtctcctaacctcgtgatccacccaccttggcctcccaaagtgctgggattacaggtgtgagccaccgtgcccggccgggcacttcttaacgttatgaagagcttttgaagatagggtttctcttgttggcacaaaattcccacatttggctgcaccctactcaaaacttcactgttttctggcatcttcaggaatttttgctgttggagtgaggtgcagccttgtccaggggaaggatgttttggctaatgcttatttcagagcgcgtggaggtgggtctgggttgtaaaatctcttaacgatggactaaacatattttagttgaaaggcccaccaaggctcccaaataaaaacacatccgtaatcctgtttgtaggcatgggatacaggtgattttgccctcagtcttgttttaaaacactagcttgtcagaagagaacagtttttttcccccaatttttgttttgtacattgagaggtttattcccccctcccttcacccccaaatcactagagtttaaggaagcattgctgattgttccagatttatctgatcaggtttctgggatgtcctatggggcatggcatgctgtgaaatgtagccacacagctgtgtcgtctctggagcctccgcagccaccatgcccagaaatgagcctgagagccatctcgcctccagtctgaacagcgtgtgttagtttcccctctggttctccttagaaaagtccatcgggggttgatggcattgaggtagatgaattaactgcctttcttgttcaataaagcttgttcttctttcaaggataaagcctctcttagcagtcacacatcgtaattcagcttgccagcagcaggaccgtgatgtgagtgatagcccagccagctcattcagccaggcggcccgattcccaggttcccacgcatcgccgggaaggttggccttcctctgaggttgagccctcatccagcccacaagcctccatccccaccaggtggccgatgagaggaaacccaggctctccactggcctggcacttggcaggagaaccctgccctgcacttcttaagggcatttccacagggagattccaggaccccttagtagtatctcagccccagtgtttgggggacctgggaagatgggtcagggttccccactttgtcccatgatacagctgctctgttgagcatgtgtgtcccacagagtgcggagtgtctgaggtgcatcatctcagttcgtcctgcagcgatcttgtacacagacgcactgctgaggccagaaagcttaggacacttgtgcgagagcggtgagctgggcccgtccgacctcacctctggccctctgtcgccgtgtgagattgcggagcccctgttattcatacttcccataggccgtgtgtgcaaagcatcccaagcttgtttccgccacccaaggcaagagggtttgagaaggccccaaagaacctaaagtattctgttctctgtaaagcagctgactgtggcaaaacttccagaagcatttgttttcatgtggaaatgtatttagtccggttgatgcaggtgtgcatgtttagggaaacaaacattttcttcctgctgtggataagtgtcatgtttctttgtcaccattggccatgttcataatccttcaagttgaatgaaaggtggcaggtttgcagtcccctccttaaaaataacactcagttggcttttagttgcttccaggtgagctctcgtaccttgccggcacccgggacctccacaatgcgggcgttccttgtgagtccagcttactcatgcttctcagttgtggtgcaggtgctctttgagatgccgccttctctgcctgttgctcaccctgcgaggctcggtctctgttggtgtcactcatgaccagccttgcctcgccagaattaaggccctcctggtctctgcccaccgtgtttggctcatctacttaatcagctgggaggtctggaagctggttgagggcagaaatcagggcttgtttattgctgtatcctcagtggtttgatagatcacgtctggcccttgaaggatgcccaggggtttgttggctggctgacttgccagagggtcctttccaaagctccttcttggtaggataaacaatgtttatacgctgcagaagtgaggacaatttgaaacgtccccagagcacagaagttagggttagacaccttttggatttggtgggctggcttggtgggaactcagtgtcatgtggtgtttgggatggaagtgaaattttctttactgtaggtaggggaagcaaaagatttgcttgctaaatcttggcagctttttcagatcagctgtctacaacaggttggtgtttatgttgggtgtaagtgaatttcagacatagaatcaatattaagaggacaaatgggtgacagcctgtgtcactgccatgatatagtatctttggcgtcacaccgagagcaaacgtgagtgtgtgtcaggtcacattgagggctgatggaaacagattgccggcccctcccatacctcccgagtttctagttctgtgggtttggagcaggacgcacgaatgtgcctctctaagaagtgtcctgaggatgcggatgccctggtccagggaccgcacttctggaagcatagctgtaaaggaaaggcagctccagttgacttggtatcatctctgggccgttgtttcttcttccttgctgtgcttgtagccagctgagaaggtttcctatcagcctgccctgcaggtttcaggtgaagacacctaaggccagctgctcagggagttgcttgtggtcacgcaggctaagtgtggtggacgagggacttaaaccagatctgaatggtttcaagctggtgttcatgtgatcttcatgatgctgtttgaaaagcagctgaatgctgggtgaggggcctgtcgtgccagacccctttaaatttcattagggatggcaccgggttcaagagactggagaggagacctagagccagcaaacaaaagacagagggtttattaggggaatttatttacagagtggtcccatggcggcctgggcaggagaagcgctgctgcttgctttcagaaagcgtgcagtttatatagcattttcgcttaacaccctcccccaaacaaccaccacccagcaaccttaacaccaatcaaagagcctcaataccctgtatggcctgctttccatgggacaggctgggggtttagatgttcctcatagataaggaatgaatctctgggttggccactcccggattccttagctcagaaccccgaacatacattcaggtgcacctgccatgtggggccattctcagttattgctgtcaggggcatctgtcagtgggctgcgtttctgcgacacggtggcatgtcggatggacattgccaagagaatctggttaggaggtagaggcagctgatgtccatttccttctagactcattctgtggttttgcggattttccttcttgtctttcggagattgttgctttttaatgtagtcttatgtatatttagattgggttcttcagtattcacttattatatgataatttggcagatgacacattttgttaccaatatttccaagctgaaagcgcgtttctgtaaaagacaggagctagatgttactagtagcttaaaagagctgttggaggagcctgaaggaagtgactcataagggagagaagcagtgggggcagctgcaggaaccttcaaaacaaaacctgcagccctgttgctaccacctcttgttttttgcctaaaccaggcgttttattttgttaagacgaaaatcccttattttgcatccgtttttccccctgtataccctgcaggtgtttatagtttgtgagtctcactctggcttgttttaaccactgatttcgtttcgtcttatgtttctctacactctagcaaacctgtgtccccctccccgcccccatcccaatcctccagccttcacgtccttagcttaagtgattgagtctggcaaagcggatgaggcttagctatttttaaaatccagggtttgaggttctgatctggtgcttagctacataattccttccctttgttaagtacctttctccgagaaacaaaatgcactctacagatgttaatctctaatctttgcagcatctgttatttttattcaggggtacaagtgctttgtgtgtgctgcggtgagccctggccttctggaagctctgtgcttctgaggggctgagggggatttgggggtcccttttcatagtgtgggctgtctttcccaagatgcagtgatgacccatcagaggcagggttggtattgtccgtggggtccagtccctctatcttccagggcttttctggtcacaagagaccatggccagaagtgggtatcgtgcttgtgtctggggcctggggagggaaggaaaacaaataccaccccctgcagaagagatcgttaatggattctttgagtaaccagccagatagcttgtttgtgtgcgaggttgggacattttccgtaaagagcagactaaatataggctcgagggtggggaccagggcccgagagggggctgccactgcttgctccagtattgtttcttccattggtaaccagaacttgccaccagtcccaaacaggtggccaccctgagctctctgggaacagattggtgtttttgtttaaccaggggctcatttgcaaatttcacacttctcccgctgtttgatggggattgtctttttttgggctgcagtgttggagtatttgtacagtgtttctacacaagcaactgtctaatctttaaaactgctcatgccgtctggttgtcattagcatcatggttagaagctttttatttgcctttttttttttttttttttttaagggtgggaaaacacttttcatggttctgggagaagaatttcaaataatgtccatgttcacaaatgatttatgtttggtcttggagaaatgtcagcattcaacaggctctagtaaatacaaccatgttgatttccagcttaggacgaagctactgttaccctgttctcactcagataatagtctgaaaggcagaaccgtacctttagaaagtacatttagcttcaattcaataagttttagttttagccaatagtgacttgtagtatggaggatacttgaaagaaagaagttaaacattttttaaaaaatttatgaacacctgcaacaaatagccacaagacctacccttttttcaggaaagagttttcacttcttaaatgtcaccttgggggcatgcccactgtgtgatggtacccttcagcaggattggtattgtcggaagtgctggctagcttatgtaatgaaaaagaaattgatttggaaagagctgattgccctgaatttccatcctgtttgtgcgttgagctgcccttttcagtgggggagaatccagcatattttccagggagggcgtttccggaagcctgtctgcaccccctttgttgttgttttcgaaggtctggggtgctgctgtgagccgggatcgcgtatctgctcctgttctgacgagactgctcctgctggaagttcagcctggtgaacctgatttgggaggggatggtgtgattggcggggaacagcattgtgttaattttagcttcaacaatcaagcctgggtctctgagtgtccatgtagtacttgaagtttgggtttggaattggtgggattgagaccacttcaaactcttttatttcttggaacttgttagtatttatttatttattttttgagacagggtctcactctgttgcttaggctgaagtgcagtggcactattggggctcatttgtagcctcaacctcccagactcaagtaatcctcccacctcagcccccgccaagtagctgggactccagatgtgcaccatgcctggctaattcattggattttcagtagagacggggtttcaccatgttgcctgggctggtcttgacattctggactcaagcaatccacctgcctcagcctcccagagtgctgggattacaggcatgagccactgtgcctggcctagtttttaatttttgagacagtctctgtcaatcaggctgaagtacagtggcacgatcgtggctcactgaagccttgctttcctgaagcgatcctcctgccttggcctcccaaatagctgggaccacaggcacgcaccaccatgcccgactaattttttaattttttttgtagagatggggtctcgctatgttgccttggcctccctaagtcttaggtttacaggcttgagccaccacgcccagcctcgaactctcttttttttttgacacataacagagaaaggtgcccaagtcataaaggagaaagttttcacaaactgatcacatgtgggaccagcatccagttcagtggccagcacagactcatctgtcgtgagggtcgttagaaattgtagcccccatttattggtctcttctgcctgtgatatgtgcttgagtggttgcctgtttcgggggctgtcagtgtttgagtggctgcctgtttcgggggctgtcagtgtttgagtggctgcctgtttcgggggctgtcagtgtttgagtggctgcctgtttcgggggctgtcagtgtgtgagtggttgcctgtttcgggggctgtcagtgtttgagtggctgcctgtttcgggggctgtcagtgtttgagtggctgcctgttttggggctgtcatgaatagcaccactgtgcagattctcacttgccttttggtgcccatatggcctcatttctgtcgggtgtgtgctgggctgtgtctttctctctgtgggttggacgtagctgctcgtgaagccgctcctgcagcccagcagcccctatctgggaaacctttcagtgctttcaaggttcattttatgacactcaggatggccgtttgtctccttttgctgattttcattctttcagttgtttgttcataaacaaatgtttgcatggctaatgcatttccagcacttagagattaggtttttaaacttttggattgtctgcaggctattaattccttgttagttgaataatgacggctgtgtgcatggagctgtgtgagcgaaatccctcaccaggaagagggcgcagttcctctgggactggaacaggggcccctttggctctccttggctcctggcagaagtcagttgtcaactgggggactctttctggctgagccccaagcagcctcaatccatccctgtgctgggttttagataacccactggatctgtgttggtctttgaaagggaattcactctgtatgtttggcctaaactgtgttatggccttcatagttacgtattagcattattcagtttttgttgtttgtagcaattatgctgaagacacaaaagaagaaaaaaagctaagtgttgccaactcaaggagtaattttctttgttccagcgctgtgtcctgggagctgcccatccccctccacaaaggccagtgctaaacaaggccagagccaggaaggacacgcggggccatggattgagtgagggcagtgtgtgcgtgtgtggatttctctggtggctttgcaatggcaaatatttattttgagggatggtggtgggaggaccaagtttatactcactttgtttagtaggggaagtggctaatgtgagaatcaatagacaagattttatcaagcctctgcactgggcagagcgcagtttttgaagctgggagaacaggcagatgtgtgggacactcagggcccttcagatctcccccaggagccactgatacaggtagagatcgcagccacacaaggctgtgtgggaggggcctgggagatggggcggagtccagggagagatcctggaagccaggtagcagtcaggagggctttccaggctagtgggtactaggattggagcatccagaacagagtcacttcagcctgggaagagcggggtaggcggccgaatgataagtgatccttgacagcccccgagagcaggctgggagaccttttgttggacggtctactactgattatggatcctgcttggagaggggagtgctttttttaaaattcttttctttttttttttttttttttaagacggaatcttgctctgtcgcccaggctggagtgcagtggtgtgatctcagctcactgcagcctttgcctcccaggttcaagtgattcgcctgcctcagcctcctgagtagcggggactacaggcatgcaccaccacacccaactaatttttatgtttttagtagagatagggtttcaccacgttggccaggccggtctcaaactcctgacctcaggtgatctacccgccttggcctcccaaagtgctgggattacaggcatgagccactgtgcccggccctgttttatttatttatttatttagctcgggtttcaatattttaaaaaatttgaagccaggtgcggtggctaatgcttgtaatctcagcgcttcgggaggccgaagtgggaggattgcttgaggccaggagtttgagaccagcctaggcacagtggcaagtgcctttagtcctagctacttgagtggctgaggcaggaggatcacttgagccaaggagttgcaggctgcagtgagctatgattgcatcactgcgctccaccctgggtgccagagtgagatcttgtctcaaaaaaaaaaaaaattgaactgtgatgactatgatattgtcttttggggggttttctggacataaaattcagaattttacatagaaacttgaatttatttgtccaagagtttcttgttttgaaaataggatgccactgggaacattcttggttaggagccaccggaagccgggtctgtatgggcagggccagtgagatgcaaagccacacacgaaagctaagcacacactcttgttttcctcactcacatccatgttcatcctctttcctgtgctgacggtttgcaaagctgggagagaatgagggcggggcctcgggaagtgaatggcagagcaggtggcatagacacctcagccgtctgcccacagggtatgggcaaggtttgttttggtgactttttcttccagtcttgtgtacattatcgtctctcacaggacttgagcttggagggagctggagtggccgcttgctgagtctttctccctggagctcgtgggcagctggttacctcgcgctggggcgaccctgacttaggacctcctgccgtttctctgggtgactgctctgtagtcgtgagtcgtctctttaatgctgagcatcagtacctgcacagccctgaatggagcagctgcccagaatctgtcttgtcatcgatagatggacagttgccgagtgtcctgcgtgccgactgactaaggagtttttgtctctgtcaccctgtcccctgtggttttatgaagacgttagttatgaatccgtgtttaggatgagaagatgtaaacagtgaggaggataagtgagaagctagcaagagtctggatggtgatggcgggggagcgctggtggaggagtcgggggcgtcccgctggactggggcacagctctgcagcagcagccggtgcggttttgccttgtaagtgacaccgttgcctgcaggcatctctgacagctgctcctgctccagattccagaaatttctatggaacatttcctgaaccatcctcctggtttcttcccttcccctcactgaataaaatccgtaatagcacctgccgcttgagtgtttgtctctgcaggacgccgtgttcagggctgggtgccctttgtgtcattttgttatcctggtcactgccagacagaggtggtaggaccctcatttgtcaggtcaggagcctgcagcctggagagtttaaagccttgcctgaatccacccacttctgaaggtggcagagtcaggattcgaactcgggacccgtggacaccagccacctatgggcctttatttttatatttttaaaaacttttagtttcaggggtacacatgcaggtgtgttatataggtaagttgggtgtcatggtggtctggtgtacagattattacaacgcatagtaagtacagtacctgataggtagtttttcagtcctttccctcccaccctccaccctcaagcaggccttggtggccgttgttccattctttgtgtcaatgttgagctcaagtgagaccatgagatatttggttttctgttcctccgctggttcgcttatgatattggcctccagctccatccattttgctgcacagggcgtgatctcattctttttattatggctgcatagtactccacagtgtacatgtaccacattttctttattcagcccatcgatgggcattttggttgattccatgtctttgctattgtgaatagtgccacagtgaacacacaactaactgcgtgtgtctttatatagacacaatagaacaattatattccttcaggtgtgtaccaagtaatgccacctacagttttgatgttttagtaaagtagaaaaggaaacttcagaaatcagcccataagtctgcagaagtacttggggaattctctccgcagttcgcagctctcctgcagatctcggtttgtgatttgaaactcacattcacgctcggttttttactcatcaaggttataaagaaaataacagctgttggttcacttttattccctcgctgagagttggtggcggctgggatgctgactgacggttttgattacatgaggaggaggcacggaggcaagctgactgcctgcgattacaggtcccgaagtccgggaggagggaggatttccaaacggcatgcctttgaaaattcacctgcgtttaggaaatctgcagcacctttaatcctggctagctgaaaatacagcttacatttaagccacacaaattctgtgacattttaataatggagatgttagtgggcagttaactttttatacatgtaaatagaagttactttccccctgtgctgtaattagcaaaagagggagaaagggatgctctgtgcatcaaagcgatttgcccagggttacacagaggaaggtggcagagccggaagtggcagaatccagtgcacgggcgggatgccgagtgtgtcgccaaactccaccactttagtcgggggcgtggtggtggctgcgctatctgcttcccactcactggcatcctagccgtgtggggtgtgtgctcacctgcagccaccctcacctgcttgaaccagatttacctagagggtggtgtgaactcatgtgatgtgaacgattacttatagttaccgtgaaaattaatggtgggttttatagttggaatgctttttctacacttacttgatttttgtctatctgtttagagaagtgttttttctgttgttgttgttttttaaacttgagatggagtctggctctgtcacccaggctggagtgcagtggtgcgatctctgctcactgtaacctctgcctcccaggttcctgggttcaagcaattctccttcctcagcctcttgagtaactgggattacagacatccacaaccacgcccggctaatttttgtatttttagtagagacggtttcaccatgttggccaggctggtctcgaactcctgacctcaagtgatccaccctcctcagcctcccaaaatgttgggattacaggtgtgagccaccacgcccggccagaggtgtggtttacataaagtaaactccaactcttgaaagtttaccatttgatgagttttgacccctgtagctacaactgaggtatggaaggcaaccattccccgaccccaacacttcctcatgcccgtttgcaacctgcatcacctctgtccgtctgcttgcacccatctgctgtctgtcactgtggattagtttgcattttccagaataaaatagaaataagatcatgcattaaaaagggggtccccagcctctgggccatggaccagtactgggcctattaggaaccaggccacacagcaggaggtgagtgacgggccagcaagtgaagcttcatctgtatttacagccactccctttgccttgtgttaccccctgagctccacttcctgtcagatcagcggcggcattagattctcataagcgcacaaaccctgctgtgaacagcacatatgagggatctagatttggcgctccttatgagactctgatgcctgatgatctgtcactgtctcctgtcccccccagctgggaccctctagttgcaggaaaacaagctcagggctcccactgattctacgttatggtgagttgtagaatttttttcattatatattacaatgcagtaatgatagaaataaggtgcacaataaatgtaatgcatttgaatcatcatgaaaccatccccctgcctcccttcagtgggaaaattgtcttccacgaaaccggtccctgatgccaagaaggttagggaccactgcagtaaaggaccccttctttgactggcttcattcagtcagcatgatgatttttagggtcattcaagttgttacatatatccatagctttttctttttcattgctgagtaatgttccattgtatggatttactacagtgtttttatcctgtggatggatattgatggagttgtttccagttcttggcttttacaaatagaggtgctgtgaacattcacgtgcaagtcttcatatgggcacgtgctttcatttctcttgggtagatacctaggagtggagtggctgggagatgtgctgggtatataattaacttttatgtaaactgcctgctgttttccaaattggttgattttactctcccgccggcagtgtgagagtgtccactttgggcttaagttcagcaggcttctggcagtgatgggatagcagctgtccttaagaaagagcatttgccctctgtgtctcttgggctgtgaagtgtcttgtactgatgaggggggtgggaggctataggagtgaggctgaggagggaaaggagaagcctcagaaagaggtgcagactgaagaccaccttagaaggtcgcaaaatccaagggagcagagccagtgtgcctctccttgtgacctctggcctcagtttccctgtctgtaaatccggatgtttggccaagatcagttttcaacaaggtgctgggtgggggggcggggggcggcggtgtatggcgtgcaagcattgtagcccccaagaggacatttggccatgtctggggcaattttcggtttgttacaactttggggtgtcatggttgttactggcacgtggcaggtggaggtgagggatgctgcccaagatcccgcaatgcctggggcagccctgagtcttcgtcatcccgagactgagagccccaggtcagatgagctctgtgaccccctcagcctctgatccacactcaccaaggattactctggtgcacgattctgtttcggtgggagctggtgtaattatctagaggtgtgtctacctgtgtgcccagaggggcccgccctctcggtgagcaaggacacctggttccctggggtctgagccaggccctcagggaggggggcagccaggagccgcagggggctcagccagctcctggccctcaagtgttctaggaaaccggcttctctgtggggatgtgactctccctcactcctcccattgcctgagtaggcaaattccacctagctctttatgactaactgcctggcagcctgagctcagggcagttcctaacgaacttctttgattattaacctatgctgggcccagggaaattactcacttgttttctggccaagagaaaatctcctggaaacttctatatataaatctttttgacaattccgcattcaagagagttcccctggcagttcttctatttgtagggtggggagaaaaacccatgtaatttccccaaactgtggattttgttcctatagaacatgcttgtgagattcagtgtgcgtatttgtgtgagtgtgtgtgaatgtgtgtgtgaatgtatgagtgtggatgtgtgtgaatgtgtgtgtgtatgtgaatgtgtgtgaatgtgagtgtgaatgagtatgtggatgtgtgtgaatgtgtgaatgtgtatgtgtgggtgtgaatgtgtgtgtaaaggtgattgtgagtgtgtgaatgcgtgtgtgaatgcgtgtgtgactgtgtgaatgtgtgaggtgtgaatgtgtgtgaatggatgtgtgtgtgaatgcgtatgtgtgaatgtgaatgcgtgtgtgaatgtgtgtgtgtgtgaatgtgtgtgtgtgtggtgatggtcattgtccacattggtggtcttgtcactcacttcttgatctgttgctgcatcagcagaatgctgggcagatggctgcatcttgtttgggagtttgggagttttctttgagtatctgttttttaactttcaggggagaataccaaggttgggaaacactggttttgctgacataagaataagaaaattggccaggtgcattggctcacacctgtgatcccaacactttgggagaccgaagtgggaggattgcttgaagctaggagttcaagaccagcctgggtaacatagggagacccccatctctacgaaaaaacaaaacacccaggtgtgttggtgctgcctatggtcccagctgctcaggaggctgaggtgagaggattgcttgagcctaggaggttgaggctgcagtgagccatgattgcaccactaccctccaacctgggcaacagagtgagaccctatcattaaaaatcagtcaatcaatcaatcagtcaatccatgcgcgtcctcccccattcctgccttgatttccctgttaggatttgccatggggtgggcagctgggcaaaggcatctgagctggaggtaggtgataagctccctgggcctcccaccctgcctgcctctgctcagtggctcctgggtccctcctgaccatgtaacctttgcgccagccagagaatctgccctttgccttcctctccaggaagttgttgagatacatgagtgaaaatattattcttttaagtgctttggatgttataaaaaatacactgtgccattaatgctcgtgcagggctcccggccggcctaggccctctgcacttgagattcctctggcagcatctgtttagaactgggcactcctggttctggtcaagtttatcctgaccagttcatttcatggcagttctggtcatttttgagaaaatctagtttgcactttcattgggcccctttgtgttttctagttcagatgtggcttctctagctttttcttgctgctaaatggtcttaaaggtttgagatcagtgtctcagactttagcctgcgtcaggatcacctcaggtcacgttttaactgagggtgggttaaaatgcagatcactgtgccgggcgcgggtggctcatgcctgtaatcccaacactttgggaggctgaggcgggcagattgcttgaagtcaggagttagagaccagcatggccaacatggtgaaaccccgtctctactaaaaatacaaaaattagccagtagtggtggcaggcgcctataatcccagctatttgggaggttgaggcaggagaatcccttgaacccaggaggcagaggtcgcagcgaactgagatcgcgccactgtactccagcctgggcggcagagcaagactccgtctcagaaaaaaaaaaaaaaaaaaaaaaaaagaaatgcagatcactgggctccacccccagaagttctgattcagtgggtggcgggtgaggcctgggaacttcatgacgagccccctggcaaggctgctgctgccattttggtgccacactttgggtactatggctttgggcactcccaatccaggtgccatggcatggggagcagtgggtgaaccaaatcctggagcctggactgttccattgggtgcatttctggctggcagatagaggaccacccagctgtgcttgatggggtctagaagcattgaaactggtttgccgttatgatgtccatgaggttggagtcctttcttagttaaaaaatctgaagacccaacaacacacagcacccccacgctgaaccctcccgagaatgattgagctcttccaaataaagggcgattttgtagcttttcaagttttaacagtttgataactcccaggctcctgttgagatgctttgtgatgaggttgtgcgttcccctgtatctttcctgtgggtgtttatgtgtacagaacacatgtatctgtatttacgtgactgagcacaggcgatttccccgagtctcaccttggtgtgtgccagtgcatgcgcgtgcgcgcgcgcacacacacacacacacacacatacctcctctcagagaatgttgatgtggcaattcatgtttgacagctgggttaacccataaatagatcccaaaatataaatttacccagacctcaacctgcttaagcctttaaatagctcactagggcttttagaatgaagttgaaattccttggcctcacccttaagcctttttagaaggagtcatggaggaagtaaagaaatggaaatggagttgcctcgctgggctcccaggccctttgccgtggccctgcctgctctccagcctggtctcaccccacctgtggcaccttcgctgtggaggataccgtcagccaggctcacagttcctggcaggccacttcctctgtctggggccctgcctgggggtttggatcacctgagtcctgccccttggcaagcctcttttaacccacctgatgccttcacaacccagctcaggagtcctgcttccccaaggccattccgatggctcctgctggcgattccagggcctgccacctggtggcctgtgcactttgctgtgacgtgggctgcacgtctctccccagcatgggctcaaggtgctcaggaaccaaaccccggtgtctcatccaggactggacacgtggtgagagctccatggagcttaactgcatgagggaggcgggatggactctggcttgtagggcacagtctgtgtagcaacaaggaacatacctggtgtttagatcagatgttcaatgactcatgtcccagagaaggggcctgcagccgtattggtcagttggggagcttgtatactcaggccattgaggttgccatggccaccattttgggaatcttttctttgggagttgccatcagaatttagggcattaaaaaagtccttaaatttaggtaatgtttgccttaagcagatggtctttgccttttagaactgtcagaacttgtttacccttcaagctgggcactgtggtaagttgactctttgggtccttggttggaaacatgagaatcccattctggctgactcaagcagacatggattttattcgaaggatgtgggggtggctttgagcatagaggcgttgggatggactgaaccatgggcccaggggacaggcacaggctgcctgtgtatttagggcactgcttgggttgcctggagagtggtttattggcccagattctgccacttcttggccaggggaggcctttcatggacagcctcatcagagtggcagcagagagaagagcagggcaggtcctcaaaggaacactgaaaaggttctctgaaagacaggggcgtagatactgagctggcaataacagcgctgatccactggaatggggaagggcctcgagctgttctgtcaacacggagttgtttgtcaggcgtcatgggtatcattttgtgcatctgcccttgttcagtgtttccttgtaattttgcggaaaaaagtctgcttagtgttgaaccagacattctgcagcctttaaaagagaatggaaatggagagattgtaatgtgttcattggtgacttttgacacggatgctaacctgtaagatgtgcagatatatcatgtgcaaactgttaagatgctgtcaacattttgaatgacttcttgcaaatagtaaggaaattaaacacgcacagagctgggcaaatgctagaggatggtgttgccttttgcatcttggtgggaaagagatatttaagggggtgaggggagctcagcaacagcgacttaagggcctgctaggagcggggagaagttggttgctggggtgtgcggcctctgtagcccagtcctccgagtatcgtgacaggtggctgggtgcctcagtgctcaggtatgggctcctgttcctgccgcatgggctcctctgctgctgctgctgctgctgctgctgctgctgctgctggcccgccagttcccatggactctccctcacctgtgcttccttctgctccccgacttcatggttggaacgtgctgtcttcccatccctctgggcacgtggctcctcttttacatgcatgcctggcgaatagtatatccccagtaaatgcttgcagaatgaatgtctttcctgaatgttctgctctgctccccagcccccagaaataaaacagaaatgctgtactccttccctgtctcaggcccaggagcattattattattttttttaaatctcttgtggcacttttctactttctcctccacagtacagctgcttgttgagaggcagtatatgtcatgtctaagaagagtcctcaagtgaagtctggtgcagcttctttctagctgtgtgctttcaggaaagccttttgaatttggagcctctgtttcctctagctttactccaaaggaaacaagtgtaagtgcttggcacctgcagcctgagcgtagttcatgccgcccgtattcctggccagcctccgttctctgggacccggcaggaatgtgtttgtcgcctctggccctgtgcaccctggcttcccatcatacctggagaccctgggacaaatgcctgtggagtggatgagtgagtgcatgcgggtccactcagctccccggcaggcttcagaatcttccctgtattctggaagtaagtggcgtcgctgcccagtttaggagagtgccatgtgggactctgttccatcagctgggttggtgcagtgggactgaactttcttctttggttgccctctgcaaacagccatgcagatgttattgatgggcagttgcaggtagaagcatttttggccctacagggtagatctgccagcatggcaggctgatcagccacgggtgccacgtggctctggaggggcttggcgcctacgttagtcagctcgggctgccacgacaaaataccacagactgggaggcccaaacgtattttctcacagttctggaggttgagagtccatgatcaaggcactggcaggtttggcttcttcccattctgtgcctcacctggtcttttccgtgtgtgtggtcttcagtgtttttccgttctcaggaggacaccagtcttgttggatgagggtcccacccttaagctgccatattaccatgattgcctccttaaagaccttatctccagcgacagtcaccttggggtgtgagcctctgcagaggaatttgggggatactgcgcagtccgtacagcatccctccctccctggtggtttctgaggatttgtcactgatgtagtagcatcacgagtgtttcgtcacttaacccagagcagggctttgacgacatagctgtgcccaacgtagatctttatggtaattttattttaattgaggtcgcagggactaatttttactggaaagaagtagcagccatgaggcaggagatcctctttactttgtaaaaaaatgtaaaagaacttgtttagatcaaagtcatgtttttaaaatataaactagattatgaaaaaaattaaaacttgatttaaaaagaagcctgggccagatgcagtggctcacacctgtaatcccagcactctgggaggccgaggcagacagatcacttgaggtcaggagttcgagaccagcctggccaacatggtgaaaccccgtttctactaaaaatacaaaaattagtcagacatggtggcgtgtgcctgtaaccccagctacacgggaggctgaggcaggagaatctcttgaacccgggaagtgttggagtgagccaagattgtgcctctgcactccagcctgggtgacagagtgagactccgtttcaaaaaaaaaaaaaaagaaaaaaaaaaggtagaactcatagttgccattgaggtctgagtcccggcttgcctcagttggggttcttgcccccatttgcaggtgagaggtggaagctcaggcaggcccagcctccgaaggtgcagcgcagggaccctaacctgagagctggaaatgctttcttagagaaagtgcataagggctgtgcccatctctcctttgcccgaagacgactgttctgctgcattggtttcactgtgttgtttctgtaactctggtgtttaatccacgtgaagacagtggagctgtttacactgtttgattgattggatgcttatcaggaatctcaaaacccagctttgggcaaccagatgcctttgacttctctttctcctccactgacagtgatctctgaatgcttttataaaggtttttcataaagaatataaaaagtgacagaaataaaattggcaatcaaccaaattccttacctctcaaattgcctcttctgagactttttgtgatgatgcgtgtgccccaccctgcaattggtttcatagaaattccttggatttcctctgtttctgacaaagagccagggcggaagctgcaggtcactgggtgccagctgtttcccaccgtcagccttgggaggggcacggagctttgcaaatgtctcttcagctggtgttttctgccataggacaaagagaaaggagagtgacatggtgttttgaatattttagtaagaaaacagtctccacctgcacacaaacaaaaaaaattaatgcttggatataacttttttaatcctcaaagtaataataactttctatctcataagccagagggatggtggcatagctaacagcagctgcatgtcctcaggttaaacttcacatcttgactggcaggcttgcctcgcgggtgcacttcgtgaatgcccgctgctcctgcagcggaagagtctcctgtccttgggcctcagtggcaggggcagcaacaggaggctgcggccagttggcttcacactgtttgggaacagcagaagggtcagagcagacctcaacattatctgaaacgagtactattcacaacagcaatttgcaggttatgtgacaagaatcatatcatttggtgtgtgtgtatgtgtttatttatgagacagggtctcactctgttgcccagggtggagtacagtgccacaatcgtagctcaccataacctcaaactcctgggctcaagcaatcctcccacctcagcctcccaggtagctaggactacaggcgcacaccaccacacctggctaattctttattatttttgtagagacaggcagggtcttgctgtgttgcccaggctggtcttgaatgcctcaagtgatcctcccactatggcctcccgagttgctggggttacagtcatgagccaccgcacatggccctagtttatatttattaattggtttaatcctcccaggaatttgaagatataattcctgatatataggtgtcagaatttgagactaagagtattgagtgataattcatttctcacctctctggaagaaggtgtaataagcatagaaaatacagaattttctatatactgatataacacatattttcttgtgtgtatgtgtatatgtgttgtgtgtgcatagtgaacaaaggcagaagaaacatttaggcttgaattttttgagctaagtattattttctagagcttaccaaaaaatccaaacacacatatatgtatgtagaataagcgtaatgatctcctgtgtaccctcaaccagcttcagtaattagttcatcctgtatataccctgccacctaccaatattattattatcattatttatttttttgagacggagtcttgctcttgtggcccaggctcgagtgcaatggcatgatctcagttcactgcaacctccacctcctgggttcaagcgattctcctgcctcagcctcctgagtagctgggattacaggtgcccaccaccacacctggctaatttttttgtatttttaatagggatggggtttcaccatgtccaggctggtttcgaactactgacctcaggtgattcgcctgcctcggcctcccaatgtgctgggattataggcatgagccaccaggcccggcctcaatattattttgaagtgaattccagacaccctgccatttcatccgtaaatacttcagtatctatctctaaaagatgaaaacttaaagcacacatgaccacattaccacactttagaaaatgaacagttccttaatatggtcaaatatccagtctgtgcccacatttccagttgtctcatgattaccataacttttcccttcagtttgcctgttggaatcaggatcaaatactgtgtgcacgttgcagttggtggagacttcttctgaaactcctccaatgagtaggttccatgaccgtctttctctccttcccggggcctgtgtttgtttcgaatgcctccccttggagtcagtcagcgtgctcctttgtctcctgtattttcctataaattagtgggtgtttggaggcttgtttaggtttttagcttttgtttggtttggttggactcctttctgggcgggtctgtgtggttcatcaggaggatcccaccttctatttgtccttttgcccacgttagcagtcgggaccagttagctcgtcagaggttgcaaaatgatgattttataattctctcattattttttttgctgttatttgtttaagatgagataattctatgaagagtacctttcgggtcatgtaggaaaggcaagataaccctctttatttactaatcgtaaaaataacaagttttggtttagtagactccgtttaaaattgactaattagttttagatcattgtgaactctctggattaaatgtacatggtgcattgcggtgaaagctgttatggatgctccagtgatcccatcttctgcgtgtggaagcatttcaggaagccttctgtgttctcttgacatgacattgaccacttcctggatttctgatgtcacaggaaagataaagatggacagatgccccaggctcatgtggtacattggtcatctctctagcagtcacggttctcagggacacgaacataattcctcatttgctttgggcttccccatacaattctcagaagacagctccagcagagcttccaacagtgtgaccaccagaatgagttcaacgtgctgcaaattgcttttcctctttagggtgtatctcactttcggtgataaactccagttattgtgttttaaatcacatggaattggtcttctctgtgactcttctatcctggtggaggtgtacttagatacatttctttattttcaatttttagggaaatagttatataactagttaacatatttgtgtggaaccaatgtcacatcatcaaaataaattctaagagtcctggctttgattcttaaagataaattcaaagactctctctttgtcactttttcaccttgtcgtcttctcttcacctataactattttttaataagtattgtttatacttgtctcttttaaatataagcaaatacatgcgaatgggtacttatataacctcctgcttggatacaggtagcttcccatgcactgtttttcgtttgcctttttaacttaggaacatgttctggaaaccactccatagtgtgggctccagaacaggcctcattgtgaaactgttcccaatttattaacaggtctcttattaatagacgttgggatcgatccagtttcttgtttttgtttgttatatatatgtgtgtgtgtgtgtgtgtgtgtgtgtgtgtgtgtgtgttgctattgaaaaatagtgctgtatagtctacgtctatctttttcttatttcttgtcaatgtatttttgggatagatgcctagaaaggaggattgctaagtcaaaagggtaatgtgcatgtagtttcgctaaaggttgccaaattcccatccataataagtgtgccaccagcaatatacgtgagtgcctctttcccaacagggtgctgtcaaactattggatgtttgccagagaggcacagcttggtttttgaatacatcggatgtaatcaggatgtgcagtctttttggttcctagaggctgactgggctctgagaagcatagaacatttcctcaagaggcttagagtctgtttaggggtgatgaggcttcctggcagttccttaaacgtcagtaaacattgttcgtgtgcccgacctgggccaggctctgttagaagctggagctgtggacagggagtccagatggactggtgagaatgtcacgtcggttgaggatttgaataggccactggttttggtaaaaaggtggtaaggagtgggcacattggacttagacctcctgggcttctgtctgtaccagctctgaggtacctctcctccgtaagacgctcagcctctctgtatctgtggggtcttgataataccaatctcatggttcataggaggcgtgatggtggtgatggtggaagtgaggaaggagaggacgcaagagaatgggagacaccctggagaagccaagctggggagggaaggaagacggctcatgaggaaggccaggtttttggttgggagagacttgagcttgatgagtgtttggacaatactggccctgatgagggagcgattgcagggacggggtgatgccgatgaagaggctggccacaaggcagaggggaggctgaaagttgtgtgaagatggctgagtgggaaagacaagcaagatgggagtaagggaggatgtcttggcctttgtgcctgagcctgttttctctgcaaggctggaaagctgacctttatggtgatatctgtttggtactgttagagcgatttgtcctgcatttctgggcaacctgtgggcagaagaggagaaggatagatccttctgatatctcctgggtttggcagttggcatggtggatgtcatgtgggtgacatgccaccaggatgtcttagctggggctactgtagcaaaacacctaagactgagtggcttcaacaatagtcgtttatgtctcgcagttctggcggttgggagtccaagatgagggagccagtgagggcaggctccggtgagggctctcttcctggcttacacacggctgccttctcgctgtggcctctcatggtggagagagagagagaaaggctggtctcttcctcttcctgtaaggacactgatcccatcatgctcctcacggccatgacctcatctaaacctgatcacctcccagaggccccacttcctcatgacatcacagtggggtttagggcttcagcatacagattcagggggacacatgcattcagcccataacagggtgagggtgcagttcttcagctggagccccaggaggctcttggggagaaaatgtttccttccctgtggggatctaggctttgctcacctgtgctgcatggtgattgttgtgaattttgaaagggactgcttcccatcggtgcctgagtcaaggcctaggacttgatggatggtgcctggcagggtcagctgcttggtgcaggttcctgtgcccatgtcatggtacgtgctgtccgctaagctccctcccagcccttagtggtcctcactgtgaaaagctgattttgagtaaggctttatcccacccagggatgaaatggcaggtgttaccagtcagggagtggggtgggaatgggtgtctgcaggggaggctgcacagacatggcggggggtggtggccagtggtcaggtggccttgggtcgaaaggccgactgaccaccgtgtgacctggccagggtgtgggattgcatctgcttccctgcccttccagtgggagtgaccctgcttggacgtagcagggggacggtggtcttggattgaatggctcactcaccaccctgtgacctgaccagggtatgggattgcagcgtgcctcctcatccctccagtagggatgaccctgcacggatgaggccgggggcggtggccttgggttgaatggcccactcaccaccctgtgacctggccagggtgtgggattgtgcccggcttccccatccttccagtggggatgacgacaggcatttgctgagttccatgggactgtggaaagggctgtgtcactgtagacgctccatcggaaatgctgatgtgtattcttaccacgggcgtccgtgggccaccattgtctcctggcatctggctgtccttggaacccagcaacacccagggacttgggctgtgatcagaagtcctgcccagagcgagtagggtcacgccagagtgaggctggggacagcatggtccactgtggcccagatgtaacttttagtcctgccttcttatccggtttggcaggaacaggacagggtggttagcaggccacagtgtggtgggagtgaaagtgtactgtcctgtgtgatatttttgcacagcctgacagtgggggcaagtttagagcctttgagctgagaatctggagagagcagtggatgcgatgggcagttgcttgtccttgctgtgagaagacaggccacggggctgcacccagcccccatgggtaagtataacccccaccccactactgcccgcccaccatgccttccccacatggatgagttgctccctcctataaagtaggaaaacatgcttaccgctggagaggatgcctaacaacagctcctgctgcccagcgaggaagggaccctgtgtccaagagaaaacctgatggcaggtaacacatcacccctctcttttagggacctcgtccctttcttttagggaactcattggcttgtcttggacccaaacataattagtgggggtaggggtgaggagagaaactcttcagtgaacagatgtcttcttgggccgattgttggatattgctcaccagctagttattaaattctagaaaaactaattctttgtgcagattctaggtaaaatgtctctgttgcaaaataggatttttcaattaagaaaagctttaaaatatatcatgtgttcctccttagtctgcagaatctgaatgtcaccttaaaatgtcagggttaaatttcttacggttagtacatgaggcaggcgtgaaatttacaacagaaaattgagattgattactttcatttactttctcttttttggggcagtaactgtttaatgttaaatttgtattgtatgtcggtgcctcttttgaaactggagatattgatatgatcttaagcaaatgtctccaatacgagaaaaagaggactgatttataaagtggaggactgacacataatgtggaggactgatacataatgtggaggactgatacataatgtggaggactgatacataatgtggaggactaatacataatgtggaggactgatacataatgtggaggactgatttataaagtagaggactgacacataatgtggaggactgatttataaagtagaggactgatacataatgtggaggactgatacataacgtggaggactgatacataacgtggaggactgatacataatgtggaggactgatacataatgtggaggactgatttataaagtagaggactgatttataaagtagaggactgatttataaagtagaggactgacacataatgtggaggactgatttataaagtagaggactgatttataaagtagaggactgacacataatgtggaggactgatttataaagtagaggactgatgcataatgtggaggactgatacataatgtggaggactgatacataatgtggaggactgatacataatgtggaggactgatttataaagtagaggactgatttataaagtagaggactgacacataatgtggaggactgatttataaagtagaggactgatgcataatgtggaggactgatacataatgtggaggactgatacataatgtggaggactgatttataaagtagaggactgatttataaagtagaggactgacacataatgtggaggactgatttataaagtagaggactgatgcataatgtggaggactgatacataatgtggaggactgatacataatgtggaggactgatacataatgtggaggactgatttataaagtagaggactgatttataaagtagaggactgacacataatgtggaggactgatttataaagtagaggactgatttataaagtagaggactgacacataatgtggaggactgatttataaagtagaggactgatttataatgtggaggactgagaggcagttggatctggatggctatttttcaaagtcaaggccactcagccagatgaatccagaggcatatctaggttctcttgattgacaggaacctgcagaccagctgtgctcttggtcctgtggccttccatgggagagggtatgggaagggctttggtgcaccacagatgtcttggcctgtctcttccgatgacttccctttgcttataactcacacctgtttacttggagactgtgaattagatttttagttttgcagcaggaaaatcatttgaaattatagactatccctcttgaaatctcattacataaaaagatttaacaagcctcttgtgaataagttagggtgacaaggaatgaattatttggagaagtaaaaaaaccttaaaaattaaaaaaagtttttacaagtaataagaactttacaaaattattgtgtgtattaatatcaaagggagatactgatgaggacctgaacaacatgggtgatgggtaaaaggtcattgccaccctgagtttggaaatttgaggtgctcgttgctactttgggttcagaatagttatgatttatgataaacctaaaaattaaaagtaccacagttttctctcaaatcgtatgtgggtgggttgtgtccagaaacaaataggaaagcttccacagatggaatgaaatagtggaacagatatggtggttttgttttggaaaggatttgtctccaaagttttggggtggaggcattctagtcttgtttttcttctgagatggaaacactggcaaacttggagtcttctgcaaaactgtatcaagcaaaagtgaaacagtagttgctgtgtgacaagttagtattttgtccatgacatgtagcaatcagtagaaatagataaaggatgggatattggaaaatcccctggagatgagaaacggtgggtgacatctgatgagaggaggaggattcagggagcagaatgaagacattggccaggcaagcatctcagtgtggaggtggggctgcttagacatttaaattgacctaaatcaagcagttattaataagtgggcaaaacaccggaaaaattgcactccattcctgtgcctgtcagggctgttctattatttggaaacagactttacttacttaccttattgattgagacagggtctcactctgttgcttaggctagagtgcagtggcacgatcatggctctctgtagcctcgacctcctaggttcaggtgatccccccaccatagcctcctgaatagctgggactacaggtgtgcaccatcatgcctggccaatttttattttattttattttttgcgtttttttgtagagacgaggtctcgctctgttgtcaggctggttttgaactcttttgcccaaaccatctgcctatcttagcgtcccgaagtgctggaattaccgtagtgagctgccgctcctggcctactttaaacatctataatttgtgttcgttgtaggattattcacggtagaaacagggtggaaaaaaatgcccacagcctagcatttcaaggtgcagtgttttagttcttgtgtctgtcattacagatgtgctttacctgctcccattcacaccttagaacagagaggctcctgtgtataaaggtatccgtaaagcctcatgccctgcatttcacatctagcaatatcataagtagagcatcttcaccaaattctgtctgtatcatcttgagtacacagatgtgtcataactagccacacttctttggacatgtaagtcgcttctcagttttcactattctcagcaatgcagtgaggatattttcatgataacctcattaggctctttgtgatgttgtcctggatctgtcaaaaattggtctgtcagaaatttgtttttaacaataatagctatattgttgcattaactccagaaagttttaccaatttaccctctaaggagaatagacctccttccccatcccccccacattcaggactttgcatctgagggggaacctggccacgtggttggcattcctgagccatgccaggctgctggagcgcacaaattctttcaccccagcaagcccggctccatccaccatctgtgcactcaggccccctccccctcccccgccccctcccctcccactggcggtttcatttttatttcttaggctttataaggatattgattatggacttttggctgatttcagatctagaattacagagtgagatggaaaaatgacagaaatgcagggaaaagtcgaagcacagtgtgtgggagttgcatatggcgagatgctcgagagattgtcattttccttaagtcagtgaaagattgtcttctcaataaatgatgtttgctccgcttgtttcatatagtagctgtaggagaccatacctctccagccttctcttgtgtgcatttgtatgtggggttaattttttgtttgttttgagaagacggagtttcgctctgtcgcccaggctggagtgcagtggcgtgatcttggctcactgaaacctccgcctcccgggttgcaagcaattctcctgcctcagcctccctagtagctgggattacagtcatgtgccaccatgcccggctaatcttgtatttttagtacagatgggattttactgtgttggtcagctggtctcaaactcctgacctcaggtgatcagctcacctcggcttcccaaagtgctgggattacatgcatgagccactgcgcccagccagtggggttaatttttgtgatcattgtctggctgttgattattacttgattctcctgctgtgtgtcttctctctttctgagagccacaaaacaccacgtccccttgcctgagtctctagctagctctgtggcccctaggccacacctctgctgcctggtaactttccttgctgcgttgtgacagagcccctgtggccaggcaagtgttgccttggcgctggtcctttctgtgaatatggtggaaagttgatctcagtccttccagggaactagtcttacagtatatgctggaggctactttgtgctgatggttgtaatagccacaatttagtggacagccactgttgccaagtatcttatgtacattggtgacctcttataataatttacaaaatccatgctgtcattgccattgtaaggattaaagtggcaaatagtgaatccaggtttggtgtccaggggtgcctgatcttagagcctgtgtgtggggattgaactggcaggaggtgcagatctctcaagcaggtggggtgtctgtgggacaggggacagctgtgcagtcagcatcagactccagttaatacagaatgcttgacagctcacgctccccacatcacaaaatccaggacctggaagggagcagtgagcacccacattgaggttatttcatgactgtattcacctgacccccactgatgacctcccatgtgaggtgcacacatttgtctacatgtgaatcctcagctctggactgttgggaattttggaagtagtggctgggcagccgaggaaagaagtgaagctgggtgggcagaaatcgaggccccaggcccatcagcctgagtggttgggaggagagcttggagctggggttgtacgagaattgggctgggcaaaggcagtgtccaccttgttgggtgatgaggatgggattcaacaactacctgtcctctggagattgaaaggttaaaataaggcttgttggagcctttgccatctgaagcttctgtatggttttggggtcaaagtaggtttggggaggcaaaaatgagcccccagacactaagaagagaaggcacaggacaggccaccatccatcccctgctgtcccaaaactgacaagtctcgtacctctgacagtaaaactccccgtaggactacaagacgtgggtcttggagctgcagttggcctcaaatgcaggttcacgaactgaccagagccagctgctgcagaggctgagctcattcgcagtcttggtgtatctgaactcatgattgaaagattttgatgtacagtcgacttgccatatgcctaatgtgatatcccgttagactgtgcttccgctttagataggtagtagttacaagggctttcacgggagcccttgtgccttagtccctgtgtccgtttcccattgcagctgtacaaggttaccccagatgcagtggcttcaaacaacacacatttattctgttatagttctggaggtcagatcctaatatcaaggtgttggcagggccgcgttccttctgcaggctctagggaagaatttgtttccttgctttttccagcttctagaggctgcccacactccttggctcatggccccttcctctgtcttcaaaaccagctgtgtagcatcttccgatctcttcttccattccactccatcctgacgtccccttctccggctcctctgctttcttttttcatttgataaggacccttgtgattacgttggacccatctggataatcttgaatgatttccctgtcttaaaatccttgacttaatcacagcgacagtgcctctttatcatgtaaagtcacagttgcaggttctggggattaggacttgggcatctttggggagggtggtgtctgcccacctcagtgtccttcctctgtgtttctcctgagggctgactcttccctcactgtgggagaccctgcacacctgctgtcattggggctgagccagtcaacaccggttgagggtagggggacactggccaacccaaaggctcttggcggtctccacagacttccacttcagtttagaaagtacagtgagaaaaccagtagctgaataaagatttagggtatttggcacagatctgctaatgcacgtgtccgcaaatctagactcagcacaaggagtcttagtttgggatcacaactgattctcctggtccagtgatacctctgggctcttgttcattggctggagctctcctttttgctgggaggcagtgcttcatcttgcagttcatgagatgactggcacttttgcagccggcctcacactgctggttatgtgcatggaagaggtctcatctcactccttcctatggcttttctagctgggcagactctggttcctgtattctccccctcaactgtagtgttgaatgttcactgcccatcctttctgccctgctctgtggctgcctgtcctcatctctgcatcggtcttctcttttcatgtcctgtagctcatgagtgacccgctcccatgtcacctgccattttggccttgaaatttggtaatgattcatacatgtgtcctcgcttgtgccatatccagtgggacaagggaattgggacacctttggttctctggtagctttgcctttttttttttttttttgagacagagtcttgctgtggcacccaggctggagtgcagtggcgcgatctcggctcaatgcaacctccgcctcccgggttcaagcaattctcccgtctcagcctcccagagtagctgggattacaggtgcctgccaccacgcccagctaatttttttgtatttttagtagagacgggggtttcactgtgttggtcaggctggtctcgaactcctgaccttcgttgatccatgtgccttggcctcccaaaatgctgggattacagacgtgaacccctgcacccggcctagctttgcttttaaattgcaagctgggactccagccctgtgaagtggctgtccgcattagatcggacacctggcagacacttgtttaagttttagaattttaaaaaggaaaatacaggagaaaaagtagagttgatcacaaaaagtagattttgcaggaaatagtttaacttttaaaaaagttatcaatgtgttatatgcaaatatggaaaactataaagaagaagaaaacagttgcctataattcttctagctggaggtacctgctgttactcttggggatgctttttgtttttctacctttgtagctttttagtttttttctaagacaaagtctctctcttgcccaggctgcagtgcaacggtgtgatctcagctcactgcaacctctgcctgcccagctcaagtgatcctctcacctccacctcccaaatacctgggactgcaggcccacgccatcacacctagctaatttttgtatttttgtagagatggggtttcacccagaatggtgtcagacttgggtttaagcgatcctcctgcctcgggctcccagaatgctaggattacaggtgtgagccactgcacctgccctacctttgtgttttacgagggttgtatatgtatcacatatgcagtggtttgtccagcttttctcctacagtgacatttttctttgtcctcgccttttcataaactgtctttttaaatgtttgcttgatatttaatcatggatgtattgagatggactcatctcaaactatattaaaaacactctggatgctttaaataaaaaatggcaaaagttaatgttgtaagagaagtgaaaagaaaaccaagagctcctacctgcctcagcttaccctttgtttggtgcgtgggtgcagtgggcagtgagccgtgccattccctcctggcagccggtgcatggctggccatggtccttagcagtgactgtgaacagccgtgggctactttgttacccacccagtgctgcttttgtatgttggcaaatggggctttcgctttccttggtttgattctgtcattgatgcttcagactagtcatgcttttgtttgaagggaaaaaaaaatcaatcaatcaatatcagtaacttgctatagatttttataaaggaaaaaaccccaccacatgtatggtggggagtgagttgatgtggaatcagtcatgaccgcgttgagttaggagcatcgcggatgtggagttacagctctgctgtggatgtttttgttttaagaaaacatcttttaaaaatctaataatggttcattaaaaaccagaaatggtcaagctcactagaaaccgtcatcagccacattctgatgaaagaggttttgactttcttttttaaaaaattaatgaagatacatccaaatatttgtggcaggcaggaaatcaagcggattttaatgggaaattatgtaagaaagcttaatgactaatttttctggatcagacaagtggagaacggtcttagggaaatgtgtacatccattactcattagtttgctgtattataattactgttgtataggaagaagcatgtcagataattaggaactgggtggcattttatgctaaggatcaaaacaaagattttgcttggaatgttgagcaaaattatactctggctgagattaaacacatggcaagcatcctactccagtatttaaaatcatcaggcaggctttattctatttttttgggtctttgttctttcatgttttcctctaatgaaaaggaatgcttagaaaatagcactgggaggccagcaagaaatcagtgttgggattttctcatgtgtgaggagctgttactgctcctgtcgcctggtttcacccctcggttctgctcccaggagctggacccctccccgctggcccctctgtgctgcaagcatccattttgggcttggggataatggtcaagagagttggttggtttgggctgtgggctggacaagcgcttgctgcttaaaccatgttgattgtggcttaactgctgaaccaaaccaatacttcatccaaagaacttctccagggagggagtgggcttcaggggagccacatgggaagccccctaaccaacatttctgtagcacttgattggagcctccaaacaccgtcgctgtcgatgctacagcagtcctgtgggccgcagaaggagtactcactgtgtgttctccatgcccttctgtctctgagaagcagcgtggcgtgttcggattgtgccctcctgccgaccccggtggctcaggcaaagggcttgccagatggtcggtgttctttgccaaatgggaccgatagcgtgcgcatggtggggatgaggggaggactagggaagtaaatacagtgcctgctgccacgtcaccttcacacagtccatgtttaataagaggtcgctgctgtgatgatagggggtcggccagacatgtccactgtttaaaaagcagcatccatctgaggactcattggattaaatgtacacctaaaaaaaatacagtggcacctgcatgcagtgcccgaggatgggtgtgctgttttactagatctggtgttttttggaggtgcacatttggtagttcattgttgggttggtatttgtctccataacctgtttcagcctcaaggtcatttacctttgatcagtgcttcaagcttagcggtttgtttatatacatgttcatgtataaattatattactcagtctgatcataatatatgcccagtgcaaatcatttcattaaagcctcagggatacacggtgccaccgtttcctcattcagggacacggggatagtggtagtgtgtcttcagcacgacatggggaaattcaaaggcagccatccgtggaagagccaacggcagcccgtgcaggcgtcagcgcctggggaatagtagcagtctacatctttagctgtcagggtatctcgttgtagcctcatcctgccctctttaggggtccttggatgagttatcagttgtagtattgacattttctgtaaatagtgtcactcaagcgagtgacagtgggaagcagacaccagcccttagggagcagcccaggatgcttttttcctccaaatgcctctcacctattcccagatactcgctggagttggagcacacatgtctgcagatgtaaaacgacctgctcccccaggtgaatggattctcgccagggccaatacttatccgcaggggtgtgtgccaggcagcccaggtcagcctccctccaccgggccacccgcaccaggttgcctcccatcgtttgcaggagcggaagacccgatggagcaggtttcacagtgccctcgctgctgcctcccgtttcatctgcacgtctctttcaatgcgggcgtgcgaacttccaggtagagccgagttcaagaaaatgaagtactgcatgcgacgagcaagtttattgaagagggtgtgaggtcgcggcgcctgaccctcattatgtcagttactactaaatgaaattagaacttcactgccctttttctttttcccatcgaggtgcaggaggaattgatcttagggtagtattttggatttaaaaaaaaaaaaaacatgaaatgaaatccgtgtcctctttatcctcccctctctctgttctgcgcggcaggtagcaaggaacggtggcggggccaaaggtttcctcaaagaccctgggggccgggcggggctgtgccaggcacccgcgtcgcgctccagctccagccctttaatgctctttgccattcaagccactcactttcattttctatagaaaagcctttctgccgcctttcacaaaacttgtattttcatgcctaataagtgagcgtgtgacatgcagtgggctcagtctctgcatagcccggcaggcagcggctctgctttccagaaccttctgggagtggcagacacacattaggagtccacgcgcaggtagcctggcctttgaagctctccaggctctggccacagtggctttcctgccctccttggctggtggacgtaaggcccctcgccccatctgcttcctgctctcccagagccggcctcaccttcgagactcatgctactaagttgtctttcagttcccctggtggtgcctcctctagacccctgaggagatggagggggctgccttctttgcggctttctcacgatttcctcacagtacacacagcaggaccccggggtttgtgtgtggcatcctacacacacacacacacacacacacacacacacacacagcaggaccccggggtttgtgtgtggcatcctacacacacacacagcaggaccctggggtttgtgtgtggcatcctacacacacacacacacacacacagcaggaccccggggtttgtgtgtggcatcctacacacacacacagcaggaccctggggtttgtgtgtggcatcctacacacacacacacacacacacagcaggaccccggggtttgtgtgtggcatcctacacacacacacacacacacacacacacacagcaggaccctggggtttgtttgtggcatcctacacacacacacacacacacacacacagagcaggactctggggtttgtgtgtggcatcctacacacatacacatacagcaggacccccgggtttgtgtgtggcatcctgcacacacacacatacacagcaggacccctgggtttgtgtgtcgcatccttcacacacacacacacacacacacacacacacacacacacacacacacacaccccttgcttatgtcctccacccgtccctgaaaacatgaggtctgcgaagacgtctttgagtctgtttggcatccccaagtgcagcggtgaaccagagagagagggagcattcacttgattcttcacgcgtcagtgtttttaatctctgtggctggaggacagtgtgtgtcaccttttcttagtttccagggactgcggcttccttccacctctcccttccctctgtagttggacaggccatggctccccagttctctgctgtgggcaggtgcaggagcctgaccaactcctccgtgagtccatctatctgtgcgtgcatttattcattcctccctagtgaggcaggtccctgatgagcagctcctctgcgcctgcccaggtccagcgttgggcatgcagtggtgaacaaaacagactcaaacgcatcttcacagagctcatgttttggtggacaagtggaggatataaacaataagcacaatttagtaaaacatacggtaccacagctagcaaaggtggcaaggaaaacaatgagagcgggggtggtgtgaatgtgtgtgggtgcaggggcacctcgggagcctggccgggaaggtggcatccgctgcaggcccaggtggggagatggtgggtgctgcttccaggcccaaggaagagaaaggcagaggccctgaggaagcacagagcttgagggagagggctggcgtcagctcagggaagcagggaggccaggcggggaggccaggtggtgtggggcctcatggaggctggggagtcatgaggatgtgggaggatgggggagctctggttgctcaggcagtggggagaggacagcaccatggtaacatgcacttgtgttcatgtcttggctgccccattgctgggcacgtgtaaaataggagaaatcttaaagcttgcagctctccatgtgaaaatgatctgtttgtttcttcttattactatcaatattaatattgatcctgtagtgctttcacacttaaattgttgagttcccagtcttgtctaataattatctcagcaattgcgataccattggctgaggttcatggaggttttcaggctaatgtcactgaatgatcggaaggactcactgctggcagtcacttgtgtgttttgtgtttttttttcctctgtctctcgccctccatttttctgcacggcattaagtcagccacattttagattgtgtgcttctgtcatcagaatatctggcatgctttcccctgaatagcaggcttgacatctttttctgatattttgtaccaaccgtactaagaggcttcttgttagctgttaattcatattttctgaggctgctaatatgcgtggtagagccattactgttgcatgttcaagataaaagccaaatctcagcttataccctgttctcccaggataaattcagagaaccactatgaagtctaatccatactgtgatgttgctgaaaagaaaatagggttataggcttatttggagcctttcactgtttatggttgtacaagttgggtgttactgacttataatgtaaaatctgaatttccagggcagggacaagattcgtttttggctaaggcatattgtgtctgtggggctgctgaaggaaaaagagcatcttatttttatgtgattagcattattcaatcacaaaatgcattggattctactcagactgtcggagaatatgcttgctcctctcctaggctctggaggaagaacctcagccactatgtgtgtgtgtgtgtgtgtgtgtgtgtgtgtgtgcatgcttgtacgcctgtgcacagagggtgggaagagggcttgcacctaagtcctagggtcctgttctctgcacagttctctgcataggtttccgcacgccttgctgtctcctccttgttgcaggcatggagcaaattatcacctggtggtaactccagtctccgccacggagactgcttaccctcttcctctttggttcaggctgaaccatcctcactcatcttgtagagcctcccgttcccatctccgcatcagagtttcctactttccttgaactttcctttttgaggagatttgagaagtgtgttgtccaagataggatttagtatcctggagccaggcttggaattctagtgtgggaaagcttacttactattactttattatggcattttaaaagtttttaaaagtaagtggaaaaaggatttttgaacctgttattactttcttatagcattttaaagccatttttttttcctagtgggaggcagaaggaaaaactcggtcatgtttcactcactcctttcttaaagggagagttttatattgtaccttcttgttcacagccaggtggcagctacattgctaattgcaagctttcagggtgagaaagagaacccgtgcctacctgccttttcctgatttgaaatggtgatctgcgttggtctcaagaccttgtgcagcctcgcagagattgctctgcacacatgtgattgcatctaatcaggactttttctgaaactgctgccaggaaaatgtgtgctaggaaggttaccttctgcagctggacttttatgatgcactggattatcatggccttagatataccatcagggcatggagtggcaacagtgctttgctgtcttgacgcatctcaggtagaggatctcttagggagctttctgattgaatcccacgcccattttgagggaagggaatgggccatgggtctcatccctgcctagcgctgccttgtgaggggtgctggcctgtcacctccagttcttgctcctttttaggaagccatgctgcctccttccttgttgtgcgattattttttgggttgtgtctattttggtatttttttctctttcacctcctctcccatatttcccctctagggtgggaggaaggagacccaggtgtgaggtggtgcaggtggctgcagtgtcctcagagatactgagctgtggggtagaggtagctggaatctagatcaactcacctctcttttatcagccatttgttctgagaagagaggcttcgaggagagacgcttcggtaaggggttgctgtgggtcctggggtcacgggtgttagttctgggtgccactgggggacacgagagacagaaaggataggaatgaaaatgaagagcaactaagggatgtgaagatttctcttgcacttgttttcgggataggaaaacaagcccttttagtctggggcaaggaagtgtctagtgcctccacctggtcatccaccgcggtcctcctggtctccgttcaggcccacaggactctggaccgccccatccctcccagggaactgtcccatgtcctgctcaggaaggtggtggggaaggggtaggcaggatggacagatggacagtggcaggtggggacacctccatctcattttgttcctctcaatccgtttgtttttttctctccctccctctctcctcttttttttttttttttttttgagacagagtcttactctgttgcccaggctggagtgcagtggtgcagtctcagctcactgcaacctctgcctcctgagttcaggcaattctcgtgcctcagcttcccaagtagctgggattacaggcacacgccaccaacgcctggctaatttttgtatttttagtcaagacggggttttgccattgttgaccaggctggtctcaaactcctgatctcaggtgatccaactgcctcggcctcccaaaatgttgggattacaggcgtgagccatcgtacccaacctcaatccatttctttatcctaattgagagaatttgaaaagaaattaatagaatcaaaaaagagaaaagggcctggttatcagagatgcaaaataaatgatgattttaaagatgctagaaagctgtgctccctccctgggtgctttctctttggaggggaatgctggagaaaatctctacaaaatcttccccttgcagtgctgggagagagtaatggtgagcaaatccttgtagaattaaaatgggatgaagagacccttatgaagggagaaagcaggtgaagatggtggggataggggcgggacgtgcacccccttcactttccatgccgggcagtataaaaagtgagaagaaacacttcagggctggtgtgtaaacttcatgttggataaatacgtgacttctggtattttgggggcatggaatcaaaaagttgcagatttggagggatgtttgcagccactttttacccaacatggctctctatgtggtcattcagttgcttaaacaaagtctgggtagacttacaatttttttttaatacaagtaatatttgcttatagttttaaaaaagggagtataaccatcaaaagtaactctagcgaatgattttggaatattccagaaattttctatccttatataagctctaaaacagttaaacgcagtagctctatttaataatcaccattgggcacgtggactttcatcagtacacatagatttgcctcacacaaacaagaatgaacttgaatgtacagattaagggataataaaaatgccagcctggctgccatctggctgaggagacgttttacaagaacctttgaagcatcttgtgggcctcttctccatttactttgcttccactcccaacccccttcctaaatcttctgtccattatttcctttttccattcttattctttttttttttttttttttttttttttttgagacgaagtctcactctctcgcccaggctggagtgcagtggcgcgatctcggctcactgcaagctccacctcccgggttcacaccattctcctgcctcagcctcctgagtagctgggactacaggcgcccgccaccgtgcccggctaattttttgtattattttagtagagacagggtttcactgtgttagccaggatggtctcgatctcctgacctcgtgatctgcccgcctccgcctcccaaagtgctgagattacaggcgtgagccaccgtgcccggcctccattcttaattttatcacttaacatatttgtatctatatctgaatctctatctcattatgtatataatgtccctaaagtatatattgctcaattttacctgtttctataaactttatatagatgtaatttacctgtatgtggttctgtgacttgctttgttggctaaacatgatttctggtaatgagtcatgataatgcacgtcgctatagttcatccattttcactgctgtataatattctacttaatgaattgcatggtatgacctccattggttcttctaacggctgcattatttatttttttctgcccacactggatattatcttgacatattaaatgggtaaggacctaagttgtgaatgatcaggttgttccaggatggaagttgttatcctttgtgcaaacagggttattgctctcaaggctagaactgtttgtgtgctttgtattttcactttcattttttgcagctggacttcagagcaagacctaggaagcaaagtgcagttcagacagtgggtcccgggggggggccagttgtcagagagcccggagttaggtgtttgaagcctagtgagcagagacccatcctgagcataagggccagggccagggacttggccttggccttcagggagcccgcccttgtgtggataagcgggattgaatcctcagatgaaaaggaagcaatcaatggagctgtttgctcctgcagcttcagacagcgccatctctaccggatcaaaagagctcatcaactcccagcctccatcaccgaaaaagaaagtctcatctctgtctgataatacctattcattgttaaaaaggaaaaatcccaaatccgtacatcctcctgacccatgtgatactgatacatacctttgatgtgtccattcagattaaaaattcttaacaaaatgatacatattttacatgtacaatcatttcaaaatatagactgttctgagaattgtttgcaaatatgatcataaaaagttgattttcttggagactttaaaaaactagtttgttgtatttgctttgtcaatctctatgtaagtaatatatgtgtatttttgtgccaagccatttgagatgccctgcaggccccatggtgcttcagcctccagcactgctccctgtgtttctcagaccgaggcccctcctgtaaaaggctctgaatctcgctttcacctgtgtgaattgcaccacccaaggggaggggtccagttgcattgggcttttgtccttcgttttcctgacctggggacggtctcctggaagcctgacttcctgtttgctgagggtggacttttctttgggacctgtttgtcgagttgagccgggagccacagtcattccctccctgggtattgtgcgaccctgctcccgcctcctccccctcccccccccccgccccctgcccctcgttgggtgttgggtgttgggtgttgggtgttgggtgttgagtagcccagggcttctctttcctggctgggatgcaggcagtagtcatatcatcacagtcatcaacagccaaagtgactcagtgtcgcccacaggttctgagtgggggcttgactgagccaggcagcatcagtgagaaatgcctagtcggaaggtacccgttgttcaggatgaagttagtggcttccctgccattcggtttccactccaggagagagttgaatcagagcctggaattctggctgatgggctgtgtccccgtgtacggggagaactgctggtttcagtcttaaccaggggacgaaggacatggcagagcatccagagaagaagctggggctcggcctggtctacctggctgggaagaaccgtgctggattgagctctgcagcaagggctgtggctggccgggggtgtttccccggcctctccccagcctggagctgtggcgcaggtgcctgattacagtgcttgggagagcagtgagggcaggtggggggttgacctcactctccaaggatctgtgtttcctggagcccttcttccctgcaggcctaggaggctgggctgaaaccacctcgggcctgtgcatctgtaggaacagcacgagagctccttggagtggtagtgtcagggcggtagccatctgagctcacactggccctaggggctgtactttggggtatccaggggcaacacgtgccctctaaaagcatagacctgtcagggaatcacgggatggttccagggtaatatctggtcaagggcttgcggcagataggaagagttctctctctgccgcctgtgcccaggccactgctgtggcctagatcgggttggctctggccgtgccccattcctcatgtgctggctattgagtcaccccctgcccccactttaaacaagcatgtttgaatgcagagcgattcgtggtgacagtttcataaggctaacgttgaatatgctcaaatgcttaaaaggcatttcatttgtgaatggcagcatgtctttatgaggggtgacagattgctcagatatgactttccctggttttcaggaggggtctcttcctgtccagtggtccagggctggtcaggcggtgtggcaggaacggagccagcagactccctcttggtaaaattgtgcaagaaacgcaccacctaggtttgtgcctcctgccgttgcttacgaggttctgagtcccgcagggactggctttcttcctctgtaggagtttcctaccatgtaagttttagaaggaaaggatactctttggggcctcagcggtccccttaggctgagcatctgaaccttcccgtggtccgtgtggctggaaggaggcttccatcgctggaaatccatttctcaaggcgaggagccagccgggccgaccacggagccccttcctctattatgcacgaagtcatccaggtgtcatcccatcagtggtccaccaaggtgggacagtgcagcttgggccgggcagaggtggggaggcctgctgggtacccctgctggattgtagatggcccccaaaaccaatgctgcctctcacaggaagcccttcgcctgaggctctcccacactgcaactgtcaaactcgaatttccagttgatgtaaaatctgtcttcctactggaatgttgacttgaggggacctttcatctcagatttcagacttgctttgtttctgttgggtcacgttgctgtcttctcaatactcgagtattcttggtgtggtggggaagtttttgagttaaatttgaatagttttaaaatttaggtttgagtttagcagtattctaacggggtaaggcgtcacttgacatactgataaatcttttacattctatatagtggaattagacaattttctgaaccttccgtcccaaccttccatcccttaccctggttcttgctactttgttgtttagatcatggtctgttagcggaaatatgactccatgtggtccatgatatgggcaccttacaagttattctaaataatggcacttaggttcaaagggcttgttaataatagtgccattgaggaaaatcatttgggccatcacccccttctcatgttgaaaatagcgttaagtgttcaagagtgtgatcggtgaaacacagcttaattcagctctacaggtgtgagtatttagccctggaaaggaaggaatgattattgcagggttagaaggttcaggagaacagtgcctccctcctagtcacagttctgcagggctggcgtgtgagcccttacttagaggtttacttataggaagtttgagactgagccagaacctttctgggtctcttgcacctgcgggggaagtagtagcagctggggttttctgctttagcacattgttagttttactccgactccgttgctgtttcccagagtcatttgctctttctgaagacactggcccgtgggcgtcactgcccttagtggagttccttcctggaggctctccctgcagattctgcctctggaaatcaacacgtattgcccctgtgctcccccggattacttggctggagtcctctttccctcctgtcacctgcagtggcattcttcttccagcctgtgggatgttgctttatgctggacagagctggattctgtcttggctctgctggtgctgaaagttccccaggcccaggaccaccatccacacacctccgatatctggtgaagcaccaggcatcgtaggcattgctgagtatttgggtgactgacttctgagcatgaaggcagggagggtcccctctgtctggatggtaccccacccttcgcccctaggcaccttggccagaccctcctcattcttcaagattcagcagcccttgccttctgtgaggagtgagttaggtttcatctgtgcccagctgtgctgtgtgctttgcaaatgaactggaacagtctgtctgtgaaggggatgtcagaaattcaaggatgggggacagctgtcatcaaagcaggccacaccaatctgggctgttctgctagaattcagttgatttcttattttgtgtgactgttgttcatccgagcccaaggtagagctgcaggaaccccatgtctgagtgtccagcaggcccgcaggccctcgggtgccacctgatggggccatcctgccttttcaggtccttgattatatcccacaaagagaaatagatggcttaaaagtctttttcagaggcagaagggacaagaaaagtggaagtgtagtctggaagtagccaggttttaagttaaccaggttacactcttggtggttcctggcgtcctatcaagagaaggaattatggccccagagctgtgcctgggacccgcatgtctgtcacagatctctgctgggaagccaggctgtggcccttccaaggtgaatggtggtttccatccagggttcaggtttcttagcagctagtggtgacggtcagggtgtgagtgtggggacgtggctggcgtggtgacgggtgtgtgggggcatcattgggagtgatggcgatggcttgtcttctcaccggccggtttggagtccagaaccacatgaatgacctcagggtgggtcagaacaaggagctgtcagtctgagacctctcagtgtgctctttcttggctagcaagttactttaccttggtagtcattagtttcttctttgactaaatgaaaaggtttttatctagatgctgctgtgcatcttgaagcatgttaaaagaaggttaaggaaaaccagtttgtggaagctgactgagcaggcggctcactggccgtattcagctctccacccgtagggacctgctgtggcagccataaaactgtgcagaggtgaaccacttcagcagaaagatgcttccccacagagatctgggagcctttgactgttgaacagggaaaaattccccatgcttttaggatcgtggtgtaagaccccactgtggagagatgctttctatgctgcaacacagaccagggaggtgacgggcagtggctttgggacaccatcaactccaaggagatggcctagctgcttgaggcccacgtccagagttacacactttattcttctgattcttgaaggctttaagaaatctctttagcaagtctctacttctttttaaattttactctttcctcctatcacctgaataaaactccaggcagtaatatgctgcttacattgacttttttttttttttttttctgagatggagtctcgctctgtcacccagactggagtgcagtggtgcgatctcggctcactgcaacctctgcctcccgggttcaagcgattctcctgccttagcctccagagtagctgggattacagacatgcaccaccacgcctggctaatttttgtatttttagtaaagatggggtttcaccatattggccagattggtctcaaactcctgacctctggtgatctgcctgcctcggcctcccaaaatactgggattacaggcacataccaccacgctcaactaatttttgtattttagtagagacggggttttgccatgttggccaggctggtctcgaactcctgacctcaaatggtctgccctcctcagcctcccacagtgctgggattacaggcgtgagccaccatgcccggccatgagtcctttctactgtggggttggtcttatttccccttgctcccgtgagaagctgaatttgcaaatgccagggtgaacttggtaatggaggcaacaggcagatgcttggtgtctgtgcgttgaacagaaaagagcccggtgaaattccacgcctgtttgtgtttagcacacggttcctgaattatttcatgagaatgcaggtatagcggtgacagctacaatatttgttagccaagctgcggacagagggttggcctcaggctgctgtttctgccccagggtcgtgagaaatagctgtgtccattttaaagcaagaaaacaaatggcacgattgctctgctgttcctgtcctagggcagagagctaagtcaagcactcagtggactgcgtctcgtctcccttggactggtagtgacagggctgccctgcacgccacactgctctcctgttcctgtagtgtcgctcatgtaaaatgcactgcaggctggtgctgctgaatcggctcactttctcccatttccttctcctccactttcagatttctttcagcactctccaacttaccttcagaaatgcaacaatgggccaggcgcagtggctcacacctgtaatcccagcactctgggaggtgggtggatcacctgaggtcaggagttcgaggccagcctggccaacatggtgaaaccccgtctctactaaaaatacagaattagccaggcgtggtggcatgcacctgtaatcctagctcctcgggaggctgaggcaggagaatcacttgaacccaggaggtggaggttgcagtgagccaagattgcgccattgcactccagcctgggcaaaaagtgcgaaactccgtcttcaaaaaaaaaaaaaaaatgccacgatgtatgaagacctgcagccccttatctggaattcaaaaaccccaaagcactgatttttgcagcccactcatttggcagcagaacctgagttatctgctcatgtgagagtgcacctttcattacaaaagtacccatgcgtttgactaggggtgctctgggacgtgggttagccaactcaggccactgccccgtttttgaacataaagggttattggaacacagccatagcctttcgcttatattgcctttggctgtgtttgtacctggtccttacagaaaaagcatctgtacccctgctctggagcggacctgccctgctttgcttgcaaggtggtccgagcctgggtggaaagcactgcagggcagcttgtgcagaaactgggacctgctctccttgtagagacacaaccccagggtacttggagctcatgctaatgactaaatcattcaagccttcttcttcctggattttatacctcctagttctttgaggacagtttgccacgttcagcaggattttccagaccttttatttctaaggaatacaaactagaagggcctggtttctgtaggtgacaaagctggggggaacgtggaggacagggatgactggagagagctggcgagtgcagcctgctgggatgccagctctcacctgggaaggtcagcgtgcagggttgcagactgcttaagcctcctcctgtcagaggaccccagagagctcccccagctacttggagagatgctgttgaggttgggaggcaatgcagggtgttcatcagccagcatgagaccctcgcttccagcctgtgcctttagcccagccttgctgttctagatggtgttggcagcctttttcacgtacagagttgcattgctcctccgtcttccgcgtgcctgtgggcagcttttgttcctttggattacttttgtttctttaaaactccttggcaccatctaattttttaaaaatgagcctaatactgttcacgttttagcacctggcaaatgtattgatactttacgagcattcacatgcatttaagagtgctcttagcagttcgcgttctatatagaactgtttacacctctcaggattcttactctaacaaacaggtatagacaacatcctagttgcatctcaccgcggcctaacatccccgggagcatggggattagtggagtgagtgggaggactcgccctgcgcaggtggagggtgatgagaggctggggacgttttcggatgaccacaggtgtgaagctgtcttcagtggtgggggaaccacctgggccttgggccttggctctggtagtctcacataactctttggtgtctgcagctgtataatatgatggatgtccttgtattgtacatttttaggaaggacgggtagggttgctgcttcagagatcaagtggcatgtccacatctggagtagaccctgagtggggcagaaccatcatcctgcgtgcagcctgcacactcccagcacccgtggcagtcttagcaggtggattatcaccgagcacacaggcagcccgaggcacctcctcgtcacagtgttctccgcagccctgactggcgaggagggcacgtccccacgttcatgccctgtactagggtcccctctggcactctttctctggggctctgtgttccctttgccttttgagctcttcataaaatcactgccagtgacttctcatagctgttcgtcattgggagtcactgagcatgcacacgggctgtcaggtcctggtcccagctctgccttcctctcctcaaatgccattcacagcagtgtcagtgcctgcccagagtgtgctagaatgccagttcttgggccccaccccacacctgcgactccagactcagagttgatgagggtctgcaggcgtcggtctgggagccacagacaggtgtgtttgccgcagaggtgccgagggcccagcaggactgtagcacaggatcagcaccatccacacctgaggcgtggggatctccgggcatgatgcggaatgtagtgacgatcgcaaatccttcctgtggccaaagagtgagctctttgatgctgatgagatagtgtttatttatttttatcttattttttttgagatagagtctcactctgttgcccaggctggagtgcagtggcactgtctcggctcactacaacctccacctcctgggtccaagcaattctcctgcctcagcctcctgagtagctgggactacaggcgtgcaccaccacacccagctaatttttgtattttagtagaaatggggtttcaccatgttgggcaggctggtctcgaactcctggcctcaagtgatccacccacctcggcctctgaaagtgctgggattacaggcgtgagccaccgcgctcggccatagatagtgtttcttaagagtgagtttgcttctgaggaagagaagtggggggtcgggggcatcccacctccctggccacctccagtggtgtgagttggttgcttgatgtcatctgaggtggggccacccgggaaaggtcttcatgtctcacttgtatgccttcttggatcaggatttccaggcctctgcatctcttgagttgattctgaaagggtgaggagagaggggctagacagatttttttttttgagacaaggtctcactctgtcactcaggttggagtgcagtggcttgatcatagctcactgcagcctcaacctccccaggctcaggtcgtcctcccagctcagcctcccaagtagctgggactacaggtgcgcagcaccacacctggctgattttttttgtagagacgggtcgtccagtgatactcagattggtctctaactcctgggctcaagggatacacctacctcagcctcccaaagtgctgggattataggcatcaactaccattgccagcctgagctgcatgcattctaaggacactttgtgagactaattaaaacgtttttctttccaaggcacgtggcaggtgggtgctgtttctttcctgcaggatgtttgctgagcatttgtgagtggagcatctttagggaaagcaggacaaaccctaaaagactttctctgaatgttacctttgctcttcaccttgactggtagatcctgaaggcgtagaaagagggtcctctggagaacacaaactgagcgttgctgggcctcaggagcttctagtgatgctggaggcggccactgctgtctttcagctgtgaggagccaggagggcgatcccagctttctcctggttaattttaccgtcttttaaaaaggaagttcacaagatttcttgaaagaactctagttggagttgtagagctaatgtttttttctctggtccctgccacctgctggaaggagcctgcagggaactgtttgttgtgtgcttggctgttcagtgccccataactggccgcggtactgccacccgctggaaggggcctgcagggaagtgtttgttgtgtgcttggtgttcattgccccgtaactctggccgcggtagtctggacagggcttctgagaaccacctgcagttctgcttattgctggtgttgagaaatacagtttctgcaggaaagagagagacattggtgccaagaaatcctatcggggacatttaataactggaagtagcttaggaagccaggtttggagtgctgccttggtgtcgttataatgcaagtgggatttcattatgtgtttaaggcttggcattgttggaggtcaggaagaccaactaagtcaagtagagccattggctgcttgagtgcagtgcagagcactgggaaatggacttcctgggaagtgtgggattttttctgctactccttcattcacacctggattcagttgccctcatgagctcacccgcaatgtgtgtagggggatgctgctcccattggccaggcactggggatgcggcgtatgggcaggtgcacacacacctggcagaggtttggagctgggttgtgggtgagggatgcagagaggcttaacccagagaatggaggaaaaggagaccaggagagttcagagaggtgaagagtgaggagagagcagtggccaaagtggagagagttgagtttcagaaagccagctgcagaatgcagtgcctgacagagtgtgatgggccccatctctctctgctgagccgggttctgactctgcagagcattggaggccttgttgtgggctcaaggagtgcagagaggcagcgcctgccttggtcgtaacttctcacacacatacatccacacatgtgcatctgattgtgtgtgtgacacagtgaagggtatggggacagccacatctgggtttcagttttcagtcagctccctagctgggtggttcctctgagcctctgctttatttcatctgcaagtagcattaatactataactgaatatacagtcagctactcaccactcgaaagccagacttgagagacaagggttggtgggagaaacagcaggtatatttgaaaaccaagaagatggtgaactaacattctcaagtactgtcttaagtcagtacagattttaggctttttatattaagggctgggggaagaggagggggttgagatcaagagatgaccaacgactggacatctgggaggcagtgggggtcagaggaagttgggtttttttttgtcttggtcaggtcacgatgttcctgtgaatttttaataaaacatagttgtttacatacttctcctttaatcccacagctagttttaaaaactacatgattgtgttgctaggattagttaagaactgatttgaggtcactagcacatggtgagtagttagtaaacaattgcttctgctagaatcatcattgtcaatattaagaaggcgagtccacgcatctctctggcctgttggctcacatttgggggtgtggcatttgtgcgtgaagtggagcctggtccctggtgacccaggtacagtttacgtctggagccagcatttggaaagttgcctccagggccctggatttggagggagccaactgccagagtctcaagcaggtgagggtggggtgcaggagaggagcgttcagggcacctctgagcacatgtgacattcgtaagtggcactcctcatgctgagcaactgacgtcgtatttccacccgacaatggcttgattcacttgataagtgaaaggaacttccacgtaaggatcccgaagcacggttgcctccgcctcccaccccaccccgtggtgcggcgtgtgccaagaccagccctctgaggtcagccctcctggaccccttactgggtggacaaaggttttctgtgtgactcacctctggccagaaatttagggaagcttatttgtaactaataccacccagtcactgcaggagacctgccgaagggctctggggaaagtgatcttcaaaaatagaaaggttgagtgaaggtaggacttttgggagaagcagaaggagcctataagacagcacattaatttggcaggtaattaggaactctgatcttgagcatctcattttaattagcgtggtccagcctgccttacggtgctcacgctgaagcagagagtggcctgcttagctgctccgcaccatttatttgggtttcttatttgggaagtttgcatgtgactgggccaagtgacatttgttttgaggtccctcccagggcccaggggtgagctcttgacaaccccagagtagagatggggcacctgtgcccgggcattgatttcctgggaaggaaagaaaacgccaggccatgctgctgtgttacagccctttaatcagaagcccctgctgcatgtgggcctgctgttcccagtgcctttcaggaaaccaccagaagggctccagctttagggaggatggtccatttacacgcctgtggttggaggttccaagtgccttgaaaaatgccttgatgccacttggagctgtttctttcttctctttcctttcccttttaaaatcacggaaccatttctttctttctttctttttttagacagagtttcgctcttgttgcccaggctggagtgcagtggcgcagtcttggctcactgcctcccaggttcaagcagttctcctgcctcagcctcccgtgtagctgggattacaggcgcctgccaccatgcctgactaatttttgtgtttttagtggagacaaggtttcaccatgttggccaggttggtctcaaactcctgaccttaggtgattcgcctgccttggcctcccaaattgccaggattacaggtgtgagccacggtgcctggccagaattgtttcttgagtttttcaaacaatgctttctctccagccagttcaattgtagagggtcctggagaggaggtggagcagttgccttctcagcatcgtggggtggggctgggatgaggagagcgcggccgccagggtcagcctggatgctcctaggcagaggcacaggggttgctgattcttctttccagatggatgtttctaaagtctttcttaaaggagccagaggcttgcccgccctgcagtgccatccttcttgccgctcccacccacttctgtgatgcacagaacctgccgccctgccctgtctctttgtgttcgttggtctccatttctagtgtctgagtaaaggcagtccccagtccagtctgcaaagcctggccacttgcacaggaagatgctcatagatggctggttcctgccagtgacacacgtggacctcaagcaggtggatgggtggagctcagggaataggcatgtggggcacactctccaggcacatccagggctggactggggccggcatgggggtcactggctgcaagcgaaggcagcttatgtcatgttccctctgccaccgccagctgtcctgcagcaggaagaggtagtcatgtttggaggccgggctgtgcatgagctatgcaggccttggggtcttttcatcagattccttttggcagaatataaggaagttggcccaaaccacatttttgaacttctgctttggccttgtcagtctccttctgtgattcagaccgtagtgaagccctggttggctgaagtgctcaggagaggagactttgggggtcatcactcatttctgagttacagaagttaaatagtgacttggttcggggtcatgccatgtgtgtgaggcctgagtttgcaggtttgtgcagggcattgattggttggttggttgattggctgaggaatatttggggcacctgctctgggccatgtacacaatgaggcaaagcaatacttagacctcaaaaacaaagcgatgtagacctatctgctgtgtccttgtgtttctgcctgtggggcacgtgggacatgtgagggagaaacagcatcctgcaggagagcaatgcctccagcttggcttctggaagcctccagaaggatggacgggggcactgagacctgaagaagggttgtgcatgtgggagggagccagcctggtggaccgtggcctgcacacctgcagcagctcctcagagctgccccctcatgccttggccaatcacagagcaccctttctgtccaggccactgatcagcccccaggtccaggtccaagaacaagcctgtgaccccctgggtcccctttgtccttggcctatacctgccttctgcattctggggctaccctttgctccagtggctacagaagagagaggagggacactgaccccaaggcccaggccagtctcgtccaggctgcccacacctaggtcttcaggatgggacaaggcagtcttgggggactttggggtgacacaaaccagagaagggcttcagcagagggccatgagtgcctaaccgtttacctgttttctgctctgaccaggcaccttgggggagggaaggcatcaggagccttctgctgagttcagtggaaggtggtcttcctttccaatactctggttccctctctcccctatgtgcaagtaaataacatgctactatatgtaaattaacacaaatgaatgtaagatagttatatgtgtctactgccttagaaagtacagtaagatgaatattaaacttttcagactgtaagatcgtgaatctgaaagtcgttgcttattgtatatttgagaagtggcacttatttaccctggagtgaatgtgttactggaagtgtcttggctaaattcctgacctaagcttgtgtggtcttttgctcttcattggcaatgtagaagtcaagtttgaactgagggctgtcttattttaaatccaggtttgatcattttctgaggatatagcgtttagtgcacacctcttttgtgcaactcagggctttctggaggttggggggcggatcccgaaggcagacttggccttcccagctggcgcgggactggggacttaggggactgggtcctggggtgagctctggagcccgtgggtctggttgtcttgctgacctggtctgcctcctgcttgcttccatagcagagcctgtgggacgtgaaccaccattcatgatcctgggaggtgaagccctgggaactgccacttggaatgagaggggaaggctggaactgagctgggctggccatggggatgctcagagcccggctctttcatgggatcacagtttgttcaccttggaagctgttgctcaccgcgtgttgattttatttaagactggaaaggcttgtccatgtatcgccgttgggaagggaaatcactccgaagacggtgatgctgggtacaggctctggagtcatcttgatttggtaaaaggcatgaagtctgagttcattccgaagattctggcttttgagaacttatataaagagaacttataaaaaatggaaaatgagaaacgatgatgtcagtgaacatttattggcctttttttctgtgccaataactctcagtgcttaacctgaagaagcccacttaatccttccagcatcctgtcctagaactttccctgctgtctggataaggaaactgaggcacagagggtcgaggaacttgctgtggtacacccagacagcctgaccccagagtgggcacttcaggtcccgctccatggccgtgtgcaccttcatggtacgtgctggggttgtgccttatgaaaacaacggacttggctacatttcgacaaggggaagttagacactttagattcacagttaactgttgatgcttaaatgacatttgaggaacctattggtgctttcttgagccctgcgccatgtgagtgaggttttgtggtcctggacaggtgagctcccctccagaggctgcctgtttgtaaaataataggtttagatgaacaaagtggtctttagaggcagatacacctggggcagagtccatctgtgagtgggaagagtaccaggcacgggctgtggagaagcgggatggcgagtaggaggctggcggccttccctgtgtggaaggggcctttctgtgtgcctggccccgcagggtatgcagtacacacgcacatttatggggattactcggttccgcatgggctgtgtgtagaggtgggtgggatgctcagtggagatggaccaggctctcctccttgagtactgtcacctcttccttttctattctgtcacctccttctcatcacctctgttgtctgtccctgacaggcttctgtgctttggagacctctgtgtgtctttcttggttttggtttccctgtctcccagcatctctgggagatatgtgtatgattgattccaagaataaagtgtgaccaggaaaaccatgttttgaaatctgacctctcaagcccttgaaaatactcagagcttttccagaatgttctcatgtctccatccacttcctttccctttctgctttaaccccgctaccctccagtcgtagccttcaggagaaataaaaagaccccagagaggccagcctactttcccccacactgagttccaggaagctgagtctggttttcccataggaacaatgttatgggatggggactgcattcctcacaaaggactctgcctcgaaatgtgcgattagaaagatgcacccgctttcagccgcagcaacttacaataatgccgttatgccctcagccataaacacattgtgcaaattgatttcttgaggagccccaaggtactgtgggtagaaggagagcacatacacatgtgagtgctgtgaaatcattaccatagcctcagacatgtctgttcttaataaggaaaaaaaaagttcattacacgtcattgaagatttttttttttagatagggtctcgctgtgtgtcctaggccggagtacggtggtgtgatctctgctcactgcagccttcgcctcccaggctcaagaaattctcccacctcagcctcctaggtagctgagactacaggcatgcgccactacacccgactaatattttgtattcgtgtgtgtgtaggtggggtcttgccatgttgcccaggctggtcttgaactcctgggcttaagtgatcctcgcacctcagcttcccaaagtgctgggattataggcctgagctgccaccacagttggcttgaagattttttagaaacttgccagcttagtctttataaaaatacgatgaaggggtgatttgggtgtcccaagactgtttggaaggttgttctgacaagcaagtgctgatgttttgtacttgatcggcttctctgtggcaagccagaggcgtctgtgatgagcgcctgcagacgctggtgggtgcttgccgtgtgccagtgattgattgacgttagtgtcggtatctctcattgcgaacattcttctctaaggttgaaaatcagtttttcattatgtaaataatgtgtactcagtgtagaaaaaattagcacaggaaatagaaagctaaaggatatccctcatgatccctcatccagatccccagacgtgaccactgttatgtggttatatgttacgttatagcctcccagaaattttctatacccctgaaatttaacattttggtgggtatgatgtggtatctcaactgtggttttgatttgcatttccctggtgactaatggtgttgacctttttttttttaaatatgcttatcttaaagcatatttatatatttgtatatcttaggagaaatacctattcaaatcttttgactgtttttaaattgagtctttttattgttgagtggttggagttatttatggattctggatactagacacttattagatatatgatttgcaaatatattctttttttctgtggtttgtccattaatgttcttgatattctttgaggtactaaagcttttaattttaatgaaatctaatttacctgttttttctttgattatttggactttggtgtcatatttaagaaatcgctgcctaatccaaggtcatgaggatatactccttgtgttttcttctaagagttttctgatggtttcttttacgtttaggtctttgattttgagttactttttgtatatggtgtaagatggggtaattgtcaattttttaaaaggaaaatgaaattctattaatattgttgtacaagttggttttcccctccacggcatgtttggctgtcttcatatcagcatgcttagatcatttgattgattttctcttctttctttctctctttctgcttcctttcccttcccgtctccatccctccctcctcacctccccatgcctccctccatcccttcccctactgtggtagacagaaaaatggccccgagatgcctgtcccctaatccccagaacttgcgatgatgttacctcacatggcaaaagggactttacggatgtgattaagaactttgagatggatgatcttgtgggctcaaggtaattatgagagtacttaaaagtagaagagggaagtgaaagaggagagtcggggactgtggaaggagggcgagagagttgcagcactgttggctttgatgatggagggaggctaccagccaaagaatgtggatggcatctaaaatttcggaaaagatgaggaaacttggagcctcctgaagggcatacagccctgctgacacctaagcctggtgagacccacattggacttgtgaccctcagaactgtcagacagtgaaatcacgtcgttctaaaccagtcagctgagtggtcacggcggcagtagatgagtgcacctcccctttccaaccttctaaacctcaggtgttgccttctccactaggccaagcgatgctccaggaaacctcaggtcacagccagatgctccaccctccatcagtttctcatgtgtccttgaaaagtcataaaaaatgttgaccagaatgtcagcacagacagtagaggtgggagtgtttctttggagtgggtgccgctgcctggttgtttgggccatgcacagaaggcttgtggcaggagcctagggtgtccatttagccttctctgttgtgttggcttccatagggtcactgcctcctcgcctgtgctctctatgtgaacacagagtttctgcttcactgtgggatgaggaggcttcagtgaattgtccacagacctagtcgctgtttccaatgttatttccttagggaagagtatctccaattttaaactgcccacaaacaaatgacgtttaggaaaccttgtaggtcaggagctgctggggtctgcgggtaagaacaggagggcttcctaagctcttccactgatttagggggcgaggttgggaggggtttcctgacatggtagaatttttctttattcctactcgttggttcaggtgtgtaattattaacagttacaccctttatctcctgcttcctctggctgctgacttggagggatgctgggagaaggggagggctgaagagttggggatgggtgtgcctggcttccttctaaggtttagggctgaccctggacagtcccagccccaggcaagtgttcttgaggcttattgctgtctgcctagctggggaggatgttgagaggattacttagctaattcagtatttggaaaaagtatctgtaaacttaaatagaggcccattacataccttttgtggattagaactgtaattgacttagtgtttaaggcagaaactaaggcctttgatttaaaaactgttgacagatcggagcctaagccgcttctgtttgcagaggagagccatgacttccagtcaagttgaaacatagctttctttatacccttcccagttggacttctgtcatattttacaaaattcaaggcttttcatttaacttagatttatggcttttccatggactatcttgaggtttttctccaaagcaaaccagctcataccttgacattgtcaaaatagcaaaaacacacatcttaacaaatgatggcaaaatatttgagctgagagattggggtatgtgtagtgttacacctttgcatgtaaaagattatgtcaagcaatcttctaaaggaaatcagtttttagttaacttttaaggctattcaccatgatttaaagtgattccttgattcctctgttacattaagtgtgattgaaactgtacctttattttctcatgccttgataagcagtgtagtcaaatcataacatattatgactgcaatcaagtgattatagcacgtgattatactttttgtctctgtggcgtgaggagtggaaaggtgtctttttttgcaccacttggcactaacggtggggagagatggttccccgaagccccctccctcttgtgtgttttggggcagagcgccctgttcctgaatagcacggattgcacgtgtttctgagcatggtgtgtgagactgctttcccttcctgcagtcaactcgccaaggtgcctccccagccccagcagtccggcttctctcctttccgctgccccatgctttctggtggcctggcagactcaggactatctctgagtccttcacaaaaccctcctccacatgccttcttttgtgaaaaccctcagtcctctttaagagcagggcccctggagccagacagctctggttcagtcctggctccggtcctctgcagctgggtgaccctgggcaagtcaccatggctctgtgtttttcatctttaaaatggggatgctggctggtgtcgcggctcatgcctgtaatctcagaattttgggagactgaggtgggaggattgattgagcccaggaggttaagaccagcctggacaacatggggagatccccatctcttttaaaaaatacaaaaaaattagcccggccggtggtgtgcgcctgtagtcccagctactccggaggctgaggcaggagaatcctttgagcccaggaagtcaaggttgcagtgagccgctgcacaccagcctggggcaacagaacaagaccctatctcaaaaaataattaaaataaaataaaataagtacagtcgctttgccctggggctgctgtggggagtctgcaaacaggacctgccttgtgctgaatgcagcatctctgttgtacttgggaggtgtgcagccccagcatctcatgcctcgcaccctccgagctgcctggccttggctgtgcccccctgccctggcccactcggcgtccccagcacttcatttctttccgtcctgcccccctttgctgtgtctggtccttttatcactgctcttgtgtctgcctctgtgccctcctgtcctggccacggcttgagatcacactgccgtgcctcttgcccaggtgaccccctgagaagctacctgagctctgctaatcagccccactttcctctgcccaggcagaaactaagatgcctcggctccttctgtggaggaaagtaatgtgttaattggatccagggtcctcagcacacactgggctatttttacagtcagacaggaagttgtcgttttataactttatcctgtgtaaattatagcccgggcggggggtggggggacttggattgttaagaaagtgatcatcctgttcttggatagggtgattttggctgtctgggtaagttctaggaatttgctgtattctcttgattctaatgaactttgctatggcttgggaaggggcctctgcatggagagagagaaggaagctagcgtttcttgagggtctggtatatgctaggcactgtgctggctgctgaattggactgtttgatttaatccttgtcacaacccctttgaagtggtcttgttaccctcttttacaaatggggacattgtggctccagcaggttaagaagcttgctccaggttacatggctatcagtgggaagctgggtggggggtgtggacaggtctgtgattcccagacccatcctcagatgcctcctggagcctctttgtgggagagtgcatgtgtcatggcgagtatgtggctctgcgattggaggaaatgtcaccggaccagtcaataggtcttcctctttacaattagcttttgtcaatgtacgttttttctttagtccacacaaccttttaaaatttatttatgatcgtagccctggcctttatccatcgaatcctaaagtgatctggctgctcatgaccaggggtgacagccaggatgcttttcttggaccaagaaacctggcttaaatgacagccttgagccttgctttggagcagtcagactctctggggatactgttactattagtgagcattatttgctgcagaaattgattccttctgccgtacagtaggccagggaggcctccaggtgccttcggtgggggaaggattttagttgctcaggccaaataaccgagactagctccctgcaaattccatggagccatctatacttctgagtatatcttcaagtgctactcctaaatttaaggttcttccacttttcatccagttcacatgtagttgagggcctgcctgccttgagcctgacacagggccagttgtgagcctggaccagcacccacagccaggtgtgagcctggaccaccacccagggccaggtgtgagcctggaccaccacccagggccaggtgtgagcctggaccaccacccagggtcaggtgtgagcctggaccaccacccagggccaggtgtgagcctggaccagcacccagggccaggtgtgagcctggaccagcacccacggccaggtgtgagcctggaccagcacccacggccaggtgtgagcctggaccagcacccacggccaggtgtgagcctggaccaccacccagggccaggtgtgagcctggaccagcacccagagccaaggtatgagcctgaaccaccactcacggccagctgtgggtctagaccaccacccatggccaggtgtgagccaggatcatcctcccagggccaggtgtaagccagggtcatcctcacagggtcatgtgtgagcctggaccaccacccagggccaggtgtgagcctggaccaccacccacggtcagctgtgaatttgaaccaccacccatggccaggtgtgagcctggaccagcactcacagccaggtgtgagcctggaccaccacccacggccaggtgtgagccaggagcatcctcccagggccaggtgtgagccaggagcatcctcccagggccaggtgtgagccaggagcatcttcgcagggccaggtatgagccaggagcagcctggcattggccccatgccacatgacactctttgtcccttgtcagcattttaaaccaaggtgaagaggtcccacttagctttgtggtatctgttttataggaatgaagggggtactttaacaagttcatcttagggttctcatctgcattgttgcctgtgcagttacaccactcatgcctacccagcataattaacagtgtgacctacgaaaggtggggcggggctcacaggaactaaccagggattcctgtgtgtgaatgttattatgaaggtgctttacctcattagttatttgtgatgaaaatactcttaaaagacctgctataaagtgtcaataccaaaagcttctcatgtcattgacattaaaagactttttgtattttttttgagacagggtcggctctgtcacccggggtggagtgtagtggcatgatttctgctcactgcaacctctgcctcccaggctcaaaccactctcccacctcagccgcctgagtagttggaactacaggtgcacgccaccacgccaggctcattttttattttgatagagacagggttttaccatgttgcccaggctggtgggcaatttgtccacctcaatctcccaagatattaagaaactgttaaagaatgttttgccactaaactattgttttacaacatttcattatgaaaaatttcatacagaaaagtggaaataattttatagtgagtacttgtacactgattgccaagattctgtaaacaatatttccctctgcttgtgtcatctttcatttgtccattcctcgatttattattattattattatttgaggtggagtttcactctgtcgcccaggctagagtgcagtggcgcaacctcggctcactgcaacctctgcctcccggattcaagtgattctgctccctcagcctcccaagtagctgggattacaggcatgcgccaccacgcctggctaattttgtatttttagtacagacggagtttctccatgtttgtcaggctggtctcgaactgccttggcctcctaaagtgttgggattacagatataagccatcacgcccggccttgtattatttttcaatgcattgcaaagtcaacggcagactgaaggactgccgcatgcatagctgctattattaactcgagatcaatattgatttactgttttgtttttttatttccagataagcattcataaacagtgaaaagcacaaatcatcagtgcgccgtacgttttggccagcactttattttatggaacagaggactagatgaccagtgctgtgagtgggcaggtctgtctcctgcctctcttatttatgttgtatgcctgacaccttcctcatgccgcaggaccagccgggaccggggagaggctgttcgaggaacacaggatgcatattcaggcaggaagttgttggggttaacatgagtggaccctagatttccctgcctgaagggggccccgtgttagtttcctgtggctgccgtaacagccacaaactaggtggcttaaaacaacagaacatcattcttttacagttctggaggcctgaagcccaggatcaaggtgtgcccagagctgtgctccctccagaggatagagcaggattcctcctagccttttccggcctctggtggcccctggcaatccttggtgtcccatccagctgcatcactccagtctctgcttctgttatcacgtgccctcttcccggcatgtgtcttctgggtgggtgtgaattttgggaggacactattcaccccagtacaagcttgagcctggttgcggggactgtgtggacctctcccacaggtctgtccccctaaagggagcacactggcagtgtgcccacccccaggccagcgggcagcccttggcagagggtgtgcctagagcttggatgtgcgggtcggatgtctttgcctctcttctttcctgtcctggtttcagctggaaggatgttcagatatgagaatgggaaaaggcggagcggtgtttgttcatgagagaggactgctctgccctcagctggcccatggccttcccttccagagccccaaagggccctgccctcagctgggagatgggccctgggcgtcatttagcttgagcacctgcctggtcatcctctgcaagccccagtcactgtccctgggagaggttctacagctccctacccacacctgcagccttgcttctccccgtgtctgttcttgcgctgtccatctgtatgggagctgtcttttcatgggtctcaggtctgtgccagtatgcagctggggagctgtgaacccaggtgtgttttcaacctgcttcccagccggtcgcatactgtgggactggtggactatttagaggtctagggagtggtggggagaaggggctgcaggggaagagcatctgatggtggtggccaggaggaacgtggcactggggggtgggcagggtgggaattgtccactgtggggggcggctgaggaagccaaggggtctgggcctgtaggggaagtgggagaggagagaggaaaggacaaagatgaaggtggaaagggggaaggtgacagtggcctctcaatatgcggaggggcttgaaaacaggagggctgtgcactagaggatgcactggcgcagaactgagacatttctggaaggtggctttggagccagcatccttgctggtatgtaagaaatgccaggtatatgccctctgggaggttgtgtgggctgggtgacactgccagttcccttcagtctctggggctctgactcagtggggattcccacactgacctcgtgatgtctctagtgccctcagggaccctggacagcatcctgagctgcagcctccatgaaaggaggcccctgaaggtggcaggttgtcagatcgaggcccacatggaggtcattccttactgggcttggtgatgccccgccagctaacttgagggcaaaggcgtgcttgcaggttgatgagcagctctgtgggatccgagctgctgctgttcgtgggctgcctgctgtgggccaggcactttgcggagcatggacgcccgttctcttactctgttgatgcaacaacctgttgaaccagagtttttctccgttttatggagaaagaaactgaagctccttgatgaagtgaagccatgtcctaaagccgctagcacttagcatgtggcgggcacctggcatgcatgcgtgggatggacatggactcgtggcagaaccgagacccagacggcaggaaggagaagctgtgtatgtgttggaggaggatgtggatcgctgctggctcagtgccggttgtaaaaggaagcaattgcagttatttcttgctgctgctgtaacagattacaacatacttagtggtgaaaaacagcacacgtcattctctttgaggtcagaagtccttaaatgcatccacaaagctgtgttctttctagagggtgcagggagaatccatttccttcccttttctagcatccagaagccacctgcagtccttggcttgtgggcccatccttcatcctgaaaggcagcagcggatggagcatcttctgacctctcacctctgctctatcatcatgttgtcccctagctttactgctttttcttagaaggatgcctgtgattacattgaacccacctggatagttcaagacaccctcacctcaatgccattaatttaatcacaccagcaaagttccttttgccatataaggatatggcagcgtattcataggttctgggtgttgggacatggacattttgggggacccatgattcagtttccctcacgttgtcagagaccatcctggccaacatggcggaaacccgtctctattaaaagtataaaaattagctgggtgtggtggcgggcgcctgtagtcccagctacttgggaggctgaggcaggagaatcgcttgaacccaggaggcggaggttgtagtgacccaagatcacgccattgcactccagcctgggcgacagagcgagacaccatctcaaaaaaaaggatcttggaggaagtacatgaccccgagtgggtgcctctcctggccaggtgtccccttgtgtatgttatccttgaatcttcctagcagccttccaaagtaggcttcgggattcagttttacagatagggaaacttaggcacagagagacttttggtggctctataggcagtaaagggcaaaatggaaagcaaacctggcctcttgtacctctgagccccgaattctgccctctgcccatgtgagcatggtctgtgagcaaaccttcctgtggataggtttggaggattcgaaggacatccctggaggggctgtgcccaggtagggtgtgttcactgtgcccctgtgtgagggtttgtagtcttacacctttgccaaaccctttctgggttttgcccctcacaggagatgcaggtctttctatggaacctgtaggttctgagaccgagccttgggtagtttttatttcttaggctctctggagttctcccaaatccccattgccaatcagtagctgaaagtggatgctattgtttttccgattgctggtctctttacttgtttagtgaaaacagcaaaaatttagaatgtttatagaattgaacacgaaaaccagagttgtatatctaaggaaaacatggtgtgactggcccgggatccaaattatttgcagcgcctgtcgtctttgttaactcttctcagttctctttttctttccttctctctgtttctttcagttttggtttttctttttgaagacggaatcaaagggaaattattttcattttcttcacagggagttcccaggcttccccctagcctttgctttacttgctgtgcccagttccatgagaaggagttgttacatttcttcttcctaaagcagtgatcggtgcttctgccctggtggagaaggcttgagcagtccccggctagcggctgttgccacctacaagcccctgcctccattaggaagccatttatttatggggcctaggtaggggcaggaggttcctttcaagaaaacaacagattgcttaatgctggtctccctcttgctggccaaaaggaatgttaaagccagatcattatcttgttataatgtgtgagagagtcctgcttaaaaagaggacaaagacttatcacacaaatatgcttgggtcccttttaatgtgggaagcacattccatgtaaaggcagcctcccgttcctgtctttctttgcagagactttcagaagaagcaggtgccctcatcgagcattcctttgatcacttgctaggtgtgtttggtggtggtttcagtgctgctctttggcctcggcattagagactagttttttaaaattaagtttctctgggtgtcccaagattcttttaaatccaaagaccatttaggttccagcttccttgagcctcggtttcttcctctatgaagtggagataatggcaaacatctgaaaacattttatcaggatttggtgtgacactacgtgtaggtgattaggccggtgcctggcaagtactgctgctcgaggaatctcaggtatctgcattcaactgttctcacacggctataaaggaatacctgagactgggtaatttataaagaaaagaggtttaactggctcacagttctgcaggctgtacaggaagcgtggcaccatttgctcagcttcagggtggcctcagggaacttacaatcatggcggaaggcaaaggggaagcccacgtttcacatggttggagtaggagtaagagaggggttgcagggggctgtgccacacacttgtaaacaaccaaatctcgtgagaactccttatcacaggaacagcaccaaggggacggtgctcagccattcatgaaggatccaccccatgatccagtcacctcccaccaggccccacctccaacactgggggttaccgttcgacatgaggtttgggatggggacaaggattcacaccatatcagtgtcttatgcatagtaaaacattttatgaatgattgtctctatgtgctgtagctgtatatcctccagtatggtagccacaggccacttgtggctaaatttaagtgaaatgaaagattcagttccttgggcacactagccacgttttccaggcctgacagccatgtgctgctgatggctgccttattggaccacacagatagtgaaaggtttctgtcacggctgagaggttctgttggccagtgcttgttcagctaaggttaaaatattaaccacctacacttcctttgtatctaaacccatttccttggttcttttccaatacttatttcctgggtagccctttgtgttacagggaaattgtgaattttcatattaaaggcaactcacctgggatatggcttgctgaaagggaagaggcagacgctgtagtatatagtcagtgctcaatgaagggaaaggggcttcacttccccaacagagtggccctccaaaagggtctcactttgtagcccaggctggtctcaaactcctaggctcaaatggtcctccaatcttggcctcccaaagtgctgggactacaggcgtttgccaccacatccagctgctgctccatctttaaagttgtcttgcccacactttgtgtgtgtgtgtgtgtgtgtgtgtgtatacatatatatgtatacacacacacacacacacacacacacactttttttttttttttttgaagcagctcgtctttattgaaacttcttaaaacatccaacctgattttcaaagctcacagctctgctcctggctttgggggcttagcctctaatttgggtctgaactttattgagctttgcttggcaaatgcaatgaagaaagtgttaccaggtggcattactgagagcccttgagggtggggggagattgcgtgccgtgccctgtgtgtgtgtcagctgactcttgacccccgcttgcagctcagcatggctgtgtgacttaggactttctagatgcacataatttcaggagtggtatttgagtgcatttggcaccaggcatggggtggctgagccccatcagtggcacctcactgttgctgtgcactggtggggtagttcttcaggcagtgggggtgatatccatcagcaggttccaccactgggcaccaccacccttcccccgcaggtgctcctctgtcctctagatgtcctgcctcctgcgtcctttgcaccataccccacaggtcctgccacccctgctcatcatctctcttgctgttttcatctctgaagtccctcctataggggcttcctgcccacttctctgcacctgggcttctgccccagctaaaatctcacctctccagaaaatagtggccaacttccccatcaccttggctagaagtcacccctccatttggaatgccacagcagctgcccttagagtcttcctgctctggcaggccgttgtgtgcatcacactgacttcagccccacaaaggaggacctactgtgtgctcagcgtgtgcccagctctgagtgaggctacacatgtgaacaggaccagctcggctgcgggagctcctggtgttgggggcaggcaagcagacattctgcctgagactccttttagaacgtgaatgagaagcagcacgagagttgctgtcagactccccgattgctccatcttttttcttcttcttcttcttcttcttcttcttcttcttcttcttcttcttcttcttcttcttcttcttcttcttcttcttcttcttctttcttctttcttctttcttctttcttctttcttcttcttcttccttttttttttttttaaagatagaatctcactctgttacccaggctgcattgcagtggcacagacagctccctgcaccctggatctcctgggctcaagtgctcctagagtagctgggccacaggcatgtaccaccatgcctggttacttttttacttctttgtagagacagggttttactttgttgcctaggctggtctcaaattcttgggctgaagtgatccttagcccctcaaagtgctgggattacaggtgtgtgtccctgcacccggctgctgctccatctttaaaattgtcttacccacacgtacttacattttttgttttttaaagcagcttgtttcattgagacttaccaaaacattcaacttaattttcataggaaaaagtcctcttatttaaattcttatttagtcagtgtgtataatgtttaatcaaatgatgtcattatagttactattattaaaactcccatttcatcgatttgtgtgatatttaagtgatgtgataatagttagaaggaagcgtatggaagaaagtgtggcaacaacactgctgacactggaggacagaattctggtctctgcaaacggcatgagtgcgccccatgagtgcgccccatcaccagcaggtgggcttggcaggtgtgccccggctcatctggagagtcaggtcaggggtggctggtcaggatagctgttaccacatggaatgtgcattcctaaatccaaatgcttgcctcaccccagtgctgagcctggccagctgagaggctggagaccccgtgtattcatggctggggctggctcctggcagagcctcccagcgggttggcattctgttcagctttcccctgctgtcgcacaacctttttattgacccctcccttcctgtgttggccaggagcccactggcttcaccagaccctgactgttagctggtcagggaggcagggcctgggtgccttggggcctgtcctatctgaggtccacagcctgcagggacatcacctaaaagttgtcatcagcttcattagcagcactcaggcccagctgggcattcagctgtgactgcattctggcacctgaagcatctgggcctggacggactctttcaggttgtttggataatcatcctaaaaacgcctctgagatccacccccactcctgccatcaggcattaaaatcttccgaacagaaaagctgaaaatgttcccttaccttaagggaaaggcctcaatggattgatttaattgtatgtgtgaagcattttttcttctttgctaaatgcataaactgtataacgaaatgtaattagtgaaggtgcattatctgataaagtaaatctcagccactgggaagagccctttttggcagtgtagtttctcttttaatagctgtgatcagattatacctttaaatctctttaaacacttcccaccactgaagtctttggtttccttgatttgatagtttttaccaggctgttcaaaaagtcaagcagtgttcttttaggtcctttttggttctgtgcgacagttaatgaatagtcatgtgcatttgacccctaaaaggaaggtcttttgctttttaaagagactgtattaagaggaataatggaccaagtacaccaggagggaatgaacgagaaaaataaaagaaagaaaatcacacaagaccaaataactaattttgaatattttctgagacctttggtttagaatctaaactttgttgaggctgggcgcagtggagcacgcgtgtaattctagcacttagggaggccgaggcaaatggatcacttgagctcaggagttcgacaccagcctaggcaacatggcaaagccctgactcttccaaacatacaaaaatcagcgaggcatggaggcagacacctatggtcccaggtacatgggaggctgaggtgggatgatcgctggagcttgggaagttgagggtgcagtgagccacgatcgtaccactgcactccagcctgggtgacagagtgagatcctgtctcgaaaaaacaaaaacaacaaaccaaaaaaaaaggtgacattgagaataaagagatggtggttggatttgtggctatttttccagctgctcaatagttgtacaaaatgtagcttgatatgatgagtgtttccaaaattcctaaattacatgtcatgtttgttgattatttgtatatgttttaatgtgtattaaaaagacaccaaaggtgtgagttcataaatattaatacttaggataaacttaagatttgaaagaatttaaagttgaagagagttgaagtaggtgatagtttaggtggtctttgaatgtggcagaagccacaaaggtggtgcatgaagtttgggaaaagctgagccgaggaaactggaaggctttctcctttaaggaccagtgtgattctaggctgttgaatgatatcttcagatacccgtttgtcctgttgctctgcctcctccgtgagctgtgctcacgggtggccaggtgtttgacactagtatccagagacaaactcagacatgcgccctgggctctactcctggaacctgggagaaagggctgccgtagggaaaggtgtgaacgcacaggtttgcatgcctaaaattataacacttttttattgcaaaggttcttttcagcttttttcttttcaagtaaatggagatgtgtctttcttctgtttctggtgtcctttttctttccgtaaaataaccacctctttactgagattggggagggaagtctgtctccattgaattgtctgctgtcgacatcagataagacattcccttctgttctgttttcaaaagaagatgatgtgaaaaaaaagtggcatttttatgagacgtgttgtcccctcacataacttcttggatacctttcccttgtcctagggacctaagcctctctgggtgtcactgtccgtgcacagcctgtgataagccgctgtgtggcagagaccaactgtgggtgatttgtcgctccccagagcccggttgcaacaggaggagccaccaggctgggagggcaccaggcaggaggctgggtccatacctggcgcaaccctgggcctcaggttccccagtggcaaaggtaggataggggctttggtcgcctctgtgctatgagtctttgtccagtttgtcagtcaccatattcgttttactctccagtcttttctataaaagtgtttgggggccagaagttgttaacctggttcactagaagctaatgcattgattatttttgtgtgtgttgtactcagcacgtgcttctcagtgcgctgtgtcctcatttgctgtttcccctgaagtttgacgagtatggtatattctggtcaccaggcaggtggtgcttggggaatatctcctctccgtgtgctggaagcattgcctgattttaatgaggtgactcactgcagctggttttaagaactttgttgcaggtattggttgactgcagtgttcccaagtggtcgtgctgtgccctaaaggctgctagaacctcaggggccgttgagggcaggttcgagtcccgcaggcaagaaggtggaactctagagaggagggggatgccttggcctgggccccctctgagggaggactgtcgcccctgctgctgggagcatcattagctgcagctcctcatggagagatgcccagcgtaagggtacatcctgtcagaccctcttcccgtgactgttcttccagggtgtgaagggcagaaaggtggggccatctggacccatcatgggacaattctaatggcctctccattgctccctgttgggttggcgagatggcctcaggtttgcctggcagttcagcctctctctggccagttctgcttcttcccctccttccacaggtatccatcttccctccataccccaaatgccaaactctacctctgcatcttcaccaagaaaagcatttctgttgtcctgaaatatcaggccttcctgaacccccttgtacctctgtccagtggaagtagaatgccagccacatacgtcatttaaagttttctactagctacattagaaaaaataaaagaaacagatgaaattaattttaataaactgtttaatccaacatatccaaaatattatcctttcattgcaattatctggaatttgtggacgaggtttgctataatcctgtttggtactgatgctttgggtggtgctgtgtaatgttcattcatcgcacatttcaattcggccacattttagtgctcagtagcacctgtggctggagctactgtattgggcaccacggccttagggttttgattaaaaccccattctcttgaccttctgcccaaagcctttgccagatgagacactgcctctcgctgaatgcctgcttggagcagagtcctgtgtttgtttggaaatgatcggaagctcctgtgtccctggtcgcttgctggagtcggtgggagctgagagtcccttgctgcccggagcatggctgtgtggctgcctgactacatggttcttcccccggttatttttgtttgggcagttaactctgagcattcggaacattcgccgagtggaacgtgtgtgtcgtcatcccctcgaaggcttggctgattgagccagtaaacaaaaagtgcattcaacacaggcttgtctgctggcctcccccgggagagagagtaggtttgctattcctgaaatgtaatccctccttcagcgctgcacaaaaggcccatgtctgctcgctgggacctgatagttcgcctttgtacggatgaaaaaaaccaaacactgagcctggtctgagcggggctgtttgttgaggctcctgatgcagacaagggagcagtgtctgcacagggggtctggatcgcacccgacaccatccaggtgcctgcgtgtgctggtcccgccatcaggacttcccctcgtgaggagctgggtaccactgttatcctgcctgctggtctgagggtccgagcgtgattgggagcagagacaagagttccagggcgagcctcagttctgggaccaccattgaccagtagagctataaaggacttggccaccaaggttggagctgagccccccatgtcatgaaactgccactgtcagagccagcctgagctccacggtgcccgtctcctacctgcactgtgcccccacacctttgttgacaaggacctgacctctcctcaaactacaacctaagaaccacaatgcctgttccccttacctgcccccaggtgtcctgggagaagtcagtgacatgattaagacctttaaaaatgatggtaagcatgtgccagtgtgaatgtacttagtgccactgagctgcacacttaaaagtgggtagaatgatgcattttgtgtgtattttgccacagtttaaaaaattacagactggacgcagtggcttatgccaccccagcactttgggaggctgaggcaggcggatcacttgaggtcaggagtttgagaccagcctgggcaacatggtgaaacctcgtctctactaaaaatacaaaaaaattagctggatgtggtggtgtgcacctgtaatcccagctacttgggaggctgaggcaggagaattgcttgaacccaggaggcggaggttgcagtaagccgacattgtgccactgcactccagcctgggcaatacagcgagactcagtctcaaaaaaaaaaaaaaaattttttttttacaataagctatttaaataaacatttgtgtatagcccaatagtttttcactgttgagggtcaaaattttacctttgtctacctatctgcctgtccctctagctgtcagtcacacagacggatatagatatgtaatttgaattacttctgtttctttctctttgctagtctaagtcttagaagaattaagggttttcttattactggctaaagttaaaaggtacccagttgaatcatcttggaaagaaaaccaggaaaccaaattatcaccatgaagcagccttccccagcttgtgtcacagtggagcgctcatttttgtggctggtttactgtcgtaaaactttcgtataagggcgcactgtgtcagcccctgcccactgagggcttcagaaatgaaaggcagttctatttatgcccagctggcttctgcagagccgggctcagtttaccaggcgacacttttgctttaatccttcctggtgtgacgtaacctttcactgtccttcccatgccctgaggtctccagcctttttgttaaaacaaaacaaaccttatttgggcatgatcaatacagctgtgggttgcaatcccagggggcgacttggctcttttgttgttgtcgttaaaaaatattgaggcaaaatttacataacataaagttaagcatttaaaagtgaacacttggccaggcgtggtggctcacacctgtaatcccagcactttgggaggcctaggcgggcagatcacgaggtcaggagatcgagaccatcctggctaacacagtgaaaccccgtctctactaaaaatacaaagaaattagccgggcgtggtggtgggcacctgtagtcccagctactcgggaggctgacacaggagaatggcgtgaacccaggaggaggagcttgcagtgagtggagatggcaccactgcactccagcctgggcaacagagcgagactccatctcaaaaaaaaaaaaaaagtgaacacttacttagcgtatgcaccacatggtgtaaccacccacccgtctagttccaaaacaatttcatcacccccgcccaggggaaaccccatgttcttcagcagtcattgcccatttccccctctccctagcacctgacgaccgccagtcttctgtttctgtgggtttgcccattctggacatttcatataaacagaaccatacaacatgtggccttctgtgactgggttctttcccttaatataatgtttttgagattcatcgagggtggtagcatgcattggtgcctcatttctttctacagctgaatgatatttcattgtatggagggaccacattttgtttattcattcatctgttgatgggcgtttgtgtccatcttttggctacagggaaccatgcagctatgaacgtgcgtgtacagggatttgcttgagttgccattttcacctctttggagtatatccttaggagctgagtggttgcttggaaaggtaattgtatttgactttgagaagaaccgccatactgttctccccatcattagtggtgagaatgaagacgtgccggccgcttacattttgtcgggttgatttcttcattttcttgcatctccttcacagtggcagtgctggcttttccctcggtgcttgttggaggcagtgggggagggagggttggggagggtgcgctttctactccaccattctagtgtcttctagaggtagagtcgagtgtatctgagagtgcttctctcttagaataaatgacattaacatatgaaaaaacagctacttgtgcctgactatgggcattttcatgtacaggagttcttgaagctgagtttattgagaatggttttgttacctgctgatagctatctttttgtgtttagttctttttgacttctttggcctctaatgttttgacagtggcacttagatgacagtcagcaattgcaacagtgaatgaaatcacacagcttgagttcaaggtggaaagagaaaaaaatctagagaggatgttatctgacctggcatgagaggtgatcatcctgtctctgagcagtgggttcttgctctcgaccttagggtgtaatgtggccctgctccttgtatggtgaataacttgtgactgctgtgtttaccacatggcttgacagtttacaaagcacttttgtgtatattattgcacactctgatccttacagtaatcccgtgaggtgtggagtggaggctttttaagaaacagagactgctttgggaggcataggtcggtggatcacctgaggtcaggagttcgagactagcctggccaacatggtgaaaccccatctcaagcaaaaaaaaaaaaaaaaaaaaaaaaatgccgggcatggtggtaggtgcctgtaatcccagctacttgggaggctgaggcaggagaatcacttgaacctgggaggcagaggttacagtgagctgagatcatgccattgctctctagcctgggtgacaagagcgaaactccgtctcaaaaaaaaaaaaagatggagggtgaaagagatggagacttggaggttgcacactgttcagtggaggtgcaggacttccagcttggtctttgtccccagctttttaagaattcaatcatgaagaagattgtttatattgttcttttttttttttttttaatggattgagtgtgaaactggtggaaatatattccaggaggccatttaaaaagaaaataggctgggtacagtggctcatgcctgtaatcccacactttgggaggccaaagcaggcagattgcctgaactcaggagttcaagaccagcctgggcaacgtggtgaaattccgtctctgctaaaatacaaaaaattagccgggtgtagtggtgcatgcctgtaatcccagctactcaagaggctgaggcagagaattgcttgaacccggaaagtggaggttgcagtgagccgagatcgtgctactgcactccagcctgggcaacagagcgagattccatcttcaaaaaaaaagaaagaaagaaaataacaaggttaccatggagatcctgcagtcacggggacattctcaaacatcacaatgattggtgtcaaaaattgaaacctggaagaagaaaactggactatgattgttgaattagcacccggggaggttttattattctgtgttcaccccaggaaattcttaaggcctgagtgttgatgtccttcagcaacccaacatattaacgcagtctttaggagacatgaaatgttccttccatccagggaagacgtgattgcagcaggcaggagttgatagtgatgctatggggctgtctgctctatacgaggagcagagacccctggatcctagtggtggcccctggtcaccagatgtgagccctggagcgcatgattgtggttttgacccattcttgccccagcttgagcctgacctttggcaggtccaggagtgtgctgagtctttctaccccgctgcgtggtgctgcctgccgaggtggtgtggctctttgtgctggcatttagggtgtcactaaagcccaagaccaggattgcttgtcctttgcagtgtgctggacaggagccacacagtgtagaagcgacttgccctaaatgcctcattgagaagcatgggtgtccccttagacatcatgggagctcattgcattgatgaagccctcttgagtcagatcgtggggttggttggtcatgcgtgtaattatgtgttgaggtttggtgccttgagattaaagggatgccacattttgagcttctcagatataaaagaaggattctttgggggaggacctataaatatttcttaaaagtgttttacaacaaaagcacggagtgtacttcagaaggaaggatttagctgctggagtgatggccgaaggagcctgggagaagtcagagagagggggctcgtggtccttcttgggctctcattgctgttagcaggagttggcacttgagtcccacgtcctagcctcccggcatcacagccttatgctgcatttcctaaagtgctttctagcactgaccgactccaggaggcagcactggcaaggattttggtgagcctttgatggagtgtgttccggaatcgggaggaagcttgtaaggctgctttccactcattttatgttgttgggatttggctcggaacctgccaaggacccctgtgtgttaaagttgaaatagttccctagtaaactggccactttcagaccagctgcattttctagaataaacttcatttgtccttgactcataaagggaaaagccagaagccaggggctctggggcacctccaagtgggccagggtcaggtgtgggtcctctgcctgggttttaatgtaaactcagggttttaatgtaagaacctgttttgtttgcttttgtttttagaccaagtctcactctgttacccaggccagagtgcagcagccataaacatgtcttactgcggccttgaaccttggtcttaaatgatcctcttactcagcctctcatgtaactctggggtaactccaagtgggccagggtcaggtgcgggtcccctgcctgcgttggtctcactgccatataaccccagccatggtgatcttaccagagaaactcatttgaacctatgcggctgcttcaggccggtggttgttggcctgataggaagagagcatactcagcctcatactcagcctctcgtgtaactgggaccacaagcatgcaccaccatacctggctaatttttttttttttttttttttggtaaagatagggtctcagaggtttggtgtggtggctcatgcctgtaatcccagcactttgggaggctgaggcaggtggatcagttgaggccaggagttcgagaccagtctggctaacatggtgaaaccccatctctactaaaaatacaaaaactagctgggtgtggtggtgtgcgcctgtagtcccagctactcgggaggctgaggcagaattgcctgaactcaggaggcagaggttgcagtgagccaagattgtaccactgcactccagcctgggtgataaaatgagatcatgtcttaaaaaaaaaaaaaaaaagatggggtctcactttgctgcccaggctggtctttgaactcctggacttaaatgatcctcctgcctcggccccccagagtgctgggattatgggcatgagccaccacacctggccagggcctgtttttaattgttgaattgcccacattgcattatcaggattgaaaacatagtagtggcacagcctcctggagagtgcagatgtagctcatggtacgcttggggtttctgcagagcatgacatcaggctgtcttccagccttgcctcactaagaacttgaagcatgaccctcaataaaccacttttttttttttttttgcatggaaatctgtgaagaaagaaggccttgggaaagcctgtgtcctggcctgtcattgaacgtaataattacattaacaagtgaatgatttaagttctgcactctttgttcttataggaacaaggttaagggacgactgtgttgtgggttgaaatgtgtcccccaaaatagtatgttcaagtcctaaccttggtagctgtgtgtgtggccatacttggagatggtctttggctgatgtaattagttaagatgaggtcatactagattggagtgggtcctgatccagtgatcggtgttcatctgagaagagggaggttgtgacagcaacacgcaggaagggccatgtcacgatggaggcaaaggtcggagcaagctgtgctaggaagaggcaaggagggatcccctcccccagccttcataaggagcacggccctgcagacaccttgatttttgaacttctggcttccagaactgcgagggaatacatttctgctgtttgagccacctggtttgtggtacttgattacagcagtgctaacctccccacagttacccacaacctctgagtacctgtttgccgctcactcctccctctcccattgccacgtggtctctgcttttattcgttttctcagcggaaacttggaggccattggctattgtgtatcgtgtatcgtggctaagtcattacctttttttttttttttttttttttaaagaaaacccaaaaccaaaaaactccttttaggcgtcacccccctacccacttaggtacagtgctgctgctgctgcccccggcttcttgaaaccttctttctgactctctgagagagactcttgtggatatcttgtagctctggcctttttctttagctctggtctttccctctcttggctgtggattcatttcttatcgctgttgtaacaaattaccacacactaagtggcttaaaacagcatagatttattacagttcggaagctcagaagctccaaatgggtcttacgggcctaaaatcaaaggctgtgctccttttggaggctgtggggtagactcgatttccttgctttttccagcctcaatggctgctgcattcctggccttagctctgtatccctctggcctctgccgtggtagctgcgtggcctgctctgaccctgacctcctggaaggaccctgtgattacattggacccacctgtgtaatccagaatccttgcaaaacccccatctcaaaatctttcacctcttcacatgcacacagtggctttgccccgtggagccacatgctctcaggttccaggaatgagtctgtgggcatctctgggggccactgttcagcctgaatgtgttctgaggcttagtattttgtctctttgagttctacattcattttgatccttacatcatcatctgcaggggataggtgattctcaatctaggtttgggaagaggaacttaaggctccacagaaatttgagtccatttttacttaaatgtactttttacctttagaaaaacttgtaggtaaaaaccaacaggtgcattcaaaccaatcacacgccaacttttaccacccaccaccgtcttaccttctgctgctgtgttggctcattattttgcgcggacccgaaatgaaggctgtctcgtcctttctgtttaattggagcgcctggagagcacaggtgagttgttaaaaacccggtgaatcctgcatggatttgcaaaccaaactacatggagaaatcagttaaattctcaggtttcagggttgcagctgccactgagaagtgtatttaggcaggttctggcaacagacttggtgttgggcttgagtgggaaggggatttaggagcttcatgagcgagtcaaatgcaagttggggaagtggctgaaaaaaatgcctcctggaaaaagcagtaaatgtaaggatttaggtcggccattgtctccgtgtaagtcaacactaccttgtgtgtgtgcgcatacacacaaagagggtgagccctcagcccgccatacgggcatgttatccagaagagaggagagagaagcccgctgcactctccactgaccagaccacccactttgccctctgcacgctcactccacgaaggatgcaggtgggcacactgctacaaccccctgggtgtgtgtggagttgggaaagagacggatgttgagcctgaagaggctgtgacctccccaaatactcggactcccctgtggaaggcaaggtggaggcagctgttatgtggtgtgttggattcacagcagtcaaggctgccacgagcaagtattttgagtgctccttatgtccatgcagaggctgactccagaggatgctgtgcacaggcctgtgtgacctgaaggcccttgcaggctgaggtctcttggtgataatccacacactgtcctgggccttggttttgcagcatttccaacttgggttgtcagagtgagactgtgcaggactgccccgtacagtacggcttctatgtgtgaacaacacagaccactaagagatgtgacaaagctgttccatcagaggaaacatagtctgggggacaaatcctcccattcctgataggacaggagggagcggttggctggggaagacctgagtgagggagctttcttgaggacgggttttgtcggagtgtagttcatataccatgcacagcctgtcagcatacagcttgaatgaactcacgtgtgtaaccagatcaagaggcagaatattactagggtggcagttttgagtcccatgaaaacaaacacatttactctgtctagctccatctctagttaattctagtgcagtttaaatgctcacaaaatccttatttgaatggatgagtcagtggtttgaattgaatagtttttgagccatttgtatggagaaggtattacccaaacagaaacatggtggtgataatagactcacgttgatttcacttgttaactgagcaaacacctcttgtctcctcattctgtgcagagcattctgggtggaaaagtcggaccaagtttctgaggggaggacggaggagtcctgtcttttaagcagatggagctgcaaacagccagagagtgacagagattgagaggcagcagctgtcttttcagttgcgcatcctccttgtagtaaccataggtgggaggctgggattccgagctcagggcagcgggatgctcaccatgtgctgggtgctgtttgaaggaccggaaatgcatcattttgtttaagtctcccaacaggccgggtgcggtggctcatgcctgtaattccagaactttgggaggctgaggtgggcggatcacttgaggtcaggagtttgcaactagcctggccaacatggtgaaaccccatctctactgaaaatacttaaaaaattagccgggcattgtggcaggcacctgtaatcccagctactctggaggctgaggcaggagaattgcttgaacactggaggtggaggttgcagtgagctgagatagccccatttcactccagtctgggcaacaagagcaaaactccgccttaaaaaaaaaaaaagtcacaacaacctgtttcacttaagtacgggcttaagaggccagtgtgagggtcaggagctaacactcagccccacaggggtctccaggtcctgctgctccttccacgcctgcccggtccctgcagcttcccatgaacggaagggaagtcatctggcagccttagaaatgctcatttgtggccgggtgtggtggctcacgcctgtaatcccagcactttgggaggccgacatgcgtggatcacctgaggtcaggagtttgagaccagccttaccaagatagtgaaaccccgtctctactaaaaatacaaaaatcagtcgggcatggtggcacatgcctgtagtcccagctactcgggagactgaggcgggagaattgcttgaacccgagaggtggaggttgcagtgaaccgagattgtaccactgcactcagcctgggtgacagagtgagactccgtctcaaaaaaaaaaaaaaatgcacatttgcatcagtgatttcattctgccagtgttaaatgaaaattgttacagggaagttagttctcaggatccattggggataaaataccagaacaaagggaaggctagggtttcttctcctccacttctctacactcaaccacccttcccatttctttaatgccaacgcaccgtcaccttcctcacccttgatgctgagacattcaagaccccttagaacccaggactcccggtggctgctacaccctggtcatatctggcctctcacacttaacccctccaaatagtaaaatctggataaaaaaaaattgggttttcaaagagctgttaacagtcttctgtagctgagtttttaagaaattataccatattcattttgactcctaattcctttttggaaaaatttctgaattttgttaaattcacggagtaacacaaatggttatctttctgttcctttaaaatctatctttgatttggagattactagggtaaattatagatcaagaatatcatacatgtcattattcactgaaatttgcagtcagctctgtagacaccattctgcctcctttacccagcacgttggggattgtgattactgacgagacctttaaagaatcttccggctgggaaaggtcccgagtggcctgctttcctggcttatttgagaattttgcctggcccctaggtttctcagcagtctgtatttcccactgttcgttgtgctcgtgctgagttgttttcctatcgaaatacaactgtgttttattgaccttgaatagctctgccagatttcacaggtgctccttgctctgggaggccctgaaatgccctttctggtccctcttgggttcagcgctcagggcctctggaaggtttcaggagccccgatgctggtagaaaaggagattttgagaactaccagttaatagcttattgttttgttttttttttttttttttttttttttttgagacggagtttcgttcttgttgtctaggctggagtgcaatggcgcggtcttggctcactgcaatccctgcctcccaggttcaagtgattctcctgcctcagcctcccaagtacctgggattacaggcgcctgccaccatgcccggctaacattttgtatgtttagtagagatggagtgtcaccattttggccaggctggtctcgaactcctgacctcaggtgatccgcccaccttggcatcccaaagtgttgggattacaggcatgagccaccgcgccagtgctggtcccagttaatggcttatttctgaatttcccatccaaccgaacttttcaagtgtaactcctggttcttcatgggcaggaggaccatgtccgctctaggtggcttgtcctctttgggaaggctctctttgcattttaaaattattctggatgacagaatgaaaccctgtctcaaaaaaatatagatagatagatagatagagatatagaatggagataattggaggaagcagtggtcattttagtgtttgtgtagccaggagagcacggccaggactcactctgagttggggtagccagaattcagagcatctagagagagagagagagaggctcacctcttaggaaagggtttgggaatgagtaggaagttattttcctttttttttttgagatggtatctcgttctgtcgcccaggctggagtgcagtggtgcaatctcagctcatggcagcctctgcctcccgggttcaagcgattctcctgcctcagcctccctggtagctgggattacaggtgagtgccaccacatctggctaatttttgtgtttttagtagaaagggggtttcaccatgttgagcaggctggtctcgaactcctgacttcaagtgatctgcccgcctcggcctcccaaagtgctgggattccaggcgtgagccaccgcgcccggccctttcttttctctcactgttactgtctccctgagtttttactcggtgttaacgtttaaaagctccagcttcaaaaagtagtttttagtctttcttaaaatacagatgtaagcacccatcagctctctgcccaaagataaatattcttaacctttaggtgcctatccttttatgccagatgccaagttgaccagggagtgtctgcacagattcccggtgtctgcacctcctagggatatggaaggaggcctgagctccgcgaggctggatgttgaagctgttgatcaacaggtgtgggcaggaagggacgggaggctggaaaccgtgaccatgcccagagacagggcttctgggggtcaccagcaatgcctttcactgccctctccaccacaacctgcttttcgaatttaaagataacagaacctgccaggataggccactcatttttgtttttgtttctgttttttttgttttgttttgttttaatgtgtgtgtgtgtgtgtgtgcgtgtgcgtgtgtgtgtgtgtgtgtgtgcatttttttttttttttttttttttgaggcggagtcttgctctgtcgcccaggctggagtgcagtggtgtgatctcggctcactgcaagctctacctcccgggttcatgccattctcctgcctcagcctcccaagtagctgggactacaggcacctgccactacgcccggctaatttttttgtatttttagtagagacggggtttcaccatgttagccaggatggtctcgatctcctgacctcgtgatccgcctgtctcggcctcccaaagtgctgggattacaggcgtgagccaccgcccggcctatatttttaattttttgagacagtctcgctctgttgcccaggctggagtgcagtggggcgatctcggttcactgcaacctctgccttccgggttcaagcaattttcgtgcctcagcctcccgagtagctgggattacaggcacccaccagcatgcccagctaatttttgcatttttagtagagatggggttttgccatgttggccaggctggtcttgaactcctggactcaggtgatgcatccgcctcagcctcccaaactgttgggactgcaggcgtgagccactgcgcccagccctgttttttaagttatgtaaacagcaacgggaatgaattgactgaacgagggggagtggagtgggaagcaatgtgctgcccgggtcttggtgtgaaacgcagtggccctgggcagaatgcacaacaaaggcgcacggatttgggtttagaggcttaatccctccttctcttggtgtgatgttgactccacagaggcaaatgtgccccaggctgcagtcaactgtttgacctcgagtttgggataagcatacggcctcttcagcctgatgtcactgatgtggtttggatgattttctcctccaaatctcacttcgaaatgtgatccccagtgttggaagcgaggcctagtgcaggtgcttgggtcatgggggtgaatccttcatgaatgtctagcaccatccccttggcgatgagtgaattcttgctctgatagttcatgagaggtctgttttgttttgtttttaattttcctttacacaacagtatacagtattaggtgccaagagacctggttgtttaaaagagcctgcccccacccccaccccccaccacttctctcttgctcctctcttgccatgtgacatgcctgctcccccttcgtcttcccacatgattggaagttctgggaggcccttagcaagagcagatgctgctaccagcttcctgtatagccttcaggaccatgagccaaaataaacctcttttctttataaattacccagcctcaggcattcctttatagcaacgcaagaacagactcacacagtcatacattgaagtggcgctggttcccaggggcccaggcttgcctggacagcgccctgtggccaggaagacctggggagggagggtggctggaggccaggagctgtgctaggtatccctgctctgcagccaaggaggctcctcctccactgccctggccacctggatgctgcatttaattctgggcaccacgcgccagaaggaggagtagatgagccatgttctggggggcagtgagcaggatggtgaaggaggagtagatgagccatgttctggggggcagtgagcaggatggtgaaggaggagtagatgagccatgttctggggggcagtgagcaggatggtgaaggagcttagaaccacgagaggaccccgcttttccagggttttggagggcagggctccaggagaggctcatttagggctgactccgggcttgcggcttgtggcatgagctcttggaggttctccctaaggagtcagccaatcaggccttcctttcttgtggttttgagcagattccaagctggcttcacgggaggggtgttgaacaggagtagctatatcagagtcaaggcagggaggggagacctcagtactgctggatgtcgcacatggagatatgggcgcatcttagttatggtgtcagtcccaaagcctgtatctggccgaggttgcttggggacgtgatggctaaagctgtgcccttgcagggtgagagtgcggggtggctgctcgtctggagaagagagcaccccttgggaaatggaagatggaggtggggatcagctgctgcacagtttccaggaacactggtgtctcagggagacacctggcatctcaaaataaggagaggctgtctgacagcttcagttaaggatgatcggtggctgggacggtggccgggagggctgctgagcttctgaaatgagcgttaggtgaccctgacctgctgaaggcccctgttcacctgaccaggtgagagatggctcggaagtgagggagaggggagagggatgcaggttgtgggcctgtaatccttattgatatcagccaccctcaacctgagatgtaaattggaatcacctgtggctctcaagctggcattcagacgggcagcttttcctgagccctcaaggagattctgtcttgcagcacgtgggtaacaagtggattgggtaaataggctcttccctggagggatggtgttaacgcagagacccgagactgagcttaggaaacaaaagtggaacagaacaacctcctgatttcaaaagcaaaggcttaaaatttatttcagaatgagttacagtgatattagtatgtttttttgggtggggaggacagaatctaattttagttgttttagattatggtactttttcctgcttgatttacatgttaaatgtttctgatgaactgttaaaatcttcgaggtttttgcttcatttaaacaaatgatgcctgccaactctacaacttaaatatgttttccgtgtatatagatatatacttaaatatatctactgtgtgttttggctttgaggttttcaaaaatgtgtattcaaatcgtgtagcgctacagctaattcagtaataaggactaggcttagtggctcctttctgtaatcccagcactttgggaggccaaggtgggaggactgtatgaggccaggagttcaagaccagcccgggcaacatagtgagacccacatctctaaaaacaaaaaatacaaaaattagctgggcatgatggtgagcatctgtagtcccagctgcttgggaggctgaggtaggaggatcacttgagccccggagttcaaggctacagtgagccatgattgtgtcactgaactccagcctgggggacagagcaagcaagaccctgtctcaaaaggaaaaagaagagaaggaaaaaaaatcaatcaaattctaaggtgaatttgagagtatacataagtttaatgaagatttttatttagtaataatcataggtgcacatgtagtaaggatagttttcaagcggtgttaaggaagtggagattgagatgttaaatagcatctgataggcgtttgcttttcaaatagacttagtacttcagcttcttactctagagacagaatacagttcttacatggcttttaagatgctgcccccttctggtgactaggaagattataatatctgtagcaaataggcattctggggttttttttttttcatatttaaatattagttttattactgaacctgaaaaacaaaatgaggatcagaggtagcgtctcctcctctgtactctcctttcttccttgagaggaggaataactttctgtctcttgctgttctttgtaaatgagtttccttttggctttctttcttctgtccttccttcctctgatgggtagagcatctctgtgggccaggtactgtgttcagcatttcatgagatttatcaattttaaagaagaattgacaatatgatgcggagttttccagattgctgtttgttttgagagggagtcttgctctgttacccaggctggtgtgcagtgatgtgatctcggctcgctgcaacctccatcttccgggttcaagcaattctgccttggcgtcccaagtagcagggattacagatgcatgccaccacacccagctaaattttttgtatttttagtagggatggggtctcaccatgttgaccaggctggtcttggactcctggcctcaagtgatccacctgcctcggcctcccagagtgctgggattacaggcgtgagccactgcgcccggcccagattgctgtttttttttttttttttttttttatgatgtaaaagtatcaacatattttttaaagaaagtttcatctgctgctatctagaggaggtagctggaaccagagcaccaggctggcactggcaaggaggagagggcacctcccggcatgtggacggaatgacccaggtgaggcgggtgtggcgccagaggggcctgttgcagacctgaagaactccagtgtgttttgcagaaagggagtttcagagaataaggggcagccttgactcagacggcttgggagaggagtaagtgcagcccagcctccaggggaaggggaggaaaactgaaggtttgtaagggatctggccagcatggtcttgatgcctggaaacagctcctgggcttctcaccagtattgggagctgactcttagaaaggcagccttcctggggagcacaccctcgaggggccggaaaccgtgaaactgaccagaagcacataggtccagtgggcactgaaatacattctcaggaaggaagtgtagctgaagtccagaactcagcttactctcactcctgggcctgctgctgccttaatgtgcctgctcctgtgtttttgttctgataaacacgtatagcactttcaattatgctgttacttacagctaagtaaagcagtactaggtggatttgtcagtgccacttcctacaaagtgaaggctggatttttgggggactcatttccagcagccaccagcaggtggagggagtgagatgcgtaaacaaactgtccctcatgcttggtgtttgggcagatgcattgctaaagcgtgctcactaataaatcccctgctgatatggcacaaatatttatagccgatgattgatgtgaaattaacaaaaactagcagttgacagcgatatgaggtggcaaaggctatttgggaaagtttccgttgtctttgaaaattaagaaaaattatacgtttacttgccttgctaagaactgtttaagaataaatcaacataaactagggcagcttcttaaactatgatggagaagcacaaggtcaaagtgtttcgtctcagaatgaagcagtaatgtattactttgcgtactgtgtacaggggccggcagatgtttctgatgttatgaagctatgctcctggaagtggttgtgaaaatcgcagccctgtgaattgtgtgccctaagagccagctgtgctcctaacagtgatgccgtctttccatggaaatcacccataagcacagccttcagtctaacttcatgtcaagtctaagtggcacagctatccatgaacactgtaaacattcccagctccatctaaggtgattaaacggagtcagaacccggccatggatgtgtattcactgttatttaacagatgctcaaactagacaggtgggactgtccagatgcctgtggggcactacagagttttgaggaaatagagtctcagactggagccccaaggaccttgaggacaggagtctacctggggaggggcatcccagagacttactccagctgcttaactccggtgtgcctggagtcaccttgggaccttgttacctgcagatttggattcagcaaggcaaggtggacctgagagtctgtgtttctggtgagccacaggtagcaccccggctgctggtccctggtctggggaaaggcaggcagagttggagagacccttcccgggttcctggttgcaggtgctgtgtcatcgtatggctgtatttgaggggattgtgtaagaagatgttgttaaatttatttttagaataatagacttttagatagaagagaaacctcggaggtcaatcagctttcactcttcctctcttgtgccccagtcctagtgatgagaaaagcaatgatgtttcccaaggccggggctgtcgactgaattgtgtccctgcaaccccgtgtgatggtattaggaggtgggtctgtgggaggtatcaggtcatgggagtggaccccttgtggtggcacgaatgcccctcaggagcgcttgctctgtaccctatgaggacatcatgaggagatatggcttctgcaggaagaggcctcaccaggaaccaaattgaccagtaccttgaacttggacttccagctgccagaactgtgagaggtaaacgtgtgttgttgaagtgcctctgccggtggtctttgtgatagcagccccagccgactcatcacagccagattaagggagatcaaaagagttaaggttccagactccagctcctgagttcttctatgtggaaagatgccccttcaaccaccaaggccagggatgccctgtggttcagcgttgtcacccttgttgcccgcctccagggcagagctgggggcactggaggtgctcaggacgtgtggagcagaattgggagtgaatgttgtgtgctcagggccacctccactctgcaagcacagctcccagagatgaggacggggcttgctttgtcctctgccacacacagcccttcatgcaaggccttggcccctccagggccacacaccttggccacccagcaagcaccccttgcttggccagtctttccgtcacttcctttcctttttccctgtctcctgagcttcagactagttgaccctaaggggtgtctccagctgtaaataactgtccagactgcttgtaaaggaaaacattgcaaccaccttactgcacaattgatactattattattttagggttacccaaaaatgtgcagcacgccctcgaatgacatggatttgttctaacgttggtgatgaaaaaaatggattcccgctggggccctgtctgtgtggagcgtgcacgcgctcccgtgtttcctgtgtgtggagcgtgcacgcgctcccgtgtttcctttgtgtggagcgtgcacgcgctcccgtgtttcctttgtgtggagcgtgcacgcgctcccgtgtttcctttgtgtggagcgtgcacgcgctcccgtgtttcctttgtgtggagcgtgcacgcgctcccgtgtttcctttgtgtggagcgtgcacgcgctcccgtgtttcctgtgtggagcgtgcacgcgctcccgtttcctttgtgtggagcgtgcacgcgctcccgtgtttcctgtgtggagcgtgcacgcgctcccgtgtttcctttgtgtggagcgtgcacgcgctcccgtgtttcctttgggtggagcgtgcacgcgctcccgtgtttcctttgtgtggagcgtgcacgccctcccatgtttcctttgggtcttccggtttccgtcgacgtcccaaagctgtgcacattaggtgactggcgtgtctacagcatcccagtctgagtgagtttgggcatgtgtgagtggccccgcgatggaacagcgccctggttcctgcctgcccccactgagctgctgggacaggctcccaccaccctgaactggaataattgggtaaataattatcttacttatttttacatgtatgtaagctcacgtttattgcagtgtttaatattagaagggctttggtctttatttagaagtttggtgatgtttttgtgaccagaaataagccataggagcttaactcttgtttatatcaaattaccctatgggaaacttggttgcattgtatgtcgtttcgtttaaagttgctgtttccaggaacctattggtgatgtgaagtgaggacttactggatgacgtgaaactaattttaactttcttttactcatcatcctgggattattcaagtataaactcagaattgccaaattaaatgcaaagatatgaaaaggagccgcttatgctaaatgtacagatgatgcgtttttgctgtaacggagtcgtccctccgggtgctgactgtgccactcagcatggtggcccagggctgtgtgtttggtgcacagtgggacgtcttagtcccactacctcagccagactcctggcaaagtctttattttttaagataatttatttttagattttattcaaaatgaaaacccatttaaaaagcacatgagaaatgagttctttattcactcatctaaatatttagggctgtggatgggctcagctgctttaaatatttggctgggcagatgagtgggagcctgtcttcctcttgttgacatttgcgtctgtggtggtgtacacagatgagctcactgctgtcctcggagcaggtaggaatgtatttatttactcgcatgccttcagatgcttgcagtaagtccatttgagatgctgcttctatttttccttgtggagaacttacttgacgccaacaaagaaatttctagctgcttgtagaagacaccccagggtacgcagccagtcccttccacgaatgctgcgagaacccacacagctgttcatttcggtggccgagggcctgtgggctgcagtacgtttacactgtgtgttgggggggtggcagtgtgctttcttcctgccccaattttgcccaggaggagtctggtgatggagaaggtgtggcgggcagcaaggaggctggggaagtggatgctgcagggtgagctctgggcgacccaggaggaagtatttgcatgaattagccacacgcagagggcagttatgtgtgatgtgggaaatgactgcaaagctatcttactctttattccatagccacaaaaataagtttataaaaagcccccaccaagtcaggatttgtccagaatggtcactctgctttggagaactgcggatcccctgccatggcccatgtggctccggaagttcctgggagtggctcgtagagcctgttttcatccttcagaggaatcctgcagtccacttgcccagcgtcacttcctccagtgccctttctgggtcccacgtgattctacctgatcgctggctctctagggcttttcccctccaggttcagagagagcgcctgccccagggctgggaagatgagcagggatcctgggatgtgatggcacggtcagtcgcccctggtggaggcaatgctggtacccacgacgtggagccctgaaggatgaggaaaataatttctgagaaactgactcagggaagtgcctgtgttcagggcggaggttccactgtgatttgaaaacaggcgattcttccagacaactttaaagatgagtaggtgcaaactgcagccacagtaaacttcagggtgtcaacttcaggggaatataaacagcctccagggagcccctctctccatcccagcctttcttcctctctcgtaactgttatttactcagtaattacaggttcaagtcccttgtccaaaatccaaaaagccgacactggaaatattctgtagctcatctggcagcagggccagagctgatgatctaattcggatgatttatggcctctgtttaccccacagacgatcagtgtgcctgcttccagggggctgctcctaagggaggtgctggcactaccttttcagcctgcatggactgtgctggaaacactcagtagcaactcaggctcagggagccctcacctgaagccctcctcttacccaccctctgccctatagacccccatactcctgtagataccccctcattacagacccccaccatccccgctggattagggttctctagagggatggaaccaataggccagatatgtaataaaggggagtttattaaggagtattaactcacaggatcacaaggtcccacaataggctggctgcaagctgaggagcaaggaagccagtcccaggccgaaagctgaagaacttggagcctgatgttcgagggcaggaagcatccagcacaggacaaagatacaggctgggaggctaagccagtcttgcctgttcatgtttttctgcctgctttatatttgctggcagctgattaaatgatgcccacccagattgagggtgggtctgccttccccagcccgttgactcaaatgttaatctcctttggcagcgccctcacagacacacccaggatcaatactttgcatctttcaatccagtcaggttgacactcagtattaaccagcatacccaccattgtttcacctgcagcctcccccatctcagctggtgctcactttatttttactgcttgttgttctggccccagatctcagagtcctggtaacgcctctcctcttctcactgccttcagtatccagccaagctgggaaacgccactgccacagtacctgcagggtccagccagctccccacctccactggatgccactgtgttagcttgggctgccacgacagagaccacagagtgggtggcttaacagaagtgtatttgctcagtttgtagaagttgaaagtccaaggtcaaggtggcgtttctggtggggcccctctttctggcttgcagatagttcctccttactgtgtcctctctgtgcttgggggtggggagagaggcgagaagggaaggagaaagagatggagacaggtttgctgtctcttcctcttgttataagaacaccagttgtattagtctgttgtcgtgctgctaataagcacatacctgagactgggtaatttataaaggaaagaagtttaacggactcacagttctacatggctggggaggcctcacagtcatggcggaaggtgaatgaggagcaaagttacatctaacatgggggcaggcaagagagcttgctcaggcgaactcccgtttataaaaccatcagatcttgtgagacttattttctaccacagaacagaataggggaacccacccccaagattcagtaacctcccactgggtccctgggagccacaattcaagatgagatttgggtggggacacagccaaaccatatcaccagtccgtggagccaggtgtggtggctcacacttgtaatctcagtgctgaggcgggaggatcactggaggccaggagtttaagaccagcctgggcaacctcttttaaagttaattacttcccagcaggccctgtttttctggtacagtcacactggaggttcaacacaatccagccaccacatcacccaggtcactgcagtaacctcttagcgggcctccgtgccccatcccaaaaggtccattctcaaaggagactccagggtgacccctaaaacccaagtccaatcacattactcctgggcctcacacctgcagcagctctccaaaattctcaggataaacaccgatgtccttactatgacctccagggccgcagagcaggcactggcaaactgctgccacctgcttctgtatggctttctagctcagcacagtttctgtggttttaagtagttgggggaaaaaatcaaaagcataacttgtggtgcatgacaatgatatgaaattcatatttcagcgagcacaaataaagccgtgttgggtcatagccatgcctgtttgctcaaatgttatctgtggctgctttcatgtgacatcagcagaattcactggttgtgacagagatctacataattccctcgattttgtctcttggcccacaaaacctaaactatctactccctggcccgtggcagtggaactttgttaacccctgcttggccttctttcctcactacctctttgcccgccaggctcaccctcactccctccgctccagccacactcagtccctgctgttcctctagcacgccagccccagggcctttgcattagccgtgccctctgcctgagtgcccttccgcttcctgcattttgcccttccttcaagcctttgctcagtgtggccatcccattcagcctaatggtgcatgtttcctccacctccacagttcctcttatcctgtttccattttccttagcagttatccgcatcagacacatttctttttcttttttttgagaaggaatctcgctgtgtcacccaggctggagtgcagtggtgcgatcttggctcactgcaacctccgcctcctgggttcaaatgattcttgtgcctcagcctcccgaacagctgggattacaagcacttgccaccacgcctggctaatttttgtatttttagtagagaaggggttttaccatattggtcaggcaggtcttgaactcctgacctcaggtgatcctcctgcatcggcctcccaaagtgctgggattgcaggcgtgagccaccgtgcctggcccatcggacacacttcttactgatatggtttggctgtgtccccacccaaatctcatcttgaattatagctcccataattcccacgtgttgtgggagggacccagtgggggataattgaatcatgagggtggtttcccccatactgttctgatggtagtgaataagcctcctgagagctggtggtttcataaggggaaaccccttttgctcggctctcgtctctctcttgcctgccgccatgtaagatgtgcctttcaccttctgccatgattgtgaggcctccccagccacttggaactgtgagtccattaaacctctttttgtttataaattacccagcctagggtatgcctttatcagcagcatgaaaaacgaactaaggcacctactgtatttgttttcttgtctgtgcaccactgcggaactgtgagctcccagagtgcacagatatgtgccagacaccaagatcagaatgggtgcttcgcagtgctcaatacattatttattgaatgacttaatgtagaatgactagttacacagttcaggtgctaggaggcagtataaaagtcagagagcaaatgctttaagaaactgtagtatacaccaggaaatgcaattctttagttagataccttctcctttcagtaaaattatgttcagtgctgtaaataggcaactttcagtgatttgtttttcaaacaagtggctttttatcttttcctcttgacagtgagtgtctctccatgtgtgaagtattttctcctctcatatctgtgaagtcctgcttgtaagtgtttcggttatgcaacatttcatggggaatttgagcactggaattcttggtcgctagttaggtgggtcttaccgcatttgtcagaaaggaatgcgtccatcaggttggttgacgggttggttgacggtctgcaagttgcagtcttggcacaggcacccatcaaaatgacacacggtgactctggtttcttccagcatccccgagatgaagatgaaaaactgttgcatagcaggtggatcttgctagaagctctccagccatgtgattagtttatttgctcattttttttttccttttaatataaatatatcagaattcaggctggtttcagaacctggcatcaggaatggaatttaaaaaaaaaattggttcagatgtatcattcctccaattggcatatataaaaagaatagtgtggctcttgcctggtaatactggcactttgggaagccaaggtgggaagattgctttactccagggatttgagaccaggctgggcagcatagtgagaccccgcctatacaacagattttttttaattagctgaacatggtggtgtgcacctgtagtgccagctactcgggaagctgaggcaggaagatcctttgagcccgggaggttgaggctgtagaaaaccacgattgtgccagtgcacttcagcctgggcaacagagcgagaccctgtatcaaaataaaaaaaaaaaaagtgcttgttactgtcctctttatgccagttcctttaggttgcacattcgtgtttcttttttatttttattatcttttttttttttttttttttttttttttgagatggagtctcgctctgttgcccaggctggagtgcagtggcacgatcttggctcactgcaagctccacctcccaggttcacgccattctcctgcctcagcctcctgagtagctgggactacaggcgcccgctaccacgcctggctaattttttgtatttttagtagagatggggtttcaccatgttagccaggatggtctcgatctcctgacctcgtgatctgcccgcctcttcctcccaaagtgctgggattacaggcgtgagccatcgcgcccagcctattaccatttttttttgagacggagtctctctctgtcccccgggctggagggcagtggcgcgatcctggctcactgcaacttctgtctcccaggtttaagcgattctcgtgcctcagcctcccaagtagctggccacaggcgtgcatcaccatgcctggctaatttttgtatttttagtagagatgggtttcaccatgttggccaggctggtctcaaactcctgacctcaagcgatccgcctgcctctgcctccgaaagtgctgggactacaggcatgagccactgtgcccagcctcatgtttcttttgacagataacatttaatagtaataaataagtggtaataagtaataaataataattgagtgcttttcacattccaggtgctgagctgttttgcatttcacgcccctcatcttcatttatattgttgttcttaattatccccattttaccgatgaggaaagggagattgtaaccaccccgaggctgcacagctaatacccagagagcagaatttcgccacatgcgaagattctagctaatcctaaaatctgtttttcaccagacgacgccggcccttccggcttgtcgtgcagcacggcattatctggtacccaccatttgtatcccggcatcatttatcttctccctaccttgttgccaaggcacgtgtgggtccctaacggctggaaacaccaattattcaagacaccctaagggagaccagaaggaaagcgatatttaagaaatgcaggcacagaaaaatttaagcattttagactcattctccatcagaaacagggaggtctttgaagaggctgcttttgtaaaaattgccagctgtacccggtcagcacatttttgttgtctaacatttgttctcaaccagcaattagtcaatgactctagaatttcagcgcagatccgatgagtatagaggacgcggtgtacgccctgtgttgccatggcaacgcaggcatgcacatcctcctcccttggctgcagtgtggtggtgaacagcactccggttgcttaagtgctgtctgcagacacaaagatgtgtttgcctggtgaaattacagagcttttctttctactttttaagaattttctacactttctccaataagtatgtgttttataaggaaaacaacaaaacaagcaaacatgtttataggtctgcagagaagaagagttcttgtaaacagtgttgaatattcatggttcccaagatcggccatttccccggcctttcaccggtgagaagtaaggcatctgctctggccagtggcttgcgttccattggtcacccttggcattgcttcacatatgtttgcggctgcccttttttaaccccttggtgaatgtgatgtaggaggcagaagaaaggccttctgttctccacaacagcagaccgctgagagccgatcatgtatctgtttttaaggaaagcaaaacctgtttgccagagatgaacatccttcaccctggagccagcatctggtagatttgggggtttggggatggcaggaatgagttactcgattcagagaccaagaactacttctgtgaaagcatcatctgggtttatgtttggaatgtctagtatcacatccataatgaacctttttttaaaaaagtgggcatcagaatgaatcttgcatgtcaccaaatcgaaagccaatcctgagtcatagaagcattgactggtgccagaacttcaaagaaagaaggaacactgcttaccttaaattttaattgtttacagttgtttgcaaaccttttggcttggtggctcacgcctttaatcccagcactttgggaggctgagacgggcagatcacctgagggtcaggggatcgagaccagtgtggccaacatggtgaaaccccgtctctactaaaatacaaaaaattagcctggcatggtggcgcacgcctgcagtcccagctactgaggaggctgaggcagggggatcgcttgaggcggaggctgcagtgagctgagatcacgccactgcactccagcctgatgacagagcaaagcaagactgcctcttgaaaaaaaaaaaaaaaaaaaaaaagcactgcttaccttaaattataattgtttacgaacctgtttcacacatattatctcatctggcccatgagactggcaggtgagaaaaatgggtattaaattattgtttacatcccactgacaaaaataaacagggtcagctgggtaagggacgtttcccggattcgttaaggggcagaagtgggaccacggtgagttcgtttgtttccaaatccagagcccccccttccctgcccagacccagggctgcccctagaccatgcaggggaatgctaggtgggaaataggacattttgttgaagcccgatgcatgatttagcccaccagtacttgggttctaatattccattgtgtgctaaaaacaatgtacttggatcaaactttaccttatattcatgcaatctcacagttatgtggaaatctagctattatacagaattattagtctacctttagggctccccacagcaacaagcaaactcacagagcccagggcaggaggagctgttctgacttcaggcggccttgccaggagcccgttggcctgggtggagcccgttggcctgggtgtccactgtcagaggatggagattgatctggggttacctttttcagcctttgctttgtttgtcacctgaaggggctggatcctgagccctgtaaggcccccttcggctggtgcacacaagaggacagctttgagcctccaccaaggtctctggattccactttaagtgcgggcttgggtgtgggaagctgcaggccagcctcgagggcagcctcctggaggtggaagggcagcggggcgcgagactgctgcgctggtgggatgcttggattcccaggccccaagtcactatcggggaacgttctttgaggtttaatagtattttaggattttttaaaggatagataatatctagatgttgtgttctaccaaaacaaatattgttcttttggaaatatgttagaccaaaaaaatgcatctagatcttcgagttttgacttggaagtgcctcaagtgagcgagtgcctgctgtctcagacatgaggtggatgctgaagagattacccctgacttcatagtctgcctgtctcagagcgtgggcgggttggcatcgtctgcacgttgaccgggtcgtttttagctttgcccacttttcatttttggcttcacagagtgatgcctctggagcatccccttgcggagcctcagcatctcttctctgcttggcccacgtctagcagttcttcttcatcttgcagggaaagtgtgttggcaaacatgctggatactgtcagaatcagagcaggctggatccatggccgtattctgtaaaattccattgtgtctttttttcccccaagtaatctggctctgggaggaaactcgctgattggagactagctgagagggcttggctgggattctgtgggatggggccttcaggaggtggagccgccccaggccatggagacctggagatgctcagggaagggggtggtcaggccctgggtcccatgttggcagcctccctggcccagcgttgggctgggaccctctgcctctcccagtgagaccaaccctgccctctggacggatggaaggacactggggagccgatgatgcccagagtgtctgggggacgcatccagggtcccaggcccagaaaacagtggagccaagagaggaacgaggtctctggattccggacgccctgctgctacttggcctccaaccaaaaaattgttcttctccttccttttttagtaggggagagaggagcaattttccatggaatatatctgatggcaggtcttgaggtcagtctgtcagaggcctgggagatcaggggacaagggtgaaattcgaatagattgtacgaaggtttgagagctggcatgacccacttttgaccgtaaaacctttcagcttgttcttgacttcccccccatccctaatacccccaactatgcaaatgatagtactaggaataatagtagtagaagtagtaataataattacagaagagcaaatttaagaagctaaggagggaggaaggaggcagtggtaagttctgcatagaaatgatttttgcacagagctttgtcattgggaaggatgcttatcacagggggctgatgaatttgtttccttcttgccttatttttggcagttttctttcttgatggtggggagggtttgtgaccaggtcctagtgaggcagctttctgagcactttttcttgatcactgatgatgaccgtaaacaagctgtgggaacataaggaaaagcagatgtggccactggtgcttggaagagaacacaatgaaattgagtccctagcaggagaagtccctgttaaaatggccagaggacatggggacatggggcagggagagcttcagaatgagcgggaagcctccacaacaggtggagaaaatagcaagggctgctgggcacgatcattcgagattccaagaggtaagaactgggggctgggctgtggaagaagtgcgagagggagtggggaaggcaggctgggcgtgctgtggttataggcagcctacatgtcttgagttttcagtagagaaggcctgctcctcactttgaccccggacctgcatgcgcgctgaggatggcagaggggctcctgcctgtctcagtgctctggggtcccgtgctgagggagcatccttatggtaaacgtccctggttctgtaccggaggaacaggagctctggaggtcttctgtttgctgttgtatgctgtggctcagaagttatgtggccactttcactcccaactcacaggccagaaagtgtagtgggaggctgtgggcatatttggcgcttggcaggattgaaggcgcaactcttggcttcgtgtttcagaggttggtaaatggagtcttgctcgccaggtgcatgaggtgaagtcactgggctgggtgcagggagtgagtggccaaccacctgagaatacctggtgtttccttcctcagggacggtttggcactgggcaacagctccatttagctagggtaggataatggtaaagttgccagcagcaatgcttttcctgcatttgccccaactctgtgcagggccagcacttttagctcctagtcacagatatggtgacaggcttgtctccaccattggagtaagctccagcccagctcctggcttctgatctgtgttgactgctacccgatagagccacagtcatcctgtgtgcctgcttgagtctgcaccgaacatggctctagcttcttcgttggccagacaggatctgctgtatccttatgatacctcgtcatcttggagtccaccgtgcacttgtccgcttgggctgccataacaaaataccagacgctgggtgccttaaaccacagaaatgcattttctcacagttctagaggctggaagtccaagatcagggtgctggcatggttggactctggagagactcttgtcctgacttctagatgtctgccttcttgctatcctcacgtggtgcagagcatgccagctctctgctgtctctttttctaagggtgctaattccatcatgagggccccatccttatgaccttgtccaaccctaattaccttccaaagatcccacctcagataccatcgcattgggggttgagctttaaatacaaatttcaggagagctcaatacagcccatagcacagcgcttccgcacacatccacattgcagacccgccatcctcaaacgcactgtgctcccgtgagctccctgccctggagtggaaaccctgggctggggaggaggtgcgctaagactgggccacaggtgtgctctggttcagaaaactcttgcaggtcctacttcctgccttgacaccaccccctgcccacagccttctcattcttgtcctgtagcccagtttcgtttcacctgtcctctgcctgtaatccttttcagcccctctgaagagcggcccagtaggatggttgactgacgttagcttggctttcttcctaaggcaccgtcttcctcattgaaactgtgcccatgacctccggaagcctgccagccgcctgcctgcaaccccatagccgagtcagctccctggatgggctagtgtgttgaccttccactgccccgaggggaggactctgccctactggatcctccacctctcacttcattttgccagttgaaatgttcccctgcctagtgtagggactgccacttcatgctgtcttgccagagcaccttcccaggcagctgcaaaggtggtcttggtttgactcccttgtggcccacacaacactttcgttggagatgaagagtctccctttcagactgcaagccccttgaggtcaggatgctgcaacgaatataatagaaaatgatgttaatattcaaggtcatggccatcctcaatgcagccttcatattttcataatgaatagttattgtgaaggagctgatttttggaggagtggtttgtctgcagttgcacacatctgtgataacatggggtgggtggttctgattcctgttttgaggtggtgatttatgatgcctgtgtacttccctgtggtgcccaggcctgcagattacagacgctgtgtaattagagaatccctctccacatgtgttctctgaacagggagcccagggaggcttggatctttagattgataagcaggatagtaaaccagttgtgaggaacattgtatagagaaaaaacaaccttgagtttctgttgaaatctagatttggtataactgtcttcatttctttaaagagcattcatcaatgatattaatgattttcatttcctacctttgtagttttcatataaattagatttacataggagacaaagaaatccttccctccctgttccagttgtggaacatatggtcaccgttctgtgactgggagcattgctgtttggcatgcttgtgggcacggtttaagggttgagaccacatcctaggtggcggtcacaaacccggcccagcggcctccctgctaggcagtcctccatcaatactgatgttaataattatgtaaaatcattcctgtccgcagcctagagtctcactggagaacaatcagacatgctttattttctacttgtaatcgtaatctgagtgcaatttcaggactttgttttccagatggcttattgtttcacacgttttcttttctcagtgaagcccaggtaacctgctgcttgggtgtacgctgggcgggttcgcagtgctggaagagagagtggacagattttacaccagcacctttcatctcaggggtgcttgtgaattgattgcacccctcctgtggcgtggaggcggtgcctggttaaagtggggctcagatgccccttggttgcatttaatgtgtgtgcataatcagagggcaaggacagcagtaaataatttatgtcagctggagcccttggccctggtaatgagatctcaggggcagcgcctagagtgctgggcccttccagatgatctatgaattggtctttgcctttgtacttattcaaactgacaaatacttacttaatagctgattgtattcaggtgctaagggaaaagaacgtgactgtgtgggggtctccctgactccttagaacctgcaaatgcatgaaactcatgttaagaacagttgtggttcacgtgtaccaaacttgggaaatcctgaccagcgcatccagggttgcttgggcacagtggtccttttgcatggggtggccggccaggtgtgctgagtgccacctgggcttgcatgccggacgcatacctggcacctgcttccaggttggcctgccagccgatgttgtgatcttgtggagggaatgaccccacgtctctggattctggcttctgcttccagtgagactccgcccaggttatgtttgtggccttttatctctccaatgtgaggcatctctgatgatgcctaaggatgtccttctaatttggagttaacctctctttcccaggtgaggttagcaaatacgtatagattgtaacaagagaattttgcatttcagttttgttttttttttttttttgagatggagctcacgctgtcgcccaggctggatagagtgcagtggtacgatctcggctcagtgtaacctctgcctcctgagtagctgggattacaggcaggcaccaccatgcccagctaatttttgtatttttagtagagactggatttcgccattttggccaggctggtcttgaactcctggcctcaagtcatctgcctgcctcggcttccaaaagtgctgggattacaggcctgtgccactgcacccggccacatttaatattatttacctgagatttttgaggcaagcagccctggggatgtaagcaccttttaatttggcagcttatttgataagcaaatgggttctatcttaaaatccaaagttgtttacacttaatgcatattttgagagctgttacccaaacctttttccttccttcaatgagaagacttatatctttttgagcagaaactgtggattcagaaaccaacagaactcttcattctccttaaggagatagaggccagggaaagtgtttttaggtaaataataacgccttcttgcctctctccctttatctccccattctccctgaaaaaactacaagaaatggtaaggaagagaataaaagaggaaaataaatcacagataactagaaccactttattgctattattccaggtgatctactgataaattaaaagaaagatgaatataagctggtaattactttaaaatattcctttgtgaatgtgcctaattggcgcgggcctccctgtagaatgaggctcctcctgcagttcgaggagaggctgtaattaacagtgaattagcatatagtggcgccgtgtggcccgcagggtggccttgtccatctgctgtgtaggggacttaggtgacacctggctagtggtagtctgcaagaaccctttgttaatgggaatattgtgcatgagtcagaattcagaatctttggtatggttttttttttttcccccttttgtgtgttttggccaaatactcaaaagcactaagttttcttgcgtggtatctgttcatatattgattcaccaaatattgattgtacatctgcgaatgtgctagataccctactggtgctggtgagcagaaacaggcaaggtctttggcctcagggggtccttggagtctagaagggatggtgacattggccagagtcaccccataatcatacagttagcagtgtggccagcgtcacttaaagcggggaggtggctggtgctggagcgtgtataacaaaagtgggatccggaaagggctgctggcgagtgggagttttctagggagccgctgctcttgcttcaggtctcagatggcataggagtgtgtgtcatcccagaggagcagcagcaaacggcctgtgatgggctggatgtatttggggagggaagaaggcagttgtagctcaagggagagaaaaggcaaggagaaacatggcgaggggtgggggctttgctctttagcccgtgagcagtggaaagtcattgaatgctgtctggtgtaaaatctgttagcagtttcacttccatctggagcacccaggcctgcaggagtgtgggttggctctctacccccgttgcagattggcttgtggtttggggtgtgccaggctcaggggcagggccctttttccacacgcttagggaagatacgagactggctaactcagtattcaccgtgaattcttttgtgggaaatagaacacagcgttgggtaccaagagggtgctgtcttttcctgttttcttggcctcctagggaatcagtttgattctgtggctattaaattaatggtttagctgagatgttttctctactcagggcccaatgccgtatgtgatattttacaacaaatttggttcactggggccgacttgaaaatagtcaaagtccaagtaaacttctgcctgtgtgtggtgcgctcaaataaaggaggctgttcaaggtgagtggttttcctggcggtgtggttttttaaaatttctaataaaatgcaaatgattacagccccttccatgaagagtgcaagtacgcctgactcctccgcgcagggaatgagcagcctctgctccttcatttgattgctatgacaacccacagaggtgggtgttgtcacttccactgccagccagcttgcacggtccagggacgtccccaccctcggttgggttgtccagggtcacatggttgggagtcagaaccagacttcaaagggcatgtgactacagcatccatcctccctgctctgcctcgcactgccttctaatgggtcccactgaggagcttgccagtattgttacaattggagtgatctcatatgaccaaaagttggaatgatcccattctttactcacagcctgagctattttttttcaaagcattatctctctactgtttgtaggcagagaatttattaaatcttgcctaaatttatccgtaagcatggatcaaatgcacatttggcatgattctcatctctgagccattgcaacctattttttaatgccaagagaaagtattttaaggaagtggggtcagctttcctctgctcccctgacttcacaggatagctatgcattttgcctcttggggagctgggttattgtgaaactaggtcaaattattgttttttctctttatgctcatagccattccaaagacagaatcctttcctcaaaaaatgaatttttgagtgttcctatattcttggggatgaacttcaagggcagaaaataaatgaaaggggattactttgacagcatctgaacaacagaacaccttctgaacagcacaaacacttgtagcaaaattaaaagaccaacaaaaatatgtattacatatagagcattgtcttctatatgtaaagagttcttataaaacaataagaaaaatatttcctaactaaaggaaatggacacaaaattcataaaagaagaaacaaaggagcaattaagatataaatatatttggctttgttgattaaagagtaacaattaaaatgacaggtgacttctgggccggatgcagtggctcaagcctgtaatcctagcactttgggaggtagaggcaggcatatcacaaggtgaagagatcaagaccatcctggccaacatggtgaaaccctatctctactaaaaatacagaaattagctgggtgtggtgacgtgcacctgtagtcccagctactggggaggctgaggcaggagaatcacttgaacccaggaggcggaggttgcagtgagccaagagtgcgccactctactccagcctggtgacagagtgagactccatctcaaaaaaaaaaaaaaggtgacctctttcttttcatctggttaagttcagtgttaaaaacaaaggcccagtgttggtgaaggtgatggaaaatagttccccttttacattttagtgggaaaaatgtaaattgagatagccatctggagagaaatttgtcaaacagtaataaaaaccctaacaatgtatttgacctctgacctggcaatttcatttctgcctatcttcttttaaccctagattgattaaactcgttaaataaaacacatttgtgggtatagaaaacttcataggtttctggcttcctgccccacctgtggtttcattctgcccagttgtgttcaacttgaaaacgcttggtgcctagcacagagtagacccttaataaatgtttctgtcctgaacagatttaaaaacaaatagtgaaaacaaaattctgaacgtatgattttaaaaatcattttgtagcctaacacttaggaaacgtacttttttgttgcttcgctgaagtgaggaggggtgtatcttgtaatttttaaatgccattattaacttccctagggatgcttgtaaaatgaacaaacgtgcatctttaaattttttttattttttttttttaagcttggaaagagttgaaaagtcaaagtcacatcagctctctagggattgggctgggctcacattttatgaatttgctgtaaagaagggaaacatttgctttcacttttggcatgctgaagtggctttaccagggaattgtgactttaattttaagaattaatcgtaatgtagggggaaaaatgttcttaaaacacaaaacaaacatgtgtgaatagatgaggaacagcagttaaaataataactttcaaaaactaggttaaaatgtccagagaattagattttgttaatgttcaaagcacagctaagttactttttctacaaacaattcttgaaaacgtttttgatttttaagaggaaattagaatagtggttgaaatcatgaggccccaaatcagcagtgtgcttgctgttaattttgttgttgtaaagaacatttgtttttggccaggtgcggtggctcacacctgtaatccgagcactttgggaggccaaggtgggtggatcacctgaggtcaggagttccagactagcctggccaacatggtgaaactctgtctctactaaaaatacaaaaattagccaagtatgttggtgggcacctgtaatcccagctactcaggaggccgaggcaggagaatcgcttgaacctgggaggcggaggttgcagtgagccgagatcccgccactgcactccagccttggcgacagactgagattccatctcaaacaaacaaaagaacatttgtttttgagttataatctctgtttctgcggcctggctaatagtttggatagaaacatgtcttgcatacatgagtatttgttttttgtttttaaaaacactccaaattcagatttcttttattaagtaagtggatgcagtgcatagttttgggatatgcatgcatgcacttttgaatttaaatacatactaagatggcagttgggggacctgagtctcccttgtggtgctgtgggtttgtaggggccggcgagttaactgaactgagttgagtagctcacatctcgtggagcatcaaccaagaggatgcaacttgtgtaactgtgagaagctcagacttggaagatctgcgtctgtatgtgatcgcacacattttggagggtgggatgtgctcggtcttgggcgcgtgcagtttttgctcccttttactgttactgcgttgatgatgtgtaacccatgatatccatgagttactgtgatttctttgtttattttgactcagagctccaaatacatgggatgctagcaatttctgtgttatcattactaaaccacaagagctggaaaattccagtaggtttttgtaggtgatttttcgggagcagttggttttccttggccttcatcctactctacagagtgaatgtgactaggttctgttgtcatggggcacctggtctatcttgcaagttgaagcccctatctgtccagtttaattgacctcctgcaggtctggtctttcttagtttttttctaaccttcactttctggtagacccatttcacattagtgcaaaaattttcagtctcaattcaggcataaagcttcaagttaaggatttatagatgaaaaggctttagttattttatctttttattaaggtccatttttaagcttatatttaaataatgtaccataaaagcttaaaattacaagacttaaaattttaatagtggctgttaataattattattactgagctcttgttatgtggtatgtataatcttatttaaccctcaaaacaaaagcagaaatcaaaacctgggtgggtagatgtggtagacgtaataacggcccccaaagatgtcccaagtcctaatccctgaaacctgtgaatgtgtgaccttctgttggcaaaagaaattaagttaaggaccttgcgttgggagattattctgggctatctgggtggatctgtcataatcacaggggtctctataaaaggaggcagtaagaatgatcttttgggtcagagtcacagaaggagatgtgaatatgaaagcagaggctggagtgatggagccatgagccaaggaatgggggagagcgctaggagccggaaaaggcaaggaaatggactctaccccagaacctccaggatcacagccctaagtcaccttgattttagcccatgtcgattttagaccttggatgtaaggtaagaaatgtgtgttgtgtcaagcaagccaccaagtttgtggtttgttacagtggtaatagggaactcacgcagtaaggacagggcgatccccactttaccatgaaggaaaccaacactcagagaagttgaatgatttgcccgagttcacatcatgaagtgggggagctgggattcaaacctggggctgaagtgggggagctgggattcaatcctggggctgaagtgggggagctgggattcaatcctggggctgaagtaggggagctgggattcaatcctggggctgaagtgggggagctgggattcaaacctggggctgaagtaggggagctgggattcaatcctggggctgaagtgggggagctgggattcaaacctggggctgaagtgggggagctggtcaatcctggggctgctggagcctaggatctagagtgcagtctctggcctggaggagagaagaggctccctgcagatgcagctcttttccccatgtccacccctttaatttcatgagcatcctgggctggctgcactagaaggggacaagattgccaagaggcggccagctgctggagatcagcaacaccagcttcggcgcccgaattgctgcacattgtcccagcagctcaagtgtctacctcctctgatagcacaggtgtctgggcaattctgcattgcaacaagggccctgttctacttttttctgcaaggtttgtccagagtgcgcagccagactatatgctgggcttggttttcctgagccttggccactgctggcgccccgatcccgggccagttgttcttggtggcatggctgtcccaaggagacacatgttactgtctctgtagctgcctgtgcctccaggtgtggtgctgccttcctgggcctctgcagcacctgccctcggcccccagggaccttctttgtcacagctgaagccctcgcatgctggagacttgtcattcttctcctgccgggcatggatgctgacaatagaactactttccagaaatcagcaaatgctgggctgtgccttcaaagtatatccaggatgcagtggcttcctgagccacctcagccattagcaccctggtcccgggcagcagcgttgcttggcggattactgctcacctcttcaagccgatgctgctactctcctggacagtccacttgcccagcagccaggggcatccctgagaagccgggtcagagtgtgatgccctctgccaaaacctcctcctggccctcgccttctgccactctccccttgctcatggctctgctgatccttcaaccaaatgcatgctcctgacccttacatgtctgcactgcttcctctttttggaaaaccttcctgggggcccttgcagcttggccctcgcatccttcagcctcacctccagtgtcattgaggaccctccgtggcacctggccttcctcccagccacagcccctcctcctcacctcctcacctgcttcctatttccccataaaccccagctccctgacatgtctggtgtctctctctccccactggatggaatataagggcttgtgtttgccgtttccccagcacctagacaggacctagccaatgctaggccctttgtcgatgttcgttaggcatgcaggtgaacaagtgaatgagtgatcctgagtttgctctggtttccttctagttgtgggaagtaattcctgaattgcagccctacagcttttattggtgacaagttcttgactccccatcacctctgatggagggggctggggtctgttgtgagttcaggagccagggggctgcatctgcgtgttggctctgctgctgaagtggctggatggccttggagatctagttaatttttttcctttttttggagacccagtctcgctcttgtctcccaggctggagtacaatggcacaatcttggctcactgcaaactccacctcctaggttcaagcaattctcctgccttggcctccggaggagctgagactacaggcgcccgccaccacacccggctattttttgtatttttagtacagatagggattcaccgtgttggccagggtggtcttgaactcctgacctctggtgatccgcccacctcggcctcccaaagtgctaggattacaggtgtgagccaccacgcccagccgatctatttaatttcattgtgccttggtttcttcatatgtttcaataaaatgggtatgttaacagtctctacctcccagagtggttggggttacgtgaagtaagcttagacacggccgaatgagccagagcctctgctgctgccattggcgttggcaccattcttacctcctatacctacgaggctgtcatgtgaatgtgtcaagggccctgtcacgtctctgagccggcttctctgggcactggctgggctgaccccaatggcccctgcccatcatgcatttaggggctcctctgactccagatgtcagtgacccttctggtctctccaacacaagggttggtcattccctgtgcccattgttcatgcattggaacttggagtgcctgctctctgccctgggtttatgtcctaaggatttgaagatagaagaggcacagcagtcacttgggagctattcccagtctaacaggagagggcacatggcagtaaccccctgggagcggctgctgatgttctggctctctgcagttgggtaggagtggaggaggggtgcgatcggaagggagtgccgcgcagacccccccaccccctcagaacagcggccactgtgtggatgtttctgacggcctcttacagactctgtcctttttgttgtagctgatggagcagaattttaaatgcattcctctaactagtggtcagcttgctactgtccaacctaagctcatattcaacactttagaatgccttaatcttttcttgttgtgttttgaataggttacatgcagacatccaaaataaacttttttttttctgtacaaaattagatttagctaaagtagcttaggttttataaaagctgatgttcttcatgctcttcccaattttgggaaaggagccttcgtctttgcttcctaggaatggtcatagtcacaccagccctcctgctggctttgtagaatgctcacagtggaatagactgtcagcaggtcctgagatgtgactctggacagccagtggtctgtagcattctcatccttcagagctccctgagcttcttcacggccacgctgctctcctgcatgtccgcccatctcactggggtgatgaatggatctagacctggtgcctggactcaatctgcagagacaggtgtctgggatctgaagacagcagttggggaggacagtgttggctgctgctgtgcttcctttaactgaaccccggtggcccagttgctcctcttggtggactcactaagtcaactttgacgcttcagccaacgtcggttttgagaatgcgacctatgaaattgggagccctggctggatcagaagcacatggttcagtggacactgtcagaggtgctgtggatcacttggaccacggtagctaatgtttgtagcgcgctcacgtatgccagactcttcttagcgctaagccattttcccaggccgggttatgcagtgagacttcagggcaggcacacatgtcgcttcctgcacccacactggacagtcattgtagaaagtaagatgtgatgttaatagtctcttcttggagtcagcactgcttcacggtcctattggcatgagaaccacgtccccagctattcccacctgcacactggagggaagcaggaggggaacaaagtcaacagcaatgactgtcgctgaatcttaagtttattctggattgagaaaagtggaagaggttagaagctaacttggacattctttttgggggaatagatgtctctcatgcagctcattttccagtggattgcctgatgttctccaggctgctacagctatgatattttaaaatcaatgggcctttcctttcatttcgaactttcaatacagctgcagaaacaatgcatctgaacggatggactgttttggagatttatgcgtgttctgcaggctgacctctgcttgttgatcgtattacagcatgttgggcatgtcaaatgaatctgggcgttagcctacaaatcaagatttgctttgcctcgttgtgtaaatatcggcaaaccatgttttggggatggaaaattagttaatttggagatggtgggttattagacttcacttggtctgcacgtggtggctttgggatttgctgcttcaaggtttcaggatgacacaagccatcgggttgagtgtgtttgtttcagcccctcttgctgagcacttctctcttcctgttcctgtgctgctgggccttcacagcatggtgctcccaagctagttgctgaagctgtgggccattgagccagcctggagatgcatggtaggttagggtgctgtgttgcaggtctgtgatgcagttgccatatattttttgacttttggatcttcactcctcccctcattttggacattttctcagaatgaatgatacatctctgctttcagcctccctaagccattaatttacatgtcagatttttttgagtattgtagtttttttcaatatttatggaatgcttagtatttgtaatgcaacaaaaggtcagaattaataaggtgtagtgcccaagaggaatattttgtttccattttcaagatgattccaatttgagctgtctcctggagaagttggatccatttgtgtttctgagtgtgcttgtaagcagtcttaggggatctgtcactgcttactactaacagaagaacaccaaaataaggccaacctgctcccaggctgaatccaggagagccagtggccaaatatcagctctgcagccaccgttgcaagtgagactttgtgaaaggaaacttctcaccattaaatgtacattttatcttaaccgttgaatgtacaggatggttcaaatactaaaaactggagaaaagaccatgatggatgtcatttctccctgatgggacattttaccatatttgctttctctgtatgttgtgcgtgttggtgtttatggaagaaacacctacagatacagtggaagtccccttgcccccttctctgttctgttgaagatggtctgtctttcccatctggatctctttcctccgctacttctgtgtccttagacagtagatggtgctctgtgtgcatgaggggaagcacctacagtggtcgcctgctgaagatgtccttcagtggttggaatggaaaaacaattgttctgctacatgttgctctggttctttcattttacctgctctagaatattccatttagaacttaaaatatttcattacttaaatattgctttttctgttctgtgtgctgtaaagtgtatgtgcgtgtgtgctggcattgtaatgtttgtgcttgtggggaggatggaggagattctgattttgccaggggtctcagctacagcccctcagatcattgcaggtgatagggtttggaagtttgtccccttcaaatctcttgtggaaatgtgattcccagtgttggaagtggggcatggtgggaggtgattggatcatgggggcagatccctcatgaatggttcagcaccatccccttggtgatgagcgagttcttgctcagttagttcatgcaaattcaatttaaaggagtatgccccttccccactccccgacccctctactcatgctcttgccatgtgatgtcctgctcctccttcaccttctgccatgattggaagcttcctgaggcctcaccaaaacagatgctgatgccatgctttctatacactctgcagaaccgtgtgccaattaaacttcttttattaattacccagcctcagatattcctttagagtaatgcaagaatggactaacacagcaggtgtgatcattggatgaggaaggctctcggaatcattccaggtgcctgctctagactcttggtgttgctcttctttccttcatgaccttgaactctctgactccagcagtcccctctgcacatgcctgaactgcttcagggcaccctacaggtcactcaggcctccaactctggggtgatgcctttagcagcattgagtataaggtgacctggaggaggtgtgaagacctgcgcatgtggacagtttgaaagcctagctgaggcagctggaagaaattcatgggagtcctgcatcgctgaggtcaggggaggttctgtaaatctgggagaaaggtgcctttcctttggagggatggtgggtttcaatggtttgaaagagaaaaccatgctttgcatgtgtctttttaccaacccaatgagattgctgattttgcaagtacaagtcaccagattttagttgtttataaacttcagcttaaaaggtggggttaatagggaacaacataaatgagggcaggtgtgtgtttcagggatctttgtgcaacttttctaaatacagagttggttgtgacatattcagctgggggaaaatagtcgtctgaaatatattatggtttgtttgtagcttcagctagtacttttcattgtaatcatggctcaggtttctaagagaaaattaaaataatttaggatgttgccccacactattgggaggtgtagatgttgctactgcatctggaaagcattgtgacaacatgtgaccaagtattaaaaatgttctcacatttattcttgaaattccacacagagaaaggtgtttcggggaagtagaatattagcagagctatttgtaaaaataatgcacaggcatttgctgctgtatcctatgagcgaaaaattgggaagtgtgatatctgtgtctgcctccatactgtacagaaatcactgaatataggccagtgcggtggctcatgcctgtaatcccagcactttgggaggccgaggcaggtggatcacttgaggtcagcagtctagaccagcctggccaacatgacgaaaccccatctctactaaaaatacaaaaaaaaaaaaaaattagccggttatggtggtgcatacctgtaatcccagctacgcaggaggctgaggcaggagaatagtttgaacccgagaggcagaggttgcagtgagccaagatcacgccactgtactccagcctgggcgacagagtgagactgtctcaagccaaaaacgaactgaatatggctgacactctctccctcataagcttgcttgttccattaatggggagacccatgtaaggtctgggtgcagtgcatggcacatgggaagtgtgtgtgacagttaatggtggcgttttttaaaagtacatatgtctatagcagtctggaaaggcatacgccagaatgtttgtggcagtgacagtggattttataagtgatttttttccctttacattttttcttaaatatgcatttctcttttcctcaatgaacacgctaattatgtgaacagttatttaagaagaagtaacctgagtaatactaaaaatgtattttctgaggggcgaaagtatagttgaagtaaaaagttttagtgcactttccagaatgggctggatggtgactattttaggttttgaggatggtaccgtctctggcaactcctcaactcttgtagggagaggtacagacacaaattggcatggcgtgtttcaataaaactttatttacaaaaacacatggtgggctggatttggcctgtggcccatggcctgatctctgttctaatatgtcccattaaggacttttgtttttgaaatccactgatagtgggtcattccagcgcatagatatgttgggtttattttcactgttcacataacgtaagtttgaaacccaactgtcttaagttgaaaagtaagacatagcgtggatattgttttgttctttaattttacactgcagaatccttttaagaaaacaattcagtctatcttataaaggggagtggcattgtcccctgcttttcctgtgctggccccaggctgttttgaggttttttttttttttttttttttttgatagggtctctgttgcccaggctggagtgcagtggcgcgatcttggttcacttcaacctccacctcccgggtttaagcaattctgcaacctctacctcccgagtttaagcaattctcctgcctcggcctcctgagtagctgggatcacaggtgtgcaccaccacacccagctaatttttgtattcttagtagagacaggatttcgtcatgttggccctgctggtctcgaactcctgatctcaagtgatccgtccaccttggcctcccaaggtgctgggattacaggcgtgagccacggcgcccggctattttgagttctttatgttgggcatgctgatcccccagcctcagcgtctgatcgtcttggtaccaagtccactgcccgtggggcttattttgtggtgtgaggtgaagcagcagcatctgttgattttggggtctgtgtcccccagattgcccaggatagtaatagtaaaatgcctcgtccccggctcagcccttagtctcccattgcaatactcctgtttgagattattcacagttggggctcatgtctattgctgagaaagagaaatggtttttcttggtgatttttctcagtgctttgaatgttatttttgagttctggccaaacagagatgggacaaggtcagaactagaaaaatatgtcctataatcttctcaatgggagggaggaagaggttcccttaggagcatgaacttaggaaaggaaatggtgcgtttggtggaaaagaaggggggcataggctgaattgggacagtgcccttgactgacacagggagagggtctgagccccccatgcacttactgggcaggcttccccccgaagcaaggtggacctgcttccagtgggaggagaagggggagcactagagccctccgtgagaccattgactgcactggggtagttcagtggtgagcggatggggagaaggcagggccagcccccagcacacgtcaggcactgtctgggcacctgtgcattgctgcctacagtcctttcagagactcggcaactcagcgagagtccctcacttgcctgtgagctgctccacttggtggaggagctgctggggcagaggatactgagcctgaccactgccctgtgcttgttcctgtccccatggaggagcactggacttgtccaggggcacctagcagggatccagggacccaggcagggccggaaaggggatgttctttgcatggatttctgggaatgtacttggcagaagggaagcctgggagtgagctccaggcagaagaacaagcaggtggaagtgcccggttctggaagagcccagggtatctttgggggaagatggagacaagatttggtgggtccttgaatgctctggaaagaagggggagccattgcccacctcttttttttttccataggttattggggaacaggtggtgtttggttacatgaataagttctttagtgatgacttgtagagattctggtgcacccatcacccaagcagtgtacactgcaccctatttgtagtcttttatcccctgcttcccctcccatccttccccccaagtccccgaagtccatgtatcattctttttttgtttgtttgtttgttttttgactccgttacccaggctggagtgcagtgctgtgatcttggctcactgcaacctctgcctctcgggttcaagcaattctcctgccttagcctcccgagtagctgggattacaggcgcctgccaccacatccggctaatttttgtatttttagtagagacggggtttcaccatattggccaggctggtctcaaactcctgacctcatgatccagccgccttggcctcccaaagtgctgggattataggtgtgagccattgtatcattcttatgcctttgtgtcctcataccttagctcccacctatccgtgagaacaacaatgtttggttttccattcctgagttactcagaataatcgtctccaatctcatccaggtcactgcaaatgccgttaattcattccttcttaaggctgagtagtagtcattgtgtgtgtgtgtgtgtgtgtgtgtgtgtgtgtgtgtgtgtgtgtgtgtgtatgtgtatacaccacagtttctttatccacttgttgattgatgccactgcccatctcttgagatgcaacaggatcagacttgttggggagcaaggaggaaagtgggtggtgggaggctctggccctagtcagacaccgtagaccaagaaaaggagaacaggacagagacatgaaaatcagcaggtgagtatcgagtgtccagcacaggggccaggtgtccagcatggggacttcatgaggtattttaagagtaagaagtcattgaggggccgggcgcagtggctcatacctgtaatcccagcactttggaaggccagggcagggggattgcttgagcccaagagtttaagaccagccctggcaacatagtaagaccctatctctacaataaatgtaaaaaaaaaaaaaaatagctggacgtggtggcgtgtacttgtagtcccagcccctctggaggatcccttgagccaggaggtcaagactgcagtgagccatgatcatactactgcactccagcctgggtgactgagggagaccctgtctcaaaaaaaaaaaaaaaaaaaagaaagaacagaaatcaccattgataatgtggcatgaatagacttcatgacagacattactccagagatttttatgatgctttattaattaaagtatcatcttcaaagcagatgttaaccacttcatcactgtatacaaaatgtctgattacatttaatttttttttccagcaggatggaaatgcattaagatgaaactttaaaaatataggactgtagaaagattttgtgccaaattaaacatatactgaaacaaataagttgttttttgaaaacccagggagctatcacacgattgttaatattttagtggaattcctcctaaacgtctttctgtacttttttttttgagacaaagtcttgctctgttgcccaggctggagtgcaatggcactatctcagctcactgcaacctctgcttcccgggttcatccaattctgcctcaacctcccgagtagttgggattacaggtgtgcaccaccaagcccagctaatttttgtatttttaatagagacagggtttcaccatgttgatcaggctggtctcgaactcctgacctcaggtgatccacctgcctcggcctcccaaagtgctgggattacaggcgtgagccaccatgcccggcccctgtacattgtttttttaaagatgtttgagatagggtttgtagccttattaacacattagcatttttccgtgtcgtgttgtaatattgcacatccatgttactggtaagctgtatttgagaaagaattagggggttagtttggggagcagcagctgatgtgtgcctcagttctcaagttaattggtcctgctccttctctgccctggtgtgcccctcggctcgccactggcttaggtgcaggtacatttgtccttcatcggaacaggaccaccctcccttggctgccaccatggcaacgctcagccccgctgcctccgtttgtcatttctcctcctaatgatttgaactgaggtctgtgtgctggcccagcccgttgcgggtctgcataatgtatgaacacgagtgacagccagccgcagcccgatcaaaacaaagagccgctgcacgagaggggcagattgcggaagcatattgtgaacacattctctggtaactgtgaatcgtgtcgtaaaacgcgtctttggcctgtcaaaaatattttgacagggcccacagtctagctccttcatatgcaaatgcactggtaatgcctggataccagggttacacactcagggaaaatccacaggacgagggctgatgttagcagggttcattacttctgcaaataaacacgttgaagagcctccttccagtgggtaaatggcaaactcgataactggaatgctgtcagatcccagggtaacaaaagggtggtgtcccctaaaggcttggaaggattgagttaggagagttcaactgaaaagtcaagcatggcgcaaggaaggacgatggattagccaaccatgaccggccaggctgtgcgagctagccaaggagaggccacgaggcgggagagccaaggaggacagcctccgggtgggccatcactgctggtagagagggtttctgggtcccaggaccggactgcgtggtcctggttatacctgctggtcaaaggtcagtctgccaaggcccctccttgtgaagatggacactgagggcacccttcctagaggacctatttcctcttggtgctcttctgctttttgcttcttccctgggcttgctttccgtgtgattctgggcaagttggttaacctctctgtgcttaggtgaccttcgatggcacgggggatagcagtatctgcttcacatggtcagaaaattctgtgaggtgacacacggagccttggagctgcctgtggcaggtggcggtgctaattaagttccggctgttgtgacggtctcctcggctgggtggcccttcctgctgtcaggtgtggccactctcgtgagatgcaactggaggtgttttgtggcagcttctggaaggcctgcctttgacccttcctttctgctttttccatctgttacctgcatgcatatatgatggctggccaccatctgagactgggacagcaagggtcatgttggcattggaaggggtctgggtttatggggtcaccagcctcaagggacagcccacctggagattttgttaaggggtaagagaaatattcttctgtcttgtataagccactgttatttggggttttcagacatatgtggccaagtgattctaattagcatacaaggtgagaatgtgttatctgcaagatccagagcttagccgccctggcagttcagtgacttaaggggagttaatgaactggttttctgacttcatctcccaccaccagagcagtgttcgcatgaactgcccagccagctgtccccaggagctaaagaagtcagtttctgagcttcagagcctttggctatcctcggggtgcctcagagtagtgagggcagctctgggggactgggacctctcagcctcccctctgcctgtgtgttcctccatggagcccctgtttcgccacgtccattacgcttgcagtagtcagcaactgcctggtgagctttacatgcctgatgggctttggtgagctggcaagtctgaaacacacctggggtcatctgtgaccatctgctgatggccaagtttgatagggtttatttttcctttctttgctgaaatcgggctggggtcttggcagcaattgggaaactttgattgcttcagttgcttcagtttttctagctccacctggcctccctctggggaccacggttctgtcacctctcctgctatttaggtggccgtgtttcccatgctaaacagtgcccgctgatttaatcaagagacttgatagccggccattgcacgttcatcagcccggttttcctcttgtggcacctggtggtgtgctggtgtgtggtttataaaacatgctctgccgctttgatttccctgcttagatttacataattgttttagaagaaggttcaggtgctttgctggcagaaaaaggaagacgacctcttgcaaagtggggttagccctagccttgcaggaaggggtctcggcttccttccaaaccagaagcccgtggtgcagcctctgaacccccgactcttggtgggcttttgagttctgcttttgcttgaacttctagcggcagaaagggggtgatccctttcttctccatcataagggtcatggcccacatccctgtaacaaaagacaggttaacgagagaaaagcattatacatttacttgatcctggttttacggcatgcgggagcctacggaatgaagacccgaagattcaggggaggtcgtctgtgtgccttggttccatgacttgggggcagccaagtagaagtggaattggacaaatagggcatgagcgggccgggcgtggtggctcatgcctgtaatcctagcactttgggaggccaaggtgggtggatcacctgaggtcaggagttcaagaccagtctggtcaacatggtgaaaccccatctctactaaaaatacaaaaattagccaggcatggtggcgggctcctgtaattccagctactcgggggctaaagcaggagaatccctcgaacccaggaggaggaggttgcagtgagtcaagatcgcaccattgcactccagcctgggtgacaagagcaagactctgtcttaaaaataaaagagcttgagtgaattgtcatagatggagtggggagacctacaaggcctgtctgttcagattcctcttggcctctgtgtaacatttcttcctctcgggtatgggatgggacccctctggaatgagggtcttaattaccttatgacagctttacctaaaaagatgggggaaggttacagtaatatttttaggcttatggctagctttggggaaaaggggttttggtttctatgacctgtcttagggatgaagaattctagttcctgtggctcaggggagaatgaggggcaagagatcaggagagcaggagaagctcagagagaaacttggctgcatctgagggtggcctttactttggggtatcagttttccgagccccagcaagcccctccctgcaaagttgcagcccccagcaagccccccgccgcagagttgcagcctggtgccctgattttctaaagatcttgggtgggcggggcccacaggcatgggggaagcggtagctgaggctttacggcaagttgtggggcttctcacttgattttcccacaattaatcttgtctgtctcctgaatttcttcaagtcctgatgataaattatggcatatattccagaatacatgtttgagtttgcattggtgcattgctagaggaaagcacccagttcactgtgtatctctgtgtacctgtgtatttcatcgacacatcctttggagtcttaaacacagcagcagcactgttgtggtgataattacgcaccctgcatatggtactgtttaagcaacaaagagctgagacttcggaaggttcccaagggcatccctgagatgggactcggtcctgtcacaagcagctgtgggagctggagcttagaagctgtccatcaaaaaaccaagtttttgtgtcaaaatggagtctctcaggctgtgaagcaagcccatctctaatcagttcagccacctgtattgcagactaattgtgaccaagacactgcgaatcatcagagaaagctgagccttgtagggaatctggggacagccgtaagttcttcctccacattccattttagagaggcttgtgttccacatttttgtggctttttcctcatcagatttctctgtgttcttgctttagtttgaaactgagaacactaattttttttattttgatcaaaataaaaccatcttttcaaaatgtcaaaatgtttaattttcagagagaattgagtttacgtaccacgaaggaggctctgttttgttccggcacacgctttggctggttattggtgttaggatgtgtttgttccatgtacgagtggatggagcagacagtgcctggtccacccccacctcctcaccctcagcctcccccccgctgtagacagtggccaaccgtgtgtcctcagatctgcatggaatttcctgtggcgctttctcaattctgggaccagttttccctctgaagcgtgaatgtttcctctccagttgggaatctcctgcctcaggacctggtggtctagaggtactgtggtataagtagaaagagcagctggacttagagacaggcgtcctgagtgttgatgccagccttaccctgaccctgtgtgtggcagcagtgggtcggtcaaacctttccaagcctccgtgtcctcatctgaaaatgggaatgaggatgcctatccgaggtgacttagcagaggatgaagcactcccgtgagtgagctgcgcacagtctccttgtacaagcaggacatttctccgtttctccttttctctgcccgtaggattgactttcatcttgcctggtaataagccctcctaggaaaacaaattactctgaaaatttgtcattttggtgtggtgaattcgttcttttattcatcatccaaaaagttccattgtttgagatgattcaacatgatttggaaaccatggggtaagtctctgaggaacaagaagacagaagaaagaacgcactttggttttcttttggaaacctagagcaacctactagatcaatgagttttctagggaggcatcagagttagccatggcaccttctccaaagctgcctcgctcctgcactgatgctgtgctatgaggagccacgttgcccggaagtctgatgcgtgaggcgggaaggttaaaacttgttggctttggaggtttactgataggtcgttctgagtaggacaaatgttttcctttccgtgctttaaaagtctcatcttagaccgggcacagtgactcatgcctgtaatcccagcactttgggaggctgaggcaggtggatcttgaggtcaggagttcaacaccagcctggccaacatggtgaaaccccgtctctactaaaactacaaaaatgagctgggcatgggggtgcatgcctgtaatcccagctacttgggaggctgaggcaggagaatagcttgaacccggaaggtggaggttgcagtgagccgagatcgtgccagtgaactccagcctgggcaacaagagcgagactctgtctcagtaaataaataaataaataaataaataaataaataaataaagtctcatcttatggagcaaaagattctaaagagaaaggctggtcctgaatttcatccagcttggttctggtttcttctcctttcttcagcgagtgcagggcctttatccttggggcacctttctgggactttatctggctgtgtgcagacagacaggaaagtgtcccctgcccccaatttttgggatgaccactaaaaaatgaacacacccactcagggagcgtttgtgggatcactgaagtcaaataatttacacccaggagaaagcccttcgctgtggatgtgttcatgcctgtggaaagggaagttggctatctggtctcgaaccctcagtcactgtcagggacggcagagaactcatccagaaaccaagtgttgatgtgaagcctccccttccagaggccccccagcgtccactcccctaggcatccctcacttctggaccctccacatcagcatcccatgacattgggctagactcactgttccaggactccgctggcccagaggtgagtcggcctgaccaagtcgtcgtgtcatcacttgttgggggttgaagtcctaacgcccggtgcctatgaatgtgatcgtctctcagaatggaaataaggtcgtcgcagatgtaattatttaggatgaggtcatgccagagtggggtgggcccctcatctaatatgatggatgtccttctgagaagggaaatttggacgcagatgcacagagggagaacatcatgtcaaggctgcggtaatgcttctacaagccaaaaagaatgccaaggataaccagacagccgccagaagccaggacagaggctcgcagcagaccctccctcaccgcccctaaaggaacccgccctgctgacgctttgatcttggacttctggcctccagaactgtgagacaatgtatgtctgtttctgaagccactcagattgtggcactttgttagagcagccccaggaaactaaaacgtcacctgactcactgtgggattcagcatcttgtacgaggcaggtgccactggtctcagtttctttgtctgtaaaatgaggctaagacctgctttatacagtggtagtgacagtttgcccagcacctcctaggacctcaaaatgtgactttttttaaaagacagagccttactctgtcacccaggctgggctggagtacagtggcgcggtcatagctcactgcagcctcgacctcctgggttcaagtgatccttccacctcagccccgcaagtgactaggaccacaggtgcatgccaccatgcctagctaattgtattattatttttttttttttgtagagacagggtctcactatgttgccaggttggtcttgaactcctggactcaagctatcctcctgcctcagcctcctgagtagctgggattacaggtatgagccaccgtgctcggccttcattattatttttaggacaaaagtgaaggtggaaagttcggaccagtgggctgtatgtttcagaactttacacataggaagaggaagtattgtgtatggaagaaagtgagtgttgcattattcagggttctcagagaagcagaaccatatggaagaggaggtctgttaggggaattggttcgtgagattatggaggtccagaagcctcatgatctgtctgcacactggagaactgggaagactggtggcatccttcagcccgagaaccaggagctctgatgtccgagtgcaggaagagacagatgttccagctccaacagagagagtgagtttgcccttcctccacctttttgccctctttgggtcctcagtggattgggtgatgccctctgcatgggtgaggcagattatctttactcgttctactgatcgagctgttatctcttccaggaacaccctcatagacacacccacaaataatatcttaccggctgttggggcgttccttggcccagtgaaatgcccagtcaaactgacacgtaacattaaccataacaggtgtgggtagacagtcaggagagcaagactctagttggttctgtcacacagcagagctgcgtggcctgggtatactcctcccatctgcctgggctgctgtatcctgggctataaggtaggaggttcgatcagattaccctgagatgtgctgtgagaggtgagtgtggccccctcacagttgcagctcttcgaacgggagcctggagactccaggcctatgtcttgggaggtgcactgcacagggtggctgctctgtaaaccttgactgaagtcgtggggaaaactgcagtgtgctccaagaacaaattgtgaatagagactagttaaaataaacatcacaatggcgatggaaaatgttatttcactttattaagttaaaaacaagttataaaatagtaggtcacatataagctcagttttgtatttaaaaaccctcaaaactgtatatatgcccagaaaaaagacaggaaagaaagataccacagtatgaatggtggttcccaattagtaggagaactaggagccatcattgtctttgctttccagagaataatagcgtggtgtcctggagtcacatggctgctctggcttgccagtggagaacaggctgaggccggaggaggagggagcagccaggaagctggttacaacccaggcggagggctggcgtgggcctcaggggtcttcagcctcagcactattgacattttgtgccggataattatttgtcctgtgcatgtcaggatgttcaggagcatctctggcctctacctactagatgccagtaacatctcttccagttgcggtgaccaaaaatgtcttcaggcaatccagatcaaatgtccactggggggcagaatcacctgctgagacccactggttaaaatagtgtcagtaggggtggagagaaggggacaaaagagtcttagagccatttgagagggagcttctagaggacttgatggatggaatttggtcaaggcaggaatgagggtggatgtggggcatggggaattggacggatgatagtggcccacaggttgagagaggggatgggttcagctttggccatgctgttgtgagtctgtggttcccagggagcagctgagtaggctgttgggtgagtggttctcaagctcagagctgagctgggggcatccatttgaaggttatgggaagatggaaagcacgccctggaggtgggtgggtgagctcacccaggaccacggtgtggcctgagaagtcggcctgcgatagaacccggggaatcccagtgtttccagggtgggcagaggaagaggaggctgggaagggaatttgtttctctggccagagctgttgctcagcgactgttggctggtgaggatgaggctcatgaacagatgtggaaacatcgtgggatgatctcatggtgggtgggacttgtcgccgtcatgcactcagcactctctggcctttattggtcaagctgcctgctgtgtttctggtgcccaaatgttctgggcacactgttgtttggggaagaatcgcagggactctccttcactcttagatagtggcagcgcttgcctcgctgcatctcgtgttctcaaaatcagcacatgccatcccacattctagaccatccagttttgcttctcaggctctgaaaaacacttttaagagcaggttaaactgttctcggacttctttttggattatttgcaacgtcttgaggggtccacggattgatagagtcagcagggatggacagtttccccttcagcacctttatagttgtaatttgcccatgatggggttagagacccacagttgctcaaaagcagtttttgtttttcttgatagctggatttgggttatctctcaggaagcggttagcagtctttagggcaacctaattgcatttctttgtttacaagcacttaacttcatccctctcaggcgcacaccagcactgtctatcactaatactggcagttctagggtgaggtggacagttgctcttagtcagaaactcactttgctgttttccactagattcccagatagagaaggacagttgtttcaggcaagcttaagaccctgtaacatttcttgccctttttgatttgaactcccatctccctagctctggcttgttttaccctgcagttaaaagagaaaatgatctctactggctatatggcctcaggccaggagaaaaggtgctgttccttccagcagaaattcaagggtccagggaggctggcccaacccaggtcagaaggataatctcagaaaaagaaggaagcatgcattacccatctcagaacttaggaacaagaaaatcctaaaactccaaaggaccatttttccccactgacaggcccagcttaattagagaccagctaggagttgcatttcctggttgtttactgactgttctcttcggtaaacagcttcagcctgtaattaagctgtctaattggcaatgactgcaggaaaaaccatgaatggggctggcctccctctctagcccctgtgtctgctgtctgttacctaccaccatttttattcccctgtcttctattaaaaatgtcgtgggggcaaattctaaagaatagtctaggcaggcaaaccctttgaacttcactttgcaaacctgcctgagagtgagtctgagaggcaaattctttttctttccacttgaagaagtgtcagaaatttggtggattggaaaagatgggagagaaaagtccaggagtcctgactgctttcactcatttaggtgggctggcaagcagtgctggctgctccacctgttttcctgcctaataacagtgtcttttatagttgtctgataacaatgtcttttataatgtctcataactctgcctttttgtaatgaccggcctaatacctttgcctacaatagttcttttttcctctgggagtttaactcaggttgtgattagagagtatttcccataaatcacgcaaagcacatgtcctgcccaccagccaattacagaaatggagttggtcagacctacactttatctgaaacaatgcataatgggagttttgaactaaaaaaattaccctctaatgttacaaatatgattcaggcaaataaaactgcagatgtatgtgtaagtcctcagtactgcgattctttctttctctctctctttctctttctcctccctccctccctctcttccttccttcctttttttttttttttaagtgtcctggttgtgttagggtaatttgtgatttaaaaagaaatgcctctcctctccccgacccgatttttttttttcttttttggtaggatgcctccctttgcattccaaggcagcacttcaagcagcactttggtaaatgtcaaaaagttggagaggctgagtgggttgcgtggcccgtctgtgcctgtgggctcctctcccgcccacgcggctgtgcctctcactcagaaccctgcctctcttgtgtttgtcccaaggctttactttcccccccacatacgttcagtggcattatttgttacatttttaaaaatacatattttatttatttcacaaacaatgttactggcataatgttaccacactataggatataatggttgaagaatgatttcccataatctaatttcaacacattacctgattcagtattctgtgtcctctccagccttgcttttctctgtgcacaggtatgacctgattccagtgctttttaagaattattagcattttctgcattgctccttggccttcacagttatcatttgaacagtggcacaagattctctgaaactgctcctctgtcttcattcccattttgtgagcatttaagccgtttactgttgattgtccatttcttcaggtatcttcttacatcatcttgcttctttactcagcataaagcctcgtagtagattctcaggtcccaggggtgcacatgcctgtgtttttaccttacttccccaggggccctccagagggtgcccatccacggagtgcggcgcctgctcgacttggccttctggcactggggattcctctcccaagtcttgctagctcgtggcatgtgcaatgggatctctttcctgagtgcgcatttctttcctcacatttgggggcattcagtgggggaggatttacaaagaaacttgaggtgaggggccctctgcactcaacctcctgggacctggggctgcacccactggcattgattagaagagagcttgtgactgaggaaaacctggcttagggatttatctgcagggactgtccccagtaggtctatgagagcccaccacagcagcagccctctggatggggatttgggtcttggttttgccagcactcccagtggacagtcatgcctggacttgtcttctccaccttccacttgtcctaacagctgtcgggaccatcatccaccaggggccagctgtccagaggcagacccaccctggaaggcaggccagcctccgctctccacaccagcttggggatgaatcagcgggtgctctgaccactactttcccaaggctactttgcttcaggaagttacagcagccatagaggactctgcttatgtgagatgtgcagacataattcttgcttttagaaggaggggggaaaatagagaagtagttatctcattgtcttggaataaaattattttgctttgcaaagattaggcaaatcccaggttgctgagtcttggcagatttctcgtggcctagactgtggtgtttggggccgcctgtctgtaatgtgctgccatgacaaggcacggtggtggtggggacctggcaaggtaccgaacggtggaggtgactgtaggattagccccggctttgcagcaggttttcttgggaggagaaaatacacagttgggacagactccagggaccagctccttcccccttttttctattgcagagggggaaactgaggctcagagagggggactggctgtgcatacatggattctttgaaattttaaaggatggccaggtgcagtggctcgcacgtgtaataccagcactttgggaggccgaggcgggtggatcacgaggtcaggagttccagaccagcctggccaacatggtgaaactctgtctctactaaaaatacaaaaattagctgggtgtggtggcgggcacctgtagtcccagctcctcgggagactgaggcaggagaattgcttgaacctgggaggcggaggttgcagtgagccgagattgtgccattgcactccagcctgggcaacaagagagagactgggtctcaaaaaaaaaaaaaaaaaaaaaaaaaaaaagaaagaaagtttaaaggatgttaaaaattttccacacattatcttttaatgtgttgtcaaggagcaatgatcatcataatggcactggggaaatggaaaaaactggaaaactctcttggtttgacagaaagggatagatctaactgtttagtgttgccaagtgagcccccaaacatctcccctggaaaagtcattaggaatttaccatctccatctgcaggggccaagtgagataaccgtatctagtatatccatctgagcaaaaccctgtttctcttcccttgaataggaagccagaaactgctgcagcgcactgttgaaacatagcttagaaatagatactttgtggggggaaaacaacctacttatctttcccattatgctatctcttaatagggcccctggtatctgagccagcatacacatttggttcttctgtgtcctgtgatcttcctctgagtgaaaactgattatctactcaaaggaagcagatgacagagcccccgtgatgtgtgctgcctttgctctgtgcctctgtagtaagggaggcctggaatgagcagaaagatggctcccctggccacaaaggggggtcagtctattgcaaagcagccttcacgttctggaagcagggagcagtgggagcccgggaaggtcagccttgcagacttgtagatgtcataggattatttgagctgcttccgctgcaggtggttgggaagtactggatggaatccttggaggcgagatgagaggatgggagaagaaagtctggaagaacagttagatttcttcctgattagataatactgagtgagagtgggaagaacggagcggagcctgttgccagcgcgatctctgtcccgttcactgtcatgtggcctcttcacggatgtgtgtgtgtctgcagggactcctgagagctcttgttgatgtttagcccttggacctgctggtgcttacacatacgtttccatggagtctgtaccaaaaccacagaggatcgcccccgtttatctgagagtagctcatcatcattctctgcttgggtgtaaatagctcactgcagaatcttaatccccagaactggagaccaaccattttctctgcacttggagggaaccattcaaacatccctgttgggctagcatgaggaaaagccaagtcaggcgcttggccaccaggggatcttggcaagagaggccgtgggatttgagagttagaactgatatgcagcacagtgcaccttggtgccagagttctgaccagtagtgttgcgtccattggtccactatgatccatggattgggaacccctgttactgatgtgttgacgctatagcaatattatggtgtgtcagcttcgctgtctttcaaggatgacttgcgtagattgcatttaagtatagtggagcaacagcaatcaaggtgtaagacttttttttttttttggagacaagagttttactcttgtcacccagactggagtgcaatggcgcgatctgggctcactgcaacctccgcctcccaggttcaagggattctcctgcctcagcctgctgagtagctgggattacaggtgcctgccaccatgcccggctaatttttgtatttttagtagagacagggttttaccatgttggccaggctggtctagaattcctgacctcaggtgatctgcccacctcagcctcccaaagtgctgggattataggcgtgagccactgcacccggccaaggtgtaagagttctaatcttaggccttcattctgccatatgacaaacaaagtagaattacagttgaaaactaattaactctacataaaacaaaaatgaagaggtgggctcacatacctatctcaaagttgctctggaagatggatttagcccatttaaaggaagctaagggatagaattcatgagaagtgaggtctccggctttgtatttattagggcactattattagatggcaacagatagatcccaaattctcaatgactaaccaaagggatgtttattgccctttcacattaggttggaaagagatgcttctgcttagtaacgctcctttagtgactgggctcagccatccagggccaccgtgaaagaagaagagttcagagaatgggtcattgcaggggtttacgccccaggcctggcaggggcacacagcattgcacatcccccttccatgggtcagcacgcagtcagatgaccaccccttcctgcagagggaggtggggagacaaggtcggcctgagtgtccaggggaaggagaaaaccggcacagaaacaactagccagtctctgctacctgtttcttgtgttaaatcagaatttataggaaggtgattttttaaacagtttagagagcttttctaatttttgagcgagggtcttgtctgagaattatagcttgagataaggacttcagaatctaacaattctttgctccattgctacaatttccccaacccagaagtggtgaaaccaagtctatcaagcttcttggttgacatcaagaaggttgttctgggcgggcgcagtggttcacacttgtaatcccagcactttaggagtcccagatgggcagatcatgaggtcagaagttcgagaccagcctggccaacacagtgaaatctagtctgtactgaaaatacaaaaattagctgggcgtggtggtgggtgcctgtaatctgagctcctcgggaagctgaggcaggagaatcgcttgaacctgggaggcggaggttgcagtgagattgcgccattgcactccagcctgggcaacagatctagactctgtctccaaaaaaaaaaaaaaaaaggttgttttgtttggtaaacagaaaaggagccatcttaagataatgcatctttatttaacagttatgaatagaatctctcaaggtccaaaatgaatcttttgaaagaactagaaattcttgcctgtaccaaccatattagcaagacttgaaatgcaacattctaagatgtgcctcaggaataattttattgaccaaaaccagacgtcagcttgcagccttgtgaagcctcctctccatgtaggaacggggggcattttggttagctgggttaggcttgctgaattttaacatgacatgcttgcttttcctgtgttggtgtgtcgcttctctcccttgggcccccgcccctaacttttccacctgatctctgacttctccatctttctaacccctgaacaacaactagagataagttcaaggtcactgctggaactgacctttgggtgcttgggccacccttaggccttgagaggcacaggctgaggccttctgtacaacctcctggccagtgtggaggggccgggctccaagcaagcttgtccatatcacagaaagtcaagagtcttgccgcgtgcggtggctcacgcctgtaatctcagtactttgagaggccgaggcgggtggatcacgaggtcaggagatggagaccatcctggctaacatggtgaaaccccgtctccactaaaaaatacaaaaaattagctgggcgtggtggcaggcgcctgtagtcccagctactcgggaggctgaggcaggagaatggcgtgaacctgggaggtggagcttgcagtgaaccgagattgcgccactgcaccacccgagactccgtctcaaaaaaaaaaaaaaaaagaaaagtcaagagtcttcacaatgaatgttgacagtaatacaaggtcagctttttgtttgctttttaaaggttccagtctggtcacaactgcatgcaactgagttttgtaattatcatcttaacaatgtgatcacagtctgccctgccattaaagtatttacttgagggtacccatgtagcatgactgtctcagatcagattgaagccttcgaacttgctttatagaggtttttagagttgagcaatcacatttcttttttcttttctgagacaatgtcttgctctgtcacccgggccggagtgcagtggtgcagtcatagctcactgcagcctcagactcccaggctcaagcgatcctctcacctcagcctcccgagtagctgggactacaggcgcacaccaccacagccagctaatttttatactttttgtagagatggactcttgcagtgttgcctgggttggtcttgaactcctgaactcaaatgatcctcctcccttgccctcccaaaatgctgagattatgggcatgagccaccatgcctggctgaggaatcacattttaatagcctcacaaagaaatcctagtgttgacaatataggtttttaggtctggaatgaacttccattctagtctaatttcatcctgattttactgtccaggctcttggctgaccagtgtgtggagaccctggtggcagcctagggatcccctccaggtctcttccttgtccttactgtagaccatcacaccgccactaatttcccccctctggccaggtgagagcagattgtcaccatttcagagaaatttgaaccaatcagaaagagagctcaggagtactggggtgactgagatgagcacatgtggcttcttgaggaccttccaacccccaagttattcttagaaagctgcacacaagccaggcagctgtaggctggcgttgaaaagtttttagctttagctaattacattgtgggagagactgactggggggtgtccatcccgtgtgtgccatgctgcctccatctctttctccctctcttctgagaccttctggttatccccagctacctgcccctccacctcctgtgccctcagggtgggcagtttgggtttctttcctttttcttttgtctgctgttgtttaggattgtgaaagtgcagcagtgcactctgtccctgcaacaggctctgcggtgggctagctccagtgttgcattctcccttcatcagtggagaaatgcactcttggaaccatgaagagtctgcacatgacagctctgcactcactaacattcaagcaccttgattcagagtttcacgagactaaggtgaggttacctttccctctctgttgttcttcccgtggaaagagggttttctattcacactgtacattcagccacagctggaaacctcatcttcctcttccagttaagacagtcatgtggccgggcgcggtggctcatgcctgtcatcccagcactttgggaagccgaggcaggcagatcactaggtcaggagattgagaccatcctggctaacatggtgaaaccccatctctacaaaaaaaaaaaaaaaaaaaaaaaaaaacattagctgggcatggtggcatgcgcctgtagccccagctactcgggaggctgaggcagtagaatcacttgaacctgggaggcggaggttgcagtgcgccgagatcgcaccactgcactccagtctaagtgacaaagcgagactgtctcaaaaaaaaaaaaaagtcatgtaattgtgacctcagttcgcaggacttcggaagcagggacccctcccctgtacccccgccaaagccaccatggtagctcctcctaattggatcttgggggactcggaacagggtttagcctgagaatgtgacttgtgagaaccccagatgagagtagttacacttttctggaaggcttatttaaaaccccagaacattcttgcattggaattgagttgcattgctctctgggacgggcagtgggctcttggaagaggtaagtgaagtcactgagtgggacgctcctcgggggaggattttgtggggcagtgggaacatcagtctttcctaggctcaggagtgagtctagaggccatgtttatgcacaggaagcatctggaagcttattaacacagattcctgggccctgcccaagagatttcaattccgtggggccaagcaggccttgagactatgcagttttaatttattgttttacttttatttaaagacagattctcactctactgctcaggctggggtgtagtggtatgactgtagctcactgcaacctcaaccccctgggcataagcgatcctcccaccccagccttccgaataactgagactacaggtgcgcatctctacactcagcacattttcttattttgtagagatggggtcttgctatgttgcccaggctggcctcagactcgtggactcaagcaaccttcctgcctcagcctcccagagtgctaggaatacagatgtgagccacagtggctggccgagattgtgcttttctagcgcctcccaggtggctgtgctgatgctgcttgtctgggaccttgccctgaggagcactacgctgtaggttctatcacggtaacgatactgtaatgtacagtgcatcagatgtcactaatttaaagatctaggctgatgaaaatgaaaccaattgaagtacttcagctcctccatgcaagcatgggctggcttcccttattttactgtggagtgccttttataccagagtagtggctttctaatgtctgactcaggttaattgatgagattccaaggcaacacaattcagtaaatcaaactggatgaacatcctctgccatcagaaaaatatctttatgattagatggtgatctttggatggaaaatattaaaataagaattgattaaaccagctagggatggtggctcacgcctgaaatcccagcagtttgggaggccaaggtgggtggatcaccggaggtcaggagttcgagaccagcctgcccaacatgaagaaccccgtctctactaaaaatacaaaaattagctgggcatggtggtgcacgcttgtaatcccagctactccagaggctgagacaggaaaaatcacttgaactcgggaggtggaggttgcaatgagccgagattgtgccactgcactccagcctgggtcacagagtgagttctgggagttgggtttgttcattcatttgtttattcatctatccatctgtccttacgtccttccatccttccacccacctagacatccatgtcttcctcctcttctccctctgcccactcacccatccatccattatatgttagttgagcatgctctgtttcagttctgggcactggggatatggcaaagaagtaaacatagaaaacataaaactctgcagtctcatgctgtggcaagtggtgccttctgaggtcctgagtgttcctggaaattagcttgctctttaccctgctctgctgaagaaaaccttggcaaatagggcacagaaaactcaatgtcaaaaacgtaccaattttcagagtaggaaaaagtgtgttttttgcagattgcaaatctgtgagcttagcttcaagtaaaactctagaaagacttattaaagaaatgtcctataaaaagagctagtatgtgctctgaagacctgggtctggcagagcagcctctgacatgtgtggcaccattaggagacagccaagatagagaccctggccaggcgtggtggctcacgcctataatcccagcactttgggaagctgaggcagacagatcacttgaggtcaggagttcaagactagcctggacaacatggtgaaacccggtctctcttaaaaatataaaaaattagccaggcatggtggcatgctcctgtagtcccagctactcaggaggctgaggtgggacaatcagttgaacccgagaggcagaggttgcagtgagtcaagatcgtgccagccagtgcgctccagccagagtgacagagtgaaactccatctcaaaaaaaaaaaaaaaaaaaaaaaaaaaaaaaaagagacacccttgcaggcagtggtcacaggccgaggaacctggtggacaaggtggggaacgactcaatggatgatgataaacaggaagttctagtaccactgagaaaacgatctgccagatatctccatcagcaatgttcttaacatgttttgtttttgacatactccagtcctcattttgacaagcttaagggaaacatatttgcagtgaatgttgcagacaaatggttattcctgatgtttaaacagcccatacaaatagattggaaaaacatgaagattcccataggcaaatagacaaaaaccaattaatctgaaacgctcttattgaacaaatcagcaaagactaaaaacagtgatgtcgacgacgtagacagattcagccctctagtcatgttgtggctgttggcagattaagcctgtgtgctggtgggtgggctgggagtgagcaacgttgagccccccgaaataatgatggtgggaagggaaacctttttataaacttgtttggaaatgtgaatgtatgaaatgctggcttcctttgactcaggaattgtgcttctaggaatctaagctaaagagattttcatagtaattgacaggttgatttatatttatactcgtatcttgttccagaaaggataaagcggtccacggggagggacaggcatataaaggcagcagggcacccagaagacagcttgtcttgatgagaaggagaaggagccctgttttacagcaagtgtcttttggtatgaaattcttagggtttggggcaccccttttgttttttgaacgctcgacttttttgatggttataattgagaaatacaggatattgcaaaccctagaccatatcgaagggggcaaacttaatttcatttgaaagacacctggagtgggcaggagacatgctgatcagctttccaggtggcagaggcagcttttatagtgacttccctgactggtcaactggaagcttgattgaatgtcctgtgtccctctgggagcagcccacctgtcactctgtggccctgcaacagggccctgcttgtcaggagatggccatcttagttatctgaccactttccagccttcagccacgcagccctcagaccccccctaccccccaggccactgtgtccctggagacccctgtcctctgcatgcttcctactccttagaggcccatcagcctccaagagccaccctaagcaagtcacctgtctgtgggtgacagcattgagtccatgttaagagagcagcctctatctgtctgggggtggagagcccatgtgattcaggagacaccacatcatcatttcagagccatcactgaacatcagggaagagaactcaagggtagagttgaacagaaacataagtgatcctaggccgggtgcggtggctcacacccgtaatcccagaactttgggaggcccaggcgggtggatcacgtgaggtcgggagttcaagaccagcccagccaacatggtgaaaccccatctcccttaaaaacacaaaaattagccagttgtggtggcgggtgcctgtaatcccagctactcaggaggctgaggcaggagaatcgtttgatcaggggcagggagcagggtgggcagaggttgcaatgagtcagctactcaggaggctgaggcaggagaatcacttgaatggggcagggtgtagaggttgcagtgagccaagtttgtgccactgcacactctagcctgggggacagagccagactctgtctcgaaaaacaagaacgataccagtaggtgttctttgacccatcaacaggtgtggggaggcagcactgcaccgggaaggataagagggtaggctttgctgtctggccttgggcaagacacttgacctctcaaagcccatttgctgcattgtaaagaggaaatcataccctacagcagctaaccctcttaccttgctacttaagggcacattccggccgggcgcagtggctcatgcctgtaatcccagcactttgggaggccaaggcgggcggatcacgaggtcaggagatcgagaccatcctggctatcacggtgaaacactgtctctcctaaaaataaaaaaattagcctggtgtggtggcgggcacctgtggtcccagctactcgggaggctgaggcaggagaatggcatgaaaccgggaggcagagcttgcagtgagccgagatagcgccactgcattccagcctgggcgaaagagcgaagcctccatctcaaaaataaataaaataaaataaaataaaataaaatataacataacataacataacataacataaaataaaataataaataaaaaagtgcacactccctggccatcagcctcatctcttctacctgagtggattaagtagtaaagggggagctatccaagacagattttaaaatggtcagtttgagtaaaccaagagataggtttaaaaaacaatgtatgtttcactcagagcataaacaaaattgttgaagagccagcctacatgcaagtttaaaaattaaaaatggccttatgtattaaaaacaatccaggctgggcacagtggctcacgcctataatcacaacactttggatggccgaggcaggcggattatttgaggtcgggagttcaagaccatcctggccaacatggtgaaaccccgtctctactaaaaatacaaaattagccgggagtggtggcaggcgcctgtaatcccagctacttgggaggctgaggcaggagaatcacttaaacccgggaggcggagattgcagtgagctgagattgcaccactgtgctccagcctgggtgacagagtgagagtccgtctcaacaaaacaaaaacaatccatgttaattttagaaagtacaaatacagaagcagaagaagaatctgacagttatctagaggagattttaatcagtgtcctttaggttcattcgttgcttatttcaatctggattgggacaggatgacaaaggcccatgaagggattttatatataactgtgtgcttagtgtagcgtgggtgtttgtgttttatcgcctggcctctttgtggcatgtgacatctttgacaggaacaccaattgattcctctgtgctcaataatgtcttcactgccatggtatttcctgcacagctggggatgcttaactgtgtaactacaatagcaagataagggaaacagattttccaattggatattttaataaatgatggcttcagaaggggcacaatattctacgccactgattgaatgatgacaagaaatattttaatgggtgcattgctgtcgcagtgtagtaaaaagtaaagaatggttcaccaagtcagaggtcatcctcagatgtccctatgtgtctgttagtggagataaagtgatctcaagacggtgacacatttaaagtgacgtgaactagtttattagtagtcagtggtccccccggccacttctaaagatgacatgcttctaatcatacccacaggatttctaagatcctttttttttctcttatcaaatgacagtgcttgatgataatttcatcagaaaggtctccatcactagtctctgctttattttcacgtaggcaagtggtctcaagaaaattggaataaaaatattcaaaataatttctcccagctatatctggagcaagattaaacaattataaggagtaggcagtatgttttcaatccctgtgttgtctttgtcaccatgatttgcattcatatcagaaggccagcaaactcggaaagaaaatgactttctgattgaatcatatcattttaaacaaagctctttcatgaataaagaatattaattactatatccagaatgatcctcttttttttttttttgagttgtgtgttaacagaaacctttgtgcatttgacacaaggtcagcatagatttaacaggagacataagctttgaaaatttattcatgctggaattgaacatggaattaattaaatgtacagaagctggaaggtagacaggtcgttgtctccatttttgttctttaaagcactttattccattgggatatcacaatttcgtagcctggtatatgcattccttgtggtgtgtattaataaattgagtaggtgaaaaagacaatagatggaaagctggaaagtgatgtggcctgaattcctttctaggtaatttcaatgttggtcatgcccagggatctccttaagtgttgcagaatcacacctggacaacccaggtgcccagtccttcattgcctcatgggctctctagtcttacttttgatcccttttcctgtatttcaccagtataatactccccactcctagttgggaatatctaacctgtgttgagtacctgtatctgatgagttagtagctgtgaaaacgtttctctagcaaggctgcctgtgagtgggatcccaggccaagcagttaactgcgttccagcgaagcaggtgccccgtgtgttgctctgcaagtccacatggagcaggattccttattttgtgaagaaaggatctttagtgccacgtgtgtatttttaacacatttccaaaagcatgatttattcaggattaagtttattcagtagaaatttccaaggtatttttttaagtgaggcaccatcctggatgctggggaagaatctttgttggaatatgaccctgggttttgtatggaaaagggagggggcagtgcaggatgtggcaaggcagttgttggagctccgatacttccaataagtaactagcagggctgtacacactctaccaggaaagacaaagaaatgcagagtccagggaagcagtccatcgcacgtttcttccttccctgcaagggcactggagttctccttcaccaggaagactgcagcccccattctgattggcctcagggggccgctcctgctgatgatggctaatgaggacaagcagtagagaatattgctttcatttatcttggtgctttgtaccttgatggagacagatattcgggtttcaagaagacaactttttttgcagggcaggcattgtttgcttgttttaaggctacgttcagaagcacgagaacaaacaacagtttcaagcctaacacttgggtttacatgaagctaattgttagatatgagttctaaatttcttttcaaagaatcagtatgtcagtatgttcagttctttgccttctacttctaaacttaactttctcataaagcaacatttttcgattacctgctccaccctgactcatttcaatcacctgctccaccctgactcattccgattacctgctacctgctctgccctgactcattctccaccctgcataaccatttttcccaccgaaccactcaccgggtcactctctttaaattagccaattggaattagtttagcctgtgcggtctaaccctagccaacaggggaacgacacagcagcaggggccacgtgagtcagggataagaaccccttccctcccttgtccaagtgtgcgctcaccattgctccatctgtaagggcgcacccttctgtagaagtaacttgccttgctgagaattaaaaagaaaattttatatttgagtgctatttcttttgtggcactgaaactttatatataacataatgttgcagtcctttaacataacagaaaggaaaaggagaggcatcctattcggttttgcactaggggtccccactgaaattgctgaccacaatcacatggattatgatttaatatttcagcaagacatgcatgattttaaatgaatccaattaatattccattgaaaagtggaaaccagagtctagataagctgacccagctctcatgcatgtgctgttaactttcctactttccccaggagtatcacagtgaaattgagccatgagggactctctgcttcttacagttggaagcctctggacttcctcctcagagacgggagatcttgtctctctcaatcctgagttagtctccactttatagctgttacttcagttgtagggcactgggtagccctggagttgagttgttcaatgcatgaccttgtttatgtcgctatttgagtttttactgagaaaaaggccttctgtgaatccaaatgtgactattacacactgaatcttcccattactttaagaataagtgatgttgttgttgttgttattattatttgaggtggagtttccctgttgtctcctggctggagtgtaatggcgccacctcggctcactgcaacctctgcctctcgggttcaggcaattcttctgcctcagcctctggggtagctgggattacaggcgcccgccaccacatccagctaattttttatattttttagtagagatgggggtttcaccatgttggccaggctggtctcgaactcctgacctcaggtgatccatccgcctcggcctcccaaagtgctgggattacaggcgtgagccaccgcgcccagcccagtggtgtgattattccataaccatggtggtgattcctgtgggctaaactgtgcctcccagaatgtgtgtgttttaagtcctaacccccagtgcctcataatgcgattctatttggagacaggttctttaaagaggtgattgagtcaaaatgaggtcagtagagtgggccctaatccagtaagactgtgtccttataagaagaggagattaagacgcagacacacagaggaaagaccatgtgaggacacagggggaagacggcatgtccaagccgagagacctcaaaagagaccagccctgtccacactgtgctgatctcggccttctaggctccagaactaggataactaggtgtctgttgtttaaaccacacagcccgtggtactttgttaggtcaaggctggtaaactcgtacagtgatggcttcaaatgttatgaacattaaaatctttctattgctagggaaggtcattaaaaccttggtggccaattaaatatttatggattttttttcctttacacttttgcaaagcgttttttctagtttgtgcataccttcttctattagcaaaatgtcttctattaccagctttagaaataacggtgctgctattttccttggaggggtctgggttgacagacctgcgaaaggtctggatgtgttcagagaaataagcgatttttccaaggcccaggcctttgtactgctctaattctatccagaatgcttcggacgggaagaatttatggctttataagtgagtatttccgtattagcaaagagacatctacacttgaaagactttcctgcagcctcccgggggtcgaggtcaagagtctgggaggaggtgtggagcagagtgtccgggtgagagggtgctgggggcacgtgcccagcaggggtggaggggtggacaggctcaaaagagagacctgggcagtggacagggctgggcttccctggagctgttggcggggcagagccagctcaaggaacagctacccagcctttccaggaactctggaaggaaacggggacttccctggtgagggtgggatttgggagataatcctaatcactgggctgttctttgtcctttgacattcaaatgaaatgggagcctgttttaccccaatcagccttgagttttcggcaccctccccctcggaatacccgtgagggaccttctgtttttgttgttggtgttttactaccatttctgagtactttctccgaaagctcttttagcacgttgcttttctctctgccctccctcctcctctttcctcccttctgctctcactctgaagcagcccagcagcatgtacagcacttgctttcctttgagaggccctccattgttcccgccctgccaacttccacgccagcctccttttgcaagtccacctgccgttctgggcttgccctggggaaggccctggagctggattcccacaccctgccgagtttgtgcgtttctgtgaatctgatgagtgggttgtggacttcaatccagccccaccctttacagtgagatccagggacctttttaacctgtgactgactttttatgtctttctatgtctgtaaaatcgggataataatagtacctacctctctgtggcactttgggggtagaatggatgaactgaattaacgtctgaagtgccacagtgttgtatctgagtgagtagcgtcctccttaagcattggctttggtgcactgggaaggggcgtcagctgggcaggctgagcctgtcacctttttcaaaatttccaacaactgtggcttcttgggaaatcctttggcagtcagggtgctatatgaacacatgttttgtgggtcacttgccaggcgtcagtgccctgctcggggtccctttgcagctcccctgaacgtgccatttgaagcatagcaaccattactttgagaacctgtgcaggtccaggtgccgagggctgtcagatccctgcatcaactctggggatgggttcaattattatcctctctgtaaacagttctcagttattccaagtattctatttcttaatggatcttctaagccctggatcaatagtgtatatttctttgtctctcagttggggccctggcctctgcagataagccctcggatgcgaaatctggggaaccagccagccacctctggtcctgggagggtcagggactcgtgaatcaacatctggctctttgtgcacaatgggcctggcatgggcccaggctggtggggtgggcagggaaggaacaggcccataggcacccctccatgggcccctcaaggctgtagacccctctgtctgaccagcatcccattccctgaagtgaagcagctgccaccaggctggcttttcccaggcagtcacactctgggatgcccccacccctcagcacacacagtgactgtgttttcatgttttccaccaagggagggagggacaggctttctcaggggggcggccacccaagatcagctgcggctgaggatttttgtggctaggggaagaagtgaatcaccctcttctctgtgtctttccctaaccactggagacttcatagataaacttgcggggtcacggtgagggaggcactgtgtggaagggtaaatgggcttcctgggggtttagtacaagttgaccaaccttcttgttggtaacatgactgaggcattacctgcactgattaagtcaaccatcaagcagcatttattaagtagaacattgataagggcttgagggtgagagaagttgtccttaactgaaggagggggttctataaatggaagtgtcagagcagggtgacagatgccaaggaagagtgcccaggtgtgcacaggtgtgcccaggtatgaggggagaagaaggggtcagggccagcagggaaagagcttggggactcctgagtccagctcccagtgatgtgtagagttgagctccatcctgctgatcccagcaggagatagtggcgagactgggtatggtgtggttgggaactagaaaggacactggtgtgtttagatggggaatcttgggatgcaatagaaacaacctctgttggttttcagcattggagcagatgctccccatacatcatcacatcttattgtcgcagctaccgtattgttcttgtcccgtttttgcagaaatgaaaacctgatgcagagcctcaaggtcactttcccaaggtcacatgtggtttgcatcattctggccttggagcccagcctcttagccactcagtgcaactgtggagactggagggtgtcggggcgttgaatactggttaaggaaacggacgctttattctgcaggtgacagggactcactgagggctccgaacagaattgtaccctcagactctgattgcaggagtaaggatggtttactgagagtaggctacgtctgggggtgggtcagcaaggacgtgtgtgctgtgggaatcctgagacagatgaagaggctgtgaacagtagagggagagtggactcttcgggtagttcagacagatacgcaggtggggagagattggcaggcggaggagaggcttttgttgagggctggagggagggaggagaggcaggctgtttctgttttctgttaagtgggacgtaatcgagtgttttcctctgccgcctgaaggaaaggcggtgattgtgattgagggtacagggtccatttgccaactctgagcgggagagttgggtgtgggcgggaggcaggacattgagggagctctgaagtcatggctggaggccatcctactgaggggatggggcagtgatagtttcaaggaatcctaggaatgggaaagggggctggccagggctgtgggggtgggggggctgtaggatgctggaagcagccccagcacatgtgcatctgcagcgggacttggtgatgtggacttggggcttccgatgctcgtgctagcctgaatctccgggagacatggagcatctcagggtggggtcaggttcccaggtgaagcccctgctgctgatctgtagaccgtgcttggagaacactggtccagtgcactggagttcgtacagatccgcctttggggcatgcccaggggggtcttacaggagccagggacaggtggggccatgtctggagtagacagtgatacagtgatgtcccttggcctctgctggacagagaaggaggcgccaggaggcagctctgagttgggatggaaaggatgcatgacagtcagcttccctacagctggaggggaagttccagaaagaaaggatggccaacctgggacttgtgggcagggaaagggcttttggaggccaagattgtagggcagtgttatcctgggtgagttggggtatggccataggagggggctccaggaattcagggaaggaaaagaccatggcgctgaggaggcggcacggcctggccctccacctccaagctgaccaccctactcagctcctttagggtggagtggctgtaaggccgtgaccaggaaaaaagggacccagggtggtggcacatgaatcccagctttgtgtatccactcagttgcatgccaggtagtcacatcttaacttgtggcgcggctttagagagtgtctgtgcaggctgcctctgatccctcagtcagtgtgcagagctgagctgatgaggaaagtcttggtatgtaaccaaccaggtctcaccttcagccacactcctagggacagagtgcgtccatggaggggaggactcacagcagttttgaagtaatgtagattgtgtggccatcccaatttagtttatcattcccctacttggtctgtctgccttcatggaagttggtgatttttttttttttttttttggctctgttgcccaggctggattgcagtggtggcatctcagctcactgcaacctctgcctcctgggttcaagcgatttttctgcctcagcctcccaagtagctgggattacaggtgtgtgccaccacacctggccgaagttggtgattttgaacagaggaaagatagcacagtgtcataactcagcaaaggtgctcagcagctgcaggagttggggttttctgggctcacacccagcctgtgtccctcatccccttgctccgctgcaagaacccctcaccctgctcagtgctcctggccactgctgactggtgcatggcgagcagaggttttattccatcttactgtgtcagatgtgattccggggacgcagttctttcttaagagctctgatgcatgttctaactaggagggcaggtagctgccgctcccagcagcccctgatgtgttttccttcaagcctggggaacaccgagctagggacacgctggctaatagaggaaggagagctgggtatggtggctcacacctgtaatcccagcactttgggaggccgaggcgggtggatcatctgaggtcagcctgaccaacaaggtgaaaccctgtctctactaaaaataaaaattagctgggcatggtggtgggcgcctgtgatcccatctacttgggaggctgaggcaggagaattgcttgaacctgggagacagaggttgcagtgagccaagattgcaccattgcactccagcctgggcaacaagaaggaaactctgtctcaaaaaaaaagaaggggagcgatcacgtgcatccctctgctgagatgggagcagcagcgtggggttgggctttgaactggcatcgtaggcattttgttttctacatttagaggaaaaatatacatcaaatattcaagtcccctgggcacagataaaagagttttcagatatctctgcagccaaatcccaaatgggatgcagaagggagaactgtgtaaaatcacgctcttccagaagctgggctttgtaatggggctggcaaaaattcccagggcatcgtttgtggcctcaatgtgattttcatgtaagtcatggattttctaaatctttgaggttagtggatctaaagaaaagcttggtaaacatccagatgttgtcaaacatatttaggtcattgttctctgacagttcgtgatattcgttcctactccaggaagctcttaggagaatccaaatccgacttccctgtgctttgagaaggaatgtctgcatgaagaccatcgtacagatggcgatattagaagagttccctcccgtgaatcctgtagaggaaaatgttaccaaataggcctgttcccctgtgcacccaatactaggaagattagataatgtgtagggatttcttggtttttctgcacaaaagctccagggctgctttgaggctgtctgatagacagctgcagtgttgtgtgttacccttgaccgcatccctcctgtccctgagctcgaaggctgaatggtcgatgggagctcctttggtgactccgtagctgtggccagtgcctggcagctagcgagtggccagaactgggagctgctgtgtgtgacgtggctgttcagtgttgtttgtgttggctctgtaaaacgatgcttaatagattggattttaatatatagtttgtttttttgttttttttttcgagacggagtttcactattgttgcccaggctagagtgcagtggcatgatctcagctccctgcaacctctgcctcctgggttcaagcgatttccctacctcagccccccaggtagctgggattacaggtgcacaccaccacgcccagctaattttttttgtatttttataaatataaaaaagatttcaccatgttggccaggctggtctcaaactcctgatctcaggtgatccacctgccttggcctcccaaagtgctgggattacaagcatgagccaccacacttggcctgatttaatatcttaagtcacctttgcctgacacttagcaagaaaaactaccaagaaatatctaatattttccttttgtttgggaataagaatctactcacaatggacacttgctggcttgttttaaaaccaagcttgcttctcactggcctgtttaagtggaaatgaagtctcagtgtggggtccgatgcttcctatggctgcatggaggaaaggagtctgggcctgaatctcccgtgttcctcatgcatgggtagaactaaagcctcttcttctgtaatgtggcagttcccattctcagaggataaagtacgtgtgagtgatgccacctcaacccttagccaggtgcaggcgtaacaagggagacccacctgtgcaatatagtgagacccccatctttaccataaatgaaaaaaacgttagccaagcatggtggctcacgcctgtaatcccagcactttaggaggccaagatgggagaatcatctgaggtgaggcgttcgagaccagcctgggcaacatggcaagaccctcctctctacaaaaaaatttaaaaattagccaggggtggtgacatgtgcctgtggtcccagctattcaggaggcaggaggatcacttgagcccaggagttcaaggctgtagtgagctatgatcttgccactgcactctagcctgtctgtgtggtggtgtgttcatacacaatagacatcgccagtgttctgttggcaggaattgctatcgttggtccttaaggaaaaacacaggaaggatgcaggtgctcagaggaccttctggggtcttttttcctgccagatcaatgttcctgccctacagacagaccatacttgtccttcctccactagcagataagggtcaagtcctcatctcttttacagttccacgtttaaccttcagcttttaaaacgagagaaatagggtccccagtgagttcagctggagtgtcccaggcaaagggatgcgtgcagaattttcagttcctagaagctgagcatcatggcaaatcttagcttagaaaccattctaccatgacattctcagatgagaatttgagtcttatgctaaaaatataaaagtattaataagacgttactgtcttggtaattgcttcttcttacatgtatctgtcagtcaactggctaccagaaaatagcctttgatgtacccacggaggggctcttggtgggctcccggggtgggcatgctcaggcctgggcagtaccagtggttggccagtttctaccatcagcagacgcggttctgctaagatactgcaaacgtgattactggctgtcaggttctgttatttggaaagccagcctgtgtagcagatggctctgctgactggctaccagaagtttcctttaaataaggcttatcagctctagcaacacttggaaatactattctccaggagaatgtttgatttataggtagctagaaatgacccgggacagaggagtcgtgagacggtggccaaagcatctcataaacttggaactaagggagcgaagccagctgctgagggtgatgaatgggggttagctagggctggcacctttcctgaactctcctctgcagtcttcctctctcgcgcagcattagtccctgcagcacggaggcattacccggctgctgtttggttttgaggtagcagtgaaatcaactacatgctttaaaaaaaaaaaaatggtgatatgctccatggcatgaaaaaattcaagaaatggcagtctagtgtttaaaaagccacaggaaaataaagcataatgccacctgaacatatatagtattgtgatttttttttcctcttcaaaaaaggctggtctggctttgtagaaggggatttagattttggagtgacatgtcgggagcatgtgtcttctttgcatcgggagagcccatctctctaaggcagtggggaaaggcaattctctgtgaccaggtttttcagcacccacagttgcacttgacatggcatcattatgactggtgtggaaaataagtgcttccttctgaggtggaaatgctgaaagatcacaaacacactggctatggctggaagaggttccctggaagagtcagtgtcatctaaggtggatggaatggattcttctactccgcagcccgcatctcatatggcaaagtgcaaaacctgggatggattctcaacaaaggtacagtaattgggagacacaaacagtccagtgttttagccctgaaggaatactaccttattttttactttgggctctatgaatgcttcagataacaagccagatagatttacataccttaattatggacaagctactttcatattaaagttcatctcagtatgtgaacattgccctggtctcaaacagtgagaattgacctccccctcccacacctggctaagttaggagcccagggttctggtcccacccttgacagtagcagagatctctatctttccacgttgctgtttgtttctcagcttacagacctgggtgacctttaagtctgtacagctgcagtgataaaattttagacttttgccatattttagtggtgttcatcattaaagaggcgggatggccctgtagctgtctctgggattatcgcgaagcttttctctccctcgctgtctttctgtggtaaaatcacgtagccttagcatttttcgggagttgggtcaattctttgaggacagaacccctgcgttgtcactgtgtagcattgcagtaggtactcaatatatattcgatgaataaatgaaccaatagaaaaccgagtaagtctgtgaaagtttgctaaaaatgctacctggaaatgtcaaggtaacatttacatttgatttgtgtggagttcagtaatattcacatgtttactttggtctttgttatcaacaaagcagaatgctgatgcttactaagacaaaaaaaaaatgagcacaggcagtgtgacccccaaaccccagatttcacccttactgaggagctgtgtagccctggggaggtgccctctgtctccgagcctctgcatctccctaaccagatgggcgctaggctgtcattctgaaccattctgacagatgaatcccgcctggctgctactctagaagttgggggttcttggttcttatcaaagagggcttctttagcctggcgtggtggctcacgcctgtaatcccagcactctgggaggctgaggtgggcagatcatgaggtcaggagttcgagaccagcatgaccaacatggtgaaaccccatctctactaaaaatacaaaaattagccgggactggtggcgcgcacctgtaatcccagctactcaggaggctgagacaggagaatcacttgaacccaggaggtggaggttgcaggagccgagatcgtgccattgagctcccgactgggcaagagcgagtgagcctctgtctcaaaaaaaaaaaaaaaaaaaaaaaaagtcttctttattgaaactcaaaaggtaaaatgattctgtcttggagacccctccttacaatgaggatgtaatcagaggtaccacatccagagcccttagagtttgagtagcaggtaggctgaggtatgaccctgtgatggtgaaaatcatgttaaggtcgaggccacagagggtgctcaggtgtattttaaagtatcctttcaagataaataaagtgaatcacctagcagtcactctgacttatttcattaaatctgaatattaaatttaatgctgtcataaaatctagatttcctaggctataacttctataacttccttcaaaagagagcttgcccaattcagttttatgccacttccagtgtcgtgaacacaataggtacccccacaataagattaaagtagggaaagctggcacctgacaatccctgcctgcaaatagcaaatcccaaagtaatgcttccacctggcctggccgccagcaccttgcccagaaacagcctgtagcaagctgtggcatttctaggcctggagaaggtcgtgtaagcatgtggtgtgattaggggacattgtatttttccttctgaaacttttcatcaaggaaactctgaaacaatacatctgtgtttaagacagcttgaggaactgataagttgatcatctatgtctaaatattgtggcctccgataacatcctagaccagtatctatcagcccaccaggtaggaaatcgaggatttgatggaagagaagttcagttttcattattaatggtgaatatttagcatgtacacagaatgcctggcacataggattttaaccaatttaatcttcacaggaatgctcaaagtttaggagcttttattggcacccctgttttacaggtggaaaagcaagtggtttgtcagtgaataagcctggcttgcgggcaggcacgtctgtctgcttgctcttaaccgcagtattctcctgtctgttgtcatggggagcaagtgcttacctgtaaggaatccttccccacacattggtaaaataaccctacaagattattttagaagttttgcacagaggcagtatcgtagccatggaggtttatctggggtgaggttattgataattgaaaatgaaaacaataaagacagaattatgttaggagacagactgtggcccttcattgggatggcattggtgtacacagcaccctcacagtcacatctctttgttcttgtcttcctggaagcccacttgttcctaggtgaggttggcggtaacaggtaccaaagactgttttttaaacaagtcacatgagttgcatcttcgaggctgcatggttaggaaagatgcctcatttaaacgcgcagcaggtgagacatgcccctcgttttgttcttgcaggccaagccccagagtgggcgtggttttagggtgcaggctggtgctgggctgggcccctcggaggctccggtccgcgctgcgtcgatccatcccggcgcttgggcctgcacgccgccgcgctcgccgccgccgccgccgccgcgctcccgggactcggccagcccggctgggcgcgcggcccgcggtcccttgcacgtcggcccccgtcgcccgccccgccccggcgcgcgtttccattttaaaccgccgcccgccgcccgccacccgccacccttcggccgcagccggtgcagctgtccgcgcgtcccggagcccagggagtggcggaggctgcggaaccgccgagctgtgcagccggagcgggaggatgcgcacgggccccgcgtcgtagacaatgaagccgcgggcgccgccgcctgccctgggccctgcgcaccgcggccgcacctgccggcgagagcgctctagcgcctgaccggccgcctcgcttggccccgccggcccatggctcggcgccccgggcccggaccccggcactcgggcggcgcggcgcacgggccggcgggtgccaggggcgccgtccccgcagcctgagtgcggccctcgcggtcagcggggggcgtgggccacactcccggcccgcctgccctccccgcttggcccggcgccctcccggcccgcgggctcgctggatgcggcggggccccagcgcgcgggcgacatgtacttgttggacggcagtggcgagcccgcgtcgccacccgcggacgcgatgccgcgcgggacgccccccagaaagactgtctaccgcatctccgtgaccatggtcaggaaggagcagctggccgcgccgggctccggcggcccggacccacgcccggttcggcggccccggcccgcgcgctccccggacgcgcccgggaggcttgaggaggaggccgaggaggcggagggcgccgaggaaccggagggtccccggccgcgcgcttgggatttccgcaccttccgcacccgcagcaccgggcagctggaactggggcggctccggccgtgcgcacgcggcctggaacccgcggacctggccggcagcgccccggccgaggaggagggacgcggctcgcccgcgtccggcagccccgacgtggagggggcccgggccgcgcccctgcggcggagcctgagcttcaggcactggagcgggcctgaggcgccgcaaggccggacactgggcggcggaaggcgccacagcagctccgggagcctggcctgggcgccgtgcgacgaggccgcggccgggaccaccctggagcccgcgaccgccacgcagcccgcctcggagaagcgcaacaccctggacgtgggcgaggtgctcagcaagaacgacgcgctctcggacctggagcgttgggaacgcagtaagagcaagaaccgcacgctggacaacagcgacctgcagcggctggagcgcgcgcgggcggcggccggggccggcgcggcctcggagcaccggctgctgcgcttcttcagcggcatcttcgcgcgcagggacgggggcccgggcggcgggccctcgccacggagcggagcctcgcggccacgcggctacttcagcctgcggcgggccccggccgaagcgcactcgtccagcgccgagagcatcgacggctccccgcgcagaggtgggcagcgtggccgggggtcccgggacgggaaggggcgtggtggggacttgccggttccgcagcggctatgggacccgccctcccgggtcgggagcctgcacgtggcctcgagggatgcgaactcgggtactgcggttttccccagcagggcgcagcggtcctgggttttctggctgcccctgcgcctggctgtgcgtgctggtgcccctcggagtccaccaccttcatcaaggagagcttgacccgggagaggtcgccttgccagccggcgccgacctccttcgcgtgctcgctgggtcttctgcgggagcgggccctgagctggctgcccgcgacacctgtggggccgccccagggagccgaggctcgccggtcgccgccgcacaggtgcggctgcctggatgggagaagccggcattcatcctggcgcccctccctgcctcgagtcgtctccctgttagtgctaccatctgtcagtgttgtgatgtggactcagctgactccgtggccctcggtattgagctggctgtaaggacacctcactacagtggtggggcctggggtgggacggaggcccctctctccacagctttcctgccaggtggcatcttaatgaggagagcgagtctgggactggattctgtttcctcataatgtaggctagcaaaagggcaggaaaaccgcagccctgcagcctgttctgaaacctcaggtctgtgttcccttaagtcctcagacagggactttgcatggagggatctccagccagatatgttattctctgcaggaatcagttaaccttttggtagcatttcggggtcagagcctccagaaacctcaaaacacagactccatcaactgcgcatcaccctgagggggattctgggggtggaagtggtgctagattgctacaccttattctcctgggagggggttgtatgcctgaagatattgtggccacagacaagaggccatgcatttttaccaccaaaaaaaaaaatattattcatcctcttatctgaattctttaacttggctggtacagataaaggtagttggagagtgggcttttgatttgcagttcagactgctgtgtaacccacctctggagagggtattcatcccaagtggacttaacaggtcagctgactgcccctagggtttatgttaaaaccaactcatgcaaataaatgactgtccttatggaaatatttttaaggtaaagtgaagataaaatggtcatgttctaatatgctcctaatgatcctcagaatgtgctagaggatggttgaaaccaagcagtggcatgtgcggtaatgttaaaatctgacctgtttcactagtgaggctacactgttgccacacttatgtttagcttgtcatggcacatctagttttaacctcccttggagcacttactttagaaggcactgtatttaactccaaccattatcccatcccttcatgtattctcttaaaatatgagaacatgatgcgtgttattttgttaaaagaattggtttgcacgaagttgctcctgtcatcattggctttcagaggaagttaagacctgaaggtctcagttctctaatagcaggcttgcatctttgctctgtggacttggaagaaaacagtaattagctgcctcggttccagacaagtttgtatcagagagagaaagaaaaacgcacagacatgatttagagagaatgcatttcattgtggtccctcttgatacaagttaaaagcatttggagtttggatagttcctctctggtcaaatggattgatagtagatttggagtagtaagggtgtgaagtgtgttggaatgtttatagtaatgctcagtttgttccttgtggtcagtccttctctgggcggaattactttggtctgagacatgatattaccagcattgtgggttgtatagaaaaacggaaatttaatgaactacattatagccatatggtcagaactctagggcctcacttttttctgaagttctaagtaatcacatgctcaaaaaagctacatctttcacctggataaattctttgcctttggctaaaatgtctgacatgtcaatattcttaggattttggtgatgccagtgtctgttacaggtaaaaggtgtagcccccataggtgtcacaacttctcattttattacatttttccagtctttacatatttgcttcctgtgacataaattattcagaatttaggtgctgtttaagattttgaatttaggtgagaatctctaaggtaacagtcagatacagtagagcccaagctcagtttccctgtaaatgtccataggatgcaagtccccaaaccactggggacaggtgggtttgtaggactcggaaattttggatctgaggaaggtaaaatggtgtgtgttatatagaacgctgcttgtgagatcgggtggcgccctttagtaacacactagtattttgcagcaaagcctgaaatatccatactcagtgaaataaatagtgattaaaaatagcctcgtgccagttagagtctggttttgccaccaaagtaatttgccagccatttatgaaaagaagttccattctcagacctttttggatttcagattgacagctaaactatcgtagacctgcaacgtgataagcatcatgagaagcaccactggctttctgtacattttggccataatgttttaaaatttggagtccttgaaaatataaaggaaattagaagtgacctcagctggtacaggtttttcttccgttagaatcttttcatattctttaaaagagctagtaaatttttgaattggctacagaaatctaaagactaagtaattattgcattagtctatttggcttagagttaattgcttaggcaaggtatttccattagcacagggaagcaagatggctggagtcttattttaaagcacacacaggctcctacatacgtgtacctttggtttgcctgtattctgaactgaaggcattaaggatgaaaggattggagcacctaccttttgtaggatgattctcttgtactgtctggtccttgttggaacttgtctatttaggctcttcctagttcttccctctaatgcagaacagttgcctcggtgagttcagggctgctccctctgtgtaaggcttgcaactgatagcagcaagccagcagacattccagaaagaccctgtgtcagatcaagggcagtttcgtgttaactgatacacatgtgttagggcagagtccgttgactcaagtataatttaatacaaggaaagatcaaataataaatgataaatgacattgtagggggtccccttgcagcgcatgctctctgcatcccagtggatgccgtctgggccggccctggaaccagctgtgctgtgagtgaagcccacactggctatgcccatccagaacattcggtgtctttagagtgttctcttgctgtctgggaggattgattacagtaataaagtgattcattgatacctcttactgaggttagcttttaaaattagtaatttacaactgatttttgacagcacattttatgagtggctttgttctttaatttctgattcccttgatttgtatcagtcaattactgtagggtgatagactttttttttttttttttgatggagtctcactctgttgccaggctggagtgcagtgagcgatctcagctcactgcaacctccccctcccaggttcaagcaattctcctccctcagcctccccagtagctgggactagaggcgcatgccaccgcacccagctaatttttgtgtttttagtagagagagggtttcaccatgttggccaggatggtctccatctcttgacctcttgatccacccccctcggtctgggattacaggcatgagccaccacacctgtggtttttttattttattattttattatttttattttttaaaccatttatatttttattttttaaaccatttaaaacaaacagccttcagtggagaacgtgaggacacagcaattaaatgaaataaaattactgaaacaatttgataaagtttgatttttaaatttgatttgttactgaaaaggacactttttgttggttggttggttggttggttggtttttttttttttttttgagacagagtctcgctctgtcgcccaggctggagtgcagtggcgcgatctcagctcactgcaacctctgcctcccgggttcatgccatgctcctgcctcagcctctccgaatagctgggactacaggtgcccgccaccacgcccggctaatttatttgtatttttagtagagacggggtttcactgtggtctcaatctcctgacctcgtgatacacccgcctcagcctcccaaggtgctgggattacaagcctgagcgaccgcgcctggcctgaaaaggacactagtaaggaaactatgtaattcagtgtttctcatttgaaacattttgaactgattagtcttttgttattagaattgattatctacagtgttttgttgttacaattgaacattcctagagtttgcttgctttttgtaaattactccagatagcaatttaggaaactcctcattatttttgtttagggctaaaatgattctcctggagacagagcagttgtacttggggtacaaggaagagctgtgctgaacgtcagccagggaaccttctaagtcaccgctgtgggctgtgtcctgctgtttatttccttaggttggagcccaagtttcagcataggtcacctgttaacatctttctctttgataagtcatcaaagagacttgggctggaatatcctgccaccagggggaatgttcaaaagtacatctgctccagaggtcctccagtgttgacaggcacattgtagcaaattattgggttatacagttaacaaataccttttgtttggagctgtaagacccaattataaagcactagtagtttttgtctttttaatgcattaacaaacatatattgcatgtttatggtgtgttctgcattcactaggcagtggaagctggagctaactagagcacagttcctgtcttcagaggtcagtagcatactggaggagatggaaaagattgaatgaatcacagcctcatggggtacttgagggatgatatgactatttctctgcatagcatatctccattagagcactagtccactgtgtaacaataaccttgcatacatgcctgccacttctaactagtgagtccttcctgggcatgaagcacgtatcattcctctgtgtactgcagagttgtagacactgtgcttgacacatagattttagtaaatgtttatgggtggaactaatgagagaactagaagagggagtgaattgaatgttcttgagttaatgggaaggagttaatgaaggcctcacagaggggcaaatgagctggatcttgtaggatctgtaggagtttaccaggtagagaagagtgactccaccagcaaggtgtttgggatttctatagttaattgttaagaatttattcctgttccccagatccttatgactaatgccaacactaaacataaaacaggatgttactctttctacaatgagctttggtgtttttgtttttgaaaaatattttcggtatatggtttttgtttctgataggaattctcctttaggctattgtcaatttgttttcctgtaatgatttgaaacaattatattaacttaaaatgatgtcacaatgagtgaaataatgaaaaaaagttatagttattgagggtagtctcatgatgagataaagtgcatacagctgcactcatgtcgccaggtgattaagaacagaattggtattaaggtcaacggattagcaaaaagggaggagattattgtcttttcattattttgaaagaagtaccatctgcccttgattgttttggtttaggttttattcagcccaaattagaatccgctgtggtgttgattgttccttgttggtgatagccctagaactgtgtttcccatcgttgatacttgcattcacgtttgctagttctctcttctcctgtgaagacatgaacgtagctgctcctttaattacatttagctagttttaattcagagatggctattggccctttgttttcttaccatcttttattgtgttcattttcctagttgatttttaatggtgacatcactaacagctctaaagactcaaagcttaccagacagcacgcttccctgggtcagaagatgagagtcctctcctctctcattcagtaccagggtgtaccagtgagaggcttgtgaagggattgtttcggcgactccttatctaagaaatgaagataatttttatgaggtgcattttggtctgtgggagtggaagggaaaatgacggtttctttcctatactgtcctttgtttggaatggtgaaaatgttttgaatctgtttctggtgtgatcgttaggtccaagatttcacgtgacgttgtgtgccgggtgttgtggtcaacacacaggaatgctcctttattctctgtacggcctttgggtgcatcatttgagtggatgttcatttgcttgagacgattgtcagagggaatcttgtgtgccctttgctctctgtgcctgtcattgcgagggtttctttgagccggtctgctgaccgtcaggcacttgagattgactcggtgaacaatgccgccagcctttctgatgcggctcctgccctctctgactcctacacaggatcagaatcactcagatatcacttctgttggtggaggcgagagaagaatatttatccagtttctgcctttctgcccccattagctctttaccaaaaaaaaaaaaaaaaaaaaaaaaaaaaaaaaaaaaaaaaaaaaaaaaaaagcaaaaccagttattctgtgaaaatatgcaaagcagagttttggccttgaggatgcgtatttgtgacttgctttcctgtacagtaagtgctgccgcctcaggagcgggcgcagtcgcttatggtgccggtgagcctgcgcggcgctggcttttgctcctctggtgccaatgcagctcgttgacagctccaagatatttggatatctcactcttccggctatttcagctgccaaactagaatcccaaccttctgagagtctgttctcttttggatttgttcatagatgtctattctctcctgatctggttcatgaacactctggaagccaagttcattgaagacactctggatgtgtaatttggaagaggagactggagcatggaggctttgttcctagtattagagaaacacatagaaaggacacagtgtctagcgctggttaaggaaacttaaaggaaaaagattggggctcagaattaggaagtaatttctcacaagcatagccattctgctttggaagaagctggcttctcctatcactggaggcacccagactcgggctggcgagggattgttaggacgggggctgtgtgtgttgttgctggtagaattgatggacttcaagtcccatcctagttttcaaggtctagagtcctttcaggatctaggatttgatttttgtacctggtcttctctcagggggtagttttctcccaggcttaaaggaagatatttgtctggagtttctttggactgtcctcctgcctgcctgcctccctcccgcccccaccttgggatcctggtatattctgccggctcacctgagacgtagtaagagttctgcctgtcagctgcaaggtgctgggtggaaggtccctgcttcccactcccgctctcctgcctgccagccccacagtagtgctgcctgggcttgtgtttcgccatgtagcccctctcgataccgatgccatttgtcttctgggcatccagatggtgagtggtggctgggcatgatcttaatcggattctccctgtgcacagccagccttgactcgaaaactgatttcaggtgtgtggataatacaatgatggcggcaagaaagaaagaatgcttttctgttggttgttggaacacatttaaattgccacatggagaaagcacagtgtcttgatttggtggagtggatttagtcttgacaacaatacttcggttagtaaggtgattctgcctagttatctacatccctgagctctgtctaccttgtgccagtaaacagatatgtcactgtgcagcccagcaccatatctttgctttactttatttagctgtaatacgggttttgcaaaagacctaaaaatagaaatattgcatatgtggctgtgtttgcatttatagttactatgagatatacatttgcccaggtggatttcttatatcccgaagctccaagtataagccaaccttgtattttgctttcactgttttcccctgtattttctcatgatcttcaatttaactacttcctttaaaattattgaccactgttaccttaaaattataaatggggagaatagagttctctttttttcctttggcttaatccccttcccactcctcttattcggaggagtagcgattacttggcagcatatggattcgtctcattcctggtacaagccaaatatgtgtttattttggacagctagtctgagtgctgcgtcccaacatcacctttcctaatccctgctgtgccttctcctggagggctggcaccagagagcattgcctggaaagcagagtaatctgtgctcttgagattttagagaataaggatggatattccttgttgggcgtgacttttagtcttcagagtaagaaagcactgacacagtatattgatcaggtttgttcagtggagtgtagtaaaggtcatttggtgaattccgtattttcaaatatttaggtttctaatatgatgcgaatggtgttacgtggatctgtgttgtactgacgctgacattttgactgtcgtttctaagtaacgtactactactttggataaaaagcaccgtggcttaaccattgaagataatgttacaaacttagatagtggttgagctagcaagtaactagtgagaggaactttagctctatatgcaggagatcagagcacagggagctggccccctggctgaccttccttgtgggctacccacgccttgcaactgaagagcggtaattaaatatatattcatagaagagtggtaaaatctgctttgtccgtggaaatgagctaaaatattaagaattcaaggatgttgggccaggatttgggctttaatttggcgcgggagaagtgttgggcctgagcccttgtaggggtgggacagggcaggggtttgagtgtgaatgctggtgtccagaggggtcaggggccctgcagccccctctagaagctgtgacttgggaagcaccctcgtgtccatttggacccgtctcaggtgacttgatgtgtgtgatccccccatctctgttctgtggctctctatgggcctggggaaggggtcccaggcatcctcttgaagccatgtggggaggcaccgagagcaggaggctggcttctcctggtgtcttgtccttggcagggagcaagtgacatccattttgactggtgctgacagggtgaatgtactagcataggtgtgtgcagctggggctgtacctgccaggagcatcctggcgcgggtctcctgcctgagcttctccttgttgggaatgctgtccttaggcagatcctcattttcaggcctcaccagaattgcctggcctggtgggaagagagtggctgcgggctcccagaggttcagctcagagttctactccacacttcctgggccagcttccgcctctgaacacctgagctgacactgggactgtgaacccagataagatgatcatgctcacagctgcagctcaggatgcagccagctgtgtttttcctacttcctctcagctgggcagtttgctggcctctgaaaattctagccccccctcccccttttctttttaggcagagtgtcgctctgtcgcccaggctggagtgcagtggcgccatctcggctcactgcaagctccgcctcccaggttcacaccgttctcctgcctcagcctcctgagtagctgggaatacaggtgcccaccaccatgcccagctaatttttttgtatttttagtagagacggggcttcaccgtgttagccaggatggtctcgatctcctgatctcatgatctgccctcctcggcctcccaaagtgctgggattacaggcgtgagccaccatgcccggcaattttagcccttttgacacactctatgacccttcttacgcgcctcccgaggaggaagcatgcactagagcgtgactacaaacctggtgccatgctagagcgggagaggagtgactgcaaacctaggcctctgtcctgtcacctttcctccagctggtgaaccaccttgtctactcccttgccccaacacagccgacaggtggacagccagacacatgcagagccattgttttttcaaagacctgttaaagtttaaaggctttgttcactcattcttgagactaacagttcaagttcacaagaataaatgtggaatacagtatgcacctaaaaatataatacagttttaattttcatctgtactgttagcattaaccagcacttactgaataatgtcctcttaggactctgtgttaattgactttttaaggttgattgttaatagagcagtaggttgggaattacagtattggtgaaatttaactgtttttcacgtgtgtatacctaagtcctataaagggtctaatttagtttgctttttttttttttttttttttttttgatacagagtctcactccgtcacgcaggctggagtgcagtggcacaatctcagctcactgcaccctctgcctcccaggttcaagcaattctctgcctcagcctcccaagtagctgggattacaggcatccgccaccacgcccagctaattttttttgtatttttagtagagacagggtttcaccatgttggccaggctggtctcgaactcctgaccttgtgatccacgcatcttggcctcccaaagtgctgggattacaggcgtgagccaccgtgcttggcctcggtttgcatattttatactgtgttatgaaaccgtatcagcactgttttttttgtttgttttaatatagaaataatatgtacgttgtggactcctcctttcaagctgggcatatttcattttcactctgaactagcttggtggccaagaatgaggcgtctggaaccaggatcctgttttgtgggggttttgttttgttttgttttgtttgagatggagtctcactctgttgcccaggctggagtgcagtggtgcactctcggctcactgcagcctctgcctcccgggttcaagagattctcctgcctcagcctctcgagtagctgggattacaggtgtctgccaccatgcctggttaatttttttttaattttagtagagatggggttttgccatgttggccaggctggtcttgaactgctgacctcaaatgatcctcgcaccttagcctcccaaagtgctgggattataggcctgatccaccatgcctggcacagaaccctgattttgcttctagatttgtgacctttagcaagttatttaacttgtttgtgcctcagttttctcacccgaaaaactaggactgacaatggcatttaacctgctgggcactggtgagtgaactcgatgtgtgggtgtgtgcacacgtgtgtgtgtgtgtgtgtgtgttttcaggcagcacgagcacggaattcatgttccggtctgttgccagctgctgtagttcttttgttgatggactcatctcaccccctccaacacagggaatgttctggaaggaagtgtggctaccctgccatggttctgtgtctatgggaaatcttattctcctggaaaacgcaaagtaaattcttccctttaagacagaactgagggccggtgcggtggcttaattcctgtaatcccagcactttgggaggccgaggtgggcagatcacttgaggccaggagttcgagaccacctggtcaacatggtgaaacccccatctctactaaaaatataaaaattagctggacatggtggcacacacttgtaatcccagctactggggggctgaggcaggagaatcacctgaattcgggaggcagatgttgcagtgagctgagatcgcaccactgcactccagcctgggcaacagagtgagactccatctcaaacaacaacaaaaaagacagaattggtaaaaatactgatcccttggaaagaagtaactattttagataccattgttttattaaaaatgtacttgcctccctcatatacacatattgatataatgccatctacatttgtataatttataaatattatacaatacttaatacatattatatttaatattaataaattatacaaataaaacttatagattataaaataagtttagttattttaatatttaaatgtgctaaatgtaagtttgtaaaatttaggaataacttgttagaaaggtgaagaagctctggattgaaaggtatgtgctgaggtcaggagtccagcttgctctcctttgaggagatggccttgttttttctttctctctctctctttttttttttattatattttaagttctagggttacaggtgcacaacatgtaggtttgttacataggtatacatgtgccatgttggcttgctgcacccatcaactcgtcatttacattaggtaattctcctaatgccatccctcccaagccccccgtcccccgcccggccccagtgtgtgatgttccccgccctgtgtccatgtcttctcatttttcacctcccacctatgagtgagaacacatggtgtgtttggttttctgtccttgtgatagttttgctgagaatgatggtttccagcttcatccacgtccctgcagaggacatgaactcatcctttttttgtttgtttgtttgttttgagatggagtcttgctctgtcgcccaggctggaatgcagtcgcacgatctcggctcactgcaagctccgcttcccgggttcacaccattctcctgcctcagcctcccaagtagctgagactacaggtggccgccaccacgcctggctaattttttgtattttgtttagtagagacagggtttcaccatgttagccaggatggtctcgatctcctgacctcatgatccacccgcctcggcctcccaaagtgctgggattacaggtgtgaaccaccgcacctggccacagcctttcttaaggcaatcacgagacccagcccatcgtggcctggtgaaggagcaagccctaggcttcattctcagtttggaaaaaaccgtcattgcccagaatgtcccatttacacattaattcctaaatggaatgatgggagcgctgggtgctcagaggcttccttttgaggatttgccagctgcttctggactgtaacttttgcagcaacttctgcactcattcatcaggtgcagagcagtgtcttagaaatgagtgagtcttagtgatttcttggagtgtggatccatacacacttacctcttttctgaactatagatgggaagctgctgcaaaaaagcaaggtgcagcccctttcttgtatgagggaagctactgtttaccatccatggctgcttgagtttttagagctgcgtcagatgaataacttgttggtatcactcgtcaatcttagaggcactttcagagattaggaattgtgaccaacaggagagactatctggcattaggaacaccagggcctattttggatcatgctgtactgcttacggtcatgccctgtccaatctgggatgactgtggcatacaagtcaccatggccattgtgaagcccttgttcttggagaccctgtgctccaggtgtggctggttggttccctgtggcaggacccccagaggccccaggggttgtgagagtcaggggtgtgcaggttctgagggctttgctgggtgggccgaggttgagtgggctggttgcagaatcctggtgcccagagggttcttctttgcctgttgctggggactcacgccttgtgaggggacctttctttattaccctgatgaggacagaagagttcctgagaggaagccacaagccgcctccctgacctggcagctgcctgtgtgccctggtgtgtgggttcctcccttcctgggttcatgcagcagactcttggcagtgcaggcctccttccaggggctctcagggctcagttctcatctctctgggtcacactgagccctgctgatccccctcctgtgtggctgcctctctgatgcctgaaacaccttcagctgttagtcccacggcctctcatcacctcgatatccttttctgcttgctttctggttttcagtggctgccagcagaggctgtaatgctcccctgggacctgaccagtagagaacaaatgctatgaagaccagaggcccctcactgctccacgcgtatacagggtgcgtctgtctggacagccgaaggcccatgggtggttttgttttcaaaacacaatgaaaaatgactagtcatgccatattgttagcacctttcgattttttttactgtaaaaatcaaaacagaaatatttggctccagagctctgtgaaccccgaaaatttgagacgggtctcagttaatcttgaaagtttactttgccaaggttgaggatgtgcgctcattaacacagcctcaggagatctaacaacatgtgcccgaggtggcctgagcacagcttggtacgttttagggagacatgagacaccaatcaatacatgtaaaataaacattggttaggtccagaaaggcaggaccactcaaagtggggagggggcttctgacattcttttgagtttctgatgagcctttccaaaggaggcaatcagatatgcacttagtgagcagggcgatgactttgaatagagtgggaggcaggtttgtcctgagcattttccagcttgaattttccctttagcttagtgattttgggggcctaagatttttgttttccacaggtctttttaggaattttaaagatgtatctcatccagtaaagctgaagtccccccaagtggtagctgaccatagactaagcctcctgctgtacggggcacccgctgggagggaagaggtgctggccaaggtgaatagatggtcagatgggcgataggaatgaacactttgccatggtggatgtgctttagtgatagaatttgttcaggagattatctttgttcctggtttgggaaggcagagcttctatattggaattctttgtctcccagaataaaaactctaacatcacctgtattatattgtggggattaaaatcatgcacttgtagccaaacctaggtatgagtgtgagcgtacactgctgacagattgaaatttgacgtccgaattctggttcccaggaaggagatatatatatacacacacacacacacacacacacacacacacgtgtgtgtgtatatatatacgtggagatatagatatatatatatatatatatatatagatatatatatatatatatatttttttttttttttagacagagtcttgctctgaagcccaggatggagcgcagtggcgtgatcatggttcacaacagccatgggcttaagcagtcttcccaccttagccacccaagtagctgagactacagacacatgccatcatgcccagctaattaaaataatttttttttttttttgtagagatgaggtcttactgtgctgcccaggctggtctcagacccttgagcttaagtgaacctcctgtctctgcctcccaaatgttgggattatgggcctgagccactgggcttggcttaggaaggctttttgaataattatcttcctcactcttctttccacccactctccattcaaccctgatgaaccctgctggacttcattacatttctgctcacttgacatgcagattgcagatcaggtgggcgggagctgataacattctcacttggcctcagtttcctcgtatgtccaatgaagggatgcaccctagctctaaaagtaaacattgttctcaacagaagaatctgggcatttgctatcaaacagattcccattcttcaggcagttaattttccacaccacaggagatgtttgtgacatttcccatttctttgaagtctaaagtagatattgatcctttggaaggagattaagttctccggttccatcaggtgtaatgatttcagttttagtgttcctaggtggggagtgctaacccaaacctttcatatgtaggaatgtcatccctctgcagacctttgagtccagatttcatttgtagttgacctttgggggtgacagtccgatatgtgtaaatcgtaatagcccttcatcgtagataccagtttaaaattcattttaggtgagtttccaaacagatatattggatgtatatcagtttaatttgataaacatgcagataaaaacttattacatgaggaccagtgtttgaaagatggcttacatgacctgatgagttttcattttgtccgtttccaaaatacacaggaatgcaggaatgccaccttcgttcagatcagacttatcttcttcgcaggatgtggccagagatttatttaagacattagctgtgatgaggaaggtcagataatttaagcaggggcaaagtacacattactgaggattcagcgctctttggtagaaggatgtgttcctggattttttttttcttttttttttggatttttcttcttaatcgccgctctctgacttttttttttttttttttttgagatggagtctcactctgtcacccaggctggagtgcagtggcgccatcttggctcactgcaacctccgcctcctgggttcacgccattctcccgcctcagcctccagagtagctgggattacaggcacgcaccaccatacccagctaatttttgtattttcagtagagacggggtttcaccatgctggccaggctggtctcaaagtcccaaccttgatcaagtgatctgcccacctcggtctcccaaagtgctgggattacaggcgtgagccaccacgcccagccttgccctcggatcttgaacctcctgtctactcttgctgggctgtagatggacagaggtgtcagtattttaggagtgtgatctctccttttgctcattggtgtttgaggtctgtggtgtctgtttggggagcaggtgtgtgcaggaaggaatctgcactctccacttttgctttcccaacattgtttttttcattctctctggaaggtcatgacggtcccctccactcactcacctctcacatttccagcccctctacttcagacagacttccgaaactttctgcctctcttggggtactttagtatgccctgcagatgtaagctgctttcagaaaaagccagatcctgccacatgagactgcaggccctactagaatctgttctatcccacatctccagttataggtgggtgggaagtgggaattggaattttttccttttgttcagattttcgtcatgaccacgtgtgtacccgttaagactagacaagggagtcaccgctgctgaaagaaaagtcattgtgtattcattttgcattggaggaaatgagcattggggtgctttggtgacagcttggaggagcaggggagtcagtggcatgactaggcctgggtcccctcatcccgcccctcattcacccgctagtgctgtttgagggccagaaccaactgtgcctgtgtttagactgggtttgttgctgtgtcacagtaacgcaattgcagcagcagcagccgcacccgtgtaacgttcgccaagctgggtactgttggaagcactttgcttgcatttgtgcagcgattccagcaacaaccctgtgcggtagattattgtcccataaatctataagattgattgattggttatctgtaggagacatctacgtatacgtatttatagagcaatgaagaaataagcccaaggctatcccatgagttaggggcttcagggcttctgcgctttgctggcccttgtgctgccttcggtagatggccccggccctgcctatgccttggacactcttcattcgctagcaccgagatggttcagggcactttggagctagagcaagagcaatggagagagtgaggttgccgtgtccacaagtcactgcacagctcaccacgcgggcctggagtgagcctgctgctgttcatcggcccgtagggtctccagcacaataccgggttagtgagcagaaagtagtgcactgattatgtttccattacaccatagaacataacaattttgactgcagagaggcaggcagaatagcttgtccaggaaaataatagtgcgtttgtaagccagagaaagatggtactgtgtggtggggaattctgaaagtcttaagtctgtttctcaactcccctcttgttttcattgtttcaggcaaataatttctgatggacaccaaattggcaggtcaccatagggacctcccctaacctcaaatctgtgtaatgaagtatctgcaacatttccactcatttgagagttccacttttcaggacagtcatagagctgcactgttggtaaactgtcctgcatgtgtgtacgtgcacacttgtgtgacgtgtcagctcgtgcctgcagagactctgccagcagggctgaggctgctgccaggagagcatctggggtggtgtcctacacctcctttccaggagtttctgtgtgcatgatgcacttcagaacctatagtgtcatttgtggtatttttttttttaaatactgcttttgtttattttccctggtctaattttttcagatggtaaatagatcgcgttgttgcatgcgtttgatgaaagtgatatcacagcaaatgcaaaggtgactgggagttctaagcccctgggtgtctctccctcggggttttcatgcagtattgacactctcttctccccaggtgctgagtccccaggttcccctctccccctacctgaggtactgagggatctcacttgctacctgcttggagccagtccagtggcttcacttttaccactcagagaactttagtacacagtcttaaacaaccctggaatgttgagctaaaagggactctgaccctccctccgcaccccaccctttaaaggtgaaagcagcaggtggggtggactcctggggctggggaggccgtgccctgggggcaggtgcaggagggagcctggctcttcaggttaaattgtgtttcaaaggcagagctcacattggagcacttgatattatgcatttgaaacattgagacacagcttctagtttaaaataaaggtgatagccaaggaggaaagcatggtttattcctagcttccggtagaggaggctggccaactcagacacctaagcagccacatcagacccagagtccgaggtagaatggatattgctaaagctgagagctacagcagagcgtctgcttgaggagctctgacgggctgggcagccagtgctcctggccctgaatgtgtttgaaggagctctttggaaagaggtgcaggcttccggctattggtagacacctgtctgcttggggcaggtatactgactttttgttgcttttacggttatcttcgggtaaagtcattgtgtttcttcttgatttatttatttttttctccagtctagtcatagtattggtttcgagaagtcaaaatcaatgttttattttcagagttctaaatccagccatataaatacttcggatctggcctgagggtttggcagggattcgtggctgctattttagatatgccaggagccttcttggaagtcgctcaccacctggttttctccaattaggctatgagcctgtatcttagaacactcagattagtgtgcctagagtgccaaggtgggggttgtagacaagattctaccccctcctccagactctgctccctaggccgaggtgaggccagcaaggagtctgccccatgcgattctgaggccttggtcccttctgagagaccccagccccgagaggctctgggctgctggatgctggtgccttttcccaccgtcaatcaagcacatgcgcatagggctctgtgcctggccccaggactgtcatatccagggaaaggtcactctctggcagtggatgctaccctgttggtggcaagttagaaaggcacacgttggtaatggccaatggttgccagtgccttacttttggagacaggaattgttacacgtctccgttgcgagaagcaaaagtagatttaacacatctttaaaatccgctgaagactgtaaagatactcatttgagatgtgccaacatttagtcggattctgtgactggtcgtgagtccctcttcctccacacagcaacactggttctaaaacagtcggatagccgtggtcatttgtggatgtgagcacagccaggtcccatgttgacaagtgctggacagtggacaccagcgggagactcagtacaaatcatgttgctttgggcttatgcacatctgcagaaggctgcaagctggggaactgaggggcctcttggtctggggaccacgcctcccttcccttccttccctgtcctgagtgtgacctccgtcatgttgacccctgcactcctgcccgccccccattcacccactaggagaaagtactggatagggatgagcttggggacaatggccagtgacatccaggagagggaacttagaggcaaggcagggatgcaaaatcggagttcctagtagaaacagacatgcagcatattgtgaaatgtttcagagaaataacagcatcacgatagcacattctctagttgctggttatctagttactagtggtaagacagagccagttaacaaagactataaagttttctcaagaggatgtaaaccaagtaaacaaaataaattcagaccccaagtgcgcatattgagtttgaatattcatctaagaagcttttgtacatgcgttatgtatccataagccaaagccgggggctccctggcagatgcccctacctggccaggtctcgtcgtgtctaggtggtgacagccatgtagatatgcccgctgccttgcacctgttcctctggcctcgcctctgtaacagaacgtggcccctgccttccatcttccccagggtgccagtggggaccttgccttctccagcactgggccgtccactttgctcctttgtgcctgcactgccaggtgcacatcgagcctaatctggcttaggaaacaggaggggcaccagctagaaaatgtgacccatgttgccaactcccaaaagccaccaggtgacttccactgccgttagaatgaaacccaaactctgcactccagccccagcatcaaaccatacttcgccctgctgcccctatgctctccccccttgccctccccccttgccttcctgggccatccttttctgactcagcctcagtgcctagccagtgggttcccctcgctgaccctcagccctcaggcccagcacctcagagaagccgatgactgacgtgcaccccgccagcctccctgcttatccttccctgccgcctcgtgtgtcctgcatggcatttgttacagcccgcagtcacaggtcttgcggtggacttgctggtcggctgctctgctgattctcgaaggcggagtcagggtgtgcttggtgtgcgtatctcccttgatgtggcactgcctggctccggagatagcgagggagggagggaggcagtgagcaggacctgttgctgtcggtggtggcatcagtggagttggcaggtactgtgcatgggagagggagtgtggcctgcaggccagtggctgaggcccagtgtggactgtagagtgtcagattccacttgctggcctaggggccttcctgatgtgggctgcggcagtcaccactggggaaggccatgcagaggctgactccttgggaaggaggctctggaaggagagcatgtgcagaatgtttcctgcagtgcctcttgagctcccgcctgagggtttgctcagccggcaggcctagaggagggggctttggggctgcagtgcagtctttgcaaagggttcaagggtcctgaaggtggtggcactgtggccttaggagctggggtagtactcaaagctatccccaagtaggcacgggggctgggcctttatgcctgtcaccagtctatgattggacgtgttctgccctccaggggtcatatccttgggccacaccactcacttctctgcccaagtgcagtctctggcatggggactcagcctagagtgatcagccacctgcactcccagcagccaggtactgaaggctttacccctgaacagagggacaggctggtgcccaccacagtcatgcgaaggcattgcggaaagctctcattaaaagagcattaagccaggcctggtggctcacggctgtagtcctaggtactcgaagctgcggcgggaggatcacgagctcaggagttcgagtgcagcctgggcaacatagtgaggcctcgtctccaaaaaaccccacaaaacattagaagtagtagtacttgctattctcataggaggatgtagaaattagataagagttaactgagaatagatttgaattagcttttattcccactgaaaaaatcagaaataaacttgatttcctctggcataagtgtgggtcctgtgagttgatcctcagcccttacttgggggttaatgacgttcccatttgaaaaacatggcagtttcaatgtctgttaatgttgcaaagcataccaggaacattttataaaaagtaacagaaactaccatgtgattctggaagctgcatagttaactgtccatttatcttgaagtctagtgattcaaagcatgaggaataagatcgggaagctggccagatgtggtggcttacacctgtaatcctagcactttgggaggctgaggtgggtggatcatctgaggtcaggaattcaagaccagcctggccaacatggtgaaaccccgcctctactaaaaatacaaaaatttggccaggcatggtggctcacacttgtaatcccagcactttaggaggccgaggcgggcggatcatggggtcaggagatcgagaccatcctggctatcatggtgaaaccccgtctctactaaaaatacaaaaagttagctgggcgtggtggcgggcgcatgtattcccagctacttgggaggctgaggcagaagaatggcgtgaacacgggaggcagagcttgcagatagccgagatcgcaccactgcactccagcctgggcgacagagcgagactctgtctcaaaaaaaaaaaaaaaaaaaattagctgggcatggtggcagtgccctgtaatcacagctcctcgggaggctgaggcaagagaattgctttaacctgggaggtggaggttgcagtcagccgagatcgcgccactgcactccagcctctgcaatagaacgagactccgcctcagggagaaaaaaaaaaagaaaaaaaggaagctgctaccttcccaaggacacttgctcctcctcgtcttgctcaggcatctcctgggcacctttcggggcaagtcctgctgtcactgcacagctcaccttgtatatgtggggtgctcttctcctctcctgaggagttatgggtgattaggaagcaaacgcgtctcagacttggagatcaaatgaagagaggctgtgtaagcaccaggatgcatggggggttccggcttcttcgcagtttcacctggtttaacccaaaggcaagcaacagggatgcccagggcgggtgagaggtgctgagcggagctccatagttggagaatgtaagtatttaaaaattcttgtgtctattttactattaaatagactgtataacctcaaaaccagttaagaatctttgacattcatggtgtgaaggatgagaagctgggaaataacaaggaccttttcctcgtgtttcctccttaattatgcttgccagtgttttaagcatcgaggctgaccttcgcaggcttcagggtttcagcttgatcaccatgtggatgtggatgagtcagttcactccataatagctcttagaggtgtagaaaggaactacttctttccatgagtgcacctttattgccctatcttatagaaatagtagatgctcatcgtaaagacttacaacaggattgaaattggtaaagagaaaaaggcaatcccctacccccgtccctcagagatagctgctgttgtcagatcagttggatattcttgaagacagcttccttcacgggtgtttatatgtcgtctctgtcagtcagttacatggtgaacagacagcggctcaggttacagacgatctgtagcccagtgtttgtgctcagtatattacacttgatctgtcgtggaacttttttcaagaacagacagcttttgttctggacacagtatttggtggggcctaggtctgcctgtaagcatacatattggcagagcagtgtctcttccacatctgagctggtcaggcagagggccgggcgcagtgggggcactttgctgggtgaaagaggtaagaggtaagtcagcaggggcacaaagaaaccatgcgtattcacaggagcatctgagctccaagcccagggagctgagaggggtcactgtccttcacaaggaggtggcttcttttctggacatcagacagcattgttgcaggagatactgaataaccaacccctctgtgatgtagtcttcaagttttattcccttgggtgcaccagcggaaggtctgtgctgagaacagaggagggccgaggagacacttgcatggggttgtcgacagaggggcaccaggatgggtattgcccagagggaacctgcatgattgttttgtttaccatttttcttgagacggagtttcactgtgttgcccaggctggagtgcagtggcgtgatctcagctcactgcaacctccgcctctcgatttcaagcgattctcctgcctcagcctccaaagtagctaggattacaggcgtgcacccccatgcccagctaatttttgtacttctagtagagacagggtttctccatgttggtcaggctggtcttgaactcctgacctcgggtgatccacctgcctcggcctcccaaaatgttgggattacaggcgtgagccacggcccccagcctgtttaccaatttttaaaccatggcttatgacccttaccctgagcatcagtgacaggggaaccaagagtcgtgtgaggtcccagggtgcacagtggacatttcagtgtgaagggcgggtcgggtgccccagcttccacgctttccagcctggattgtggcatcttggatgtgaggccacagaccaagctcacagggatgagagatggtccgtgtgggtcagccggctcaacagaccttctcccaggaggctgattagatttgctgagcattacaacctgatgggcaggatttgttttaatcatgtaacacaatcacaaaattagtagtggcaccatgctatcgctgcccctttcccatgcatgtgctgcagacttatctgtgggggaaaaattatccatgccacctctcagaatgagccccgtccccaccttatacgagaccatcccagccaacacagtgaaaccccgtctctactaaaaatacagaaattagctgggtgtggtggcacacgtctgtaatcctagctactcgggaggctgaggctggagaatctcttgaaccagggagtcagaggttgcagtgaaccaagatggcaccactgcactccagcctggcgacagagcctggagactcgatctcaaaaaaaaaaagagaagtatcctaacttttgtttcattcgatttgccattaagtccggttattttagctgaaccttccccttaggtcagtgccagcccattaacctgagagaagctgggacagccccaggcaccagccagctttaggtctgcgtggaaagggtgttcttactaagagcagattctgggaggtgagagctggaagaaccggaggcagccctcccatttcacagatgaagagattaaggccccaagaggctaagtgactcgcagaaaagctgcccaggcgttccatgtagagcatggatttgaaccagcattgccgcatcgggatggggaggtgctggtttgcttgttagctgtgttgggtgtacatgttgttcgtcttcatgtgaggttgttagaagtagtttagccacattaagtgcccagtgcccccacttccccctgcaatccccgatgaagcaatgcttctctgtgagtgacatggcaggggggaccaatacctagtggactgtctgtgtctgtcacccctgtgcctgggaggggtgacccttggcttcacagactgtgctcccttcaccttgccccacggaccctcccccaaccaatttcttagtctgctcttgtggcgaaaattcagcaacagtaaggagtgagttaattctgattgctctttctgtggtaatcttctggatttatttgtgtctattattgagccatcccttattataaacattaatttcaccatgaattaaacagtatgactgactgagtttataattctttctggaatgaaaactgtcaggcccaattatatccagcccaggactgacagaaactcagcatatgaattgtaaatatcttgtctcctgcgttctttattttaaccagggaaaatgttctcgtgtctatcaacttgtcttaacttcagcaaatacagtggctcttgcatactaccagcatctaagctgcagtcgaaattatcttttaatacagcagtctccaagcttttttggcaccagtgactggttttgtggaagacagtttttccagggacccaggggtcgagggaggggggatggtttgggatgaaactgttccagctcagatcatcaggcattagattctcataaagagcacacatcctagatccctcacaggtgtggttcacagtggagcttgcactcctgtgagactctaatgccgccgctgatatgacaggaggcggggctcaggaggtggtgtgagcttatggggagcagctgtaaatacagatgaagcttcgctttgcttgctcacacgctgctcacctccagctgtgtggccctgttcccagccagccacggatgagtaccagtccacgtccctgcggttggggacccctgttttaatatacatctccacccaaactgcagtaagacaaatagctgtctactcttacatctcatgaaaaaaaaatggctgtgaatttaacctacggattttgttttttcttgcagtttctgacttgtaccttttcataaaatatccctattcaacattttcactttcaaggactcagcagtttcattttaggtgttaaaatgttttaaagcattctcgagatctgttcaaaattctacgtcttatatgaaatgtaggattctggctttggtctaaggtgacaatgttctaccgcttcttaggggtgccaggaacccctggcgggaggccgtgtctccctagtgtgacagctggcgttctggtggtggcgctcagtgtgttcctacagtcattttctcaggttcttgttattgtagcagcttgatggttgcataattattcatcatacctatcacaatttttaaatttttattgctcttcccactttagatagaagctcagttactcagaggctcaacaataaattgaacatgtagtcagcatgtgaaaaccccagggtgggtttttagcaagctcctgaaggcaggtgtctggagattagagaggagaggagcacaggggagccccgtgcccatacctgtggctggttggtggtgtaggcaggagatggtggcctggaccaccacgggcatcagacatcccccccccccaccccacctaggctcgcacaggagggacggggaggcaggagggaaagaactggtcgggcaggacgtccctacatgccccctcccttcccctccagcttttctcctactttggtggggtgttactgctggggcatgggaacagcggatgagctgggtcagggggatgggggtctagggcttggggagacctcctgtagatacaggcagtgtctttggttgcgttgtcttgctacagagagcctgatgtatttgtaagaagactaagaaggttttggatgatggtgatcaggtgcttgttccctttagcaggggaaattggggctgactttataacattggagctcactatatactagaagttgaattgtacttttttcccctggagttctgtgactcctttgaattctcacgggttaaatgggatcctggatactccctccctctttgtaaaacccctggagcattttgtggctgaaatttacttcttagagccatgaaatgccctccaaaaagtgaagcaccacatccaaattgcattccatgcccaaagtggttaacatccctcagagatgcaaactcagaagcatttttggttttgagagccacagtgctttacccataggatgggcaggccattccttctgctgactgcgtcagcagtccgggctccaggagaaccagcattcgcagtgggggtgtctgcactctctaccaagctgtccaggttcaggaattaaagatggaagtgagagcctgtgaaacaaggaagctatgaggtgtggggctttgccagaagtgccagggaggctgtaaaatgtgttttggaggcaacctcaggctggttcttctggggacctcggtgttgggggaacggcctgtttctgtagcttgggatgaacttcttccctgcatctgtgaacaagcttgtactcagcctgtaggttaacaagctggggccagaaggctgtactgcactggacccaaaacctgccctaggaagatgcttgcaacaaaacttgttatcaccttggtttataacagtgagatggaaacgggatggaattggggcatgggtttcaggactatgaagttattatttatgcattaaatattccgaagcagcctcagctaatggaacacagttcttctgaaggaaatgcggaagataatcccagcagtgcaggagagctgtgctccactcctcaaggctgtaggtgggcctctgttttcacattttaagaaggaaagggcaattttcttccttgccgttttgactttcaaatcctcacgccctctgctttgattctctcagacgtgaatcctttaagcagtgctttacacacccacgacaagggcgttcttggggaacaccgtgattctggaggggtattatgaggcactcaggaatgcttttgaagaaactgtaatgaaaatgagggccgggtgtgttggctcacacttgtaatcccagcactttgggaggccgaggcaggtggatcatttgaagtcaggagttccagaccagcctggggaacatggcgaaaccccgtctctactgaaaatacaaaaattagccaggcatggtagcgcgtgcctgtagtcccagctactcaagagactgaggcgggagaatcacttgaaccctggaggcataggttgcagtgagccaagattgtgccactgcactccaggctgggcgacaaagcgagaatctgtctctgtctctctctctctctctctgtgtatatatagtatatattatatatgtatatattgtatactctacatagtatatatttataatatatgtatataatgtataatatatgcatatattatgtattacacatgctagcatatttgtaatatatatattatgtattatgtatatattatatatgtatatattatatatgctataatatagttatatgtatatattatatatgctataatatagttatatgtatatattatatatgctataatatagttatatgtatatattatatactctataatatagttatatgtacatattatatattatgtatatatgatatgctctatttagtgtatattttatatatttatatatatgggggggtggaaatcactatcctctaagaagttacaaacctgcaaatcctctagagcccatttgggccggcaaacttttgccttgggatttccttagaggagaagagagaggacccagtcaaatgctgacgttgttgtgacagattctaagtcgcctcagggctcaggggaaagagccttggaattgcaggcagtggcgtggatgtacctgcaggggtgggcatggtggcatcttggtggccaggtgttcgtcaccctgcactgagagggcctggtgaatggcaaggtcaggggatgctgtccggacatgtcaggatgggaaactgtcttgtctgtggatctttgaggctgctgaaaaggatctttgagcctgaacttccagggaagcctgaaaccaatctggtatccccagggtttatgttttatttcatttattatagggattcaaggatttccaaataagaaattaaatcctaccattgaaactgtgctggtgaacttctgctaagtcctacatttgaaagtcatcagcggattatgtctgatccagtttgcagcgggctcttttccggctgcgttgaaatggatttctttattctatttaagactccacttccttcctcggcacagaactgacaggctgtggcagccacagcctcctccgatgctcctctcctctgtggatgtaccatctttcttccattgttgttttgttttatatttgggggctttacggctgctttaaactaaaaataaatgctcctccccttttctgtgctaaaaataatagttaaaatccttgtgacgtttaaggttttcaaagaaaattcccaatttctgagataatatgttgtttttaaaatgtcacctgcaatttcaggttcctttttttagccttgtgtataatttcacgagttttgtctggaatgcgtatttgtggttcctggagccaaacagaattgggggctgggctgggggtgaacgtgacacgggagaccatcaagtcattctaatattggctgcatgctgtgcttctagttgataatttggaggagaaaattagagtccatagctctgctggggaatgagcccacctgccagacgatggctgtcttaatgaagatgaggtcctggctcccttgtctaatgaagaatgtgggggagcctttagcagaaggctctgaaatcccgaggaaggacgcagtggaggcaccgctggacaggagctgccttccctggtccttgcagccaggctcctgcagcctgggaaggtggggcttcctcatctcaggtccagaatcctctgaaagttctcttccttgaccatagtccttgggccctgttcccttgttggtgttgtttgctgaggtagaatgctaagataggccaactggagtcatttccaggattacttcccattctagaatttttggtatatgttggtagtcatatcacatggatgacttttttcatacacgtttatgtgctgtaggttgaaccccactgtgaaattgccactattcaaacatatttgaccatatttgtgcctccagcacagcagcgagtacaagtagcacatgtgcctgtctccaagcaggaacatctcctcctggctgtggtcagattgatctggcaatttttatgtggtttgatggaatataaattgacctgggatgaaaactgactccagtaaagccttctagtttgttttactccatgtggagttagtggtcactgtgagccagttttcttggttttttttttttggacagagtctggctctgtcactcaggctggagtgcagtggcgcaatctcagctcactgccacctccacctcccgggtttaagcaattctcctgccccagcctcctgagtagctgggattacaggcgcacaccacctcacttggctagtttttatatttttagtggagactgggtgtcaccatgttggccaggctggtctcaaattcctgacctcaagtgatccgcctgcctcagcctcacaaagtgctgggattacaggcgtgagtcaccacgcccggcccgagccacggttttccatccctggtgtggttgcttcatcaggacttggcaggccatgtgttactccaggctcacttgtgcctccagcgcagcagtgagttcaggtagcatgtgtgcctgtctctgagcgggagcatcctcccccggctgtggcacctgggcaacgggacatcaattcctgctctttaatcctacccccaaaggtaataggagagcttcctctgtgggtagttgggccctttcccaggcatcctgccacctccttggcagcatctccttggaaccttacagaagccttaggaaagaattgctcccctcttctcccctccccctccttcccctcccccgcttccctcccctcccccgcccatcctccaggctggagtgcagccttccctccctcgctctatcccccaggctggagtgcggtggcacaatctcggcttaccacaacctccgcctcctgggtcaagcaattctcctgccttagcctccaagtacctgggattacaggcacctgccaccatgcccggctaatttttgtatttttagtagagatggagttttgccatgttgacgaggctagtctggaactcctgacctcaggtgatccacctgcaggctaatctcaaactcctgacctcaggtgatctgcctgcaggctagtcttgaactcctgatctcaggtgatccacgccccttggcctccaagtactgggattacaggggtgagccacctcgcgcccgaccagaaatgcttctattttatggtgaggaaattgagagaccagaaagttaaccgaggtcactgtcaaacccatggctcctggctccctgacccctcacacccatttccctctgcgtcctcttgatctcccatggacactgggatgggcagggccaggtgggagaagcagggctcatctctgagggctgcgttatggggtaggagtttagcctcagtaactgcagcactttctgcccatggcaacctgtgctgttttcacatttctcagaaattcccgctcttggagttttacacttgtaacatctgcttagcaaattttgaaaaattgaagatgaagagtaataaagtgtggacaaagctctgcagggagcttgttagaaatgctgatttgaggccgggcgtggtggctcatgcctatattcccagcacttgggaggccgaggccagcggatcacgaggtcaggagatcgagaccatcctggccaacatggtgaaaccccgtctctactaaaaatacaaaaattacccagatgtggtggcgggcgcctgtagtcccagctactcgagaggctgaggcaggagaatctcttgaactcgggaggtggaggttgcagtgagccaagatcgcgccactacactccagcctggcaacagagcgagactccgtctcaaaaaagaaatgccgatttgaaggttctgatttccagagtcccggctgatgctcacctgttgctggctttgctaagcgtcccaggttagtctagggcgagcaggctctgagcaacacagcagataatgagggagggatttagaatctggcattgccaaggaggtcaagggggactttcccaagtgtcccgctgtgtccagaggcagcagcagggagaacctgtcctgaagggctgcagtggtcggcgagcccggcacctgtctagttcttgggaaggatcattactatcaccaacgtcgattgtaaaatacaagatgcttttttctttttttttttttttttttttttttttgcgacagagtctcactctgttgcccaggctggagtgcaatggtgggatctcggctcgctgcaacctctacctcccgggttcaagcacttctcctgcctcagcctcccgagcagctgggattacaatcatgtgccaccacgcctggctaatttttgtatttttagtagagacgaggtttcgccatgttggccaggctggtcttgaactcctgacctcaggtgatctgcgcgcctcggcctcctaaagtgttgggattacaggcgtgagccaccacgcctggcccagacacttctgagaacgagctacatcctctgtgccactggattctggctggtccaggaacacaggtgtgcacacatccggatgtgcatccacacactcatgcgcatatgcccagctgtgtttccctgaagcatatttatccttccagtgttcctgcaccttggaaggaagcaggacagctggcctggaccctgccccacccttcctcgaccccacctactgagtgatgaacaattccacgccagcacagtgtccagcccacagataggtccctgtagtggagtaggaggaaggactattttggtatgcatggctttcgcgaatgttttgttaattttcgtttagctttgtatgaggcagcattccattttgactgggcggtaacagagttgatgaaagtttttaaaataaatactttttaatgggagatgaagagttttggccaattgagtcaagcatttattttattactcttattgccacaaacacaaatatgttccattcaagtgaggatgtatttgcaagtaaaaagatgcttcacattgttccaatgtttatataatcatgcatctttgtttaatggagcactgcttaatttataatgaatattttatattgttagaaagttaatcttatggtggtatgtgttgaaaaatcagcagtgcattgatgaatagagctcattttaattcacagtttaccctctttgttttactattaaagttcatttttaaaacttcacgatttaatttcttatgtgccaaatggaataaaccttaaaaggtgccagaaggtaacaatgaaaggaaaatcatctcatcacccttgacttcagccatctagttcctaaccctaaatcagcacctgttaagttggaaattttaccagaaatagtctcagccttgacaagcatatgcatatttattttgttttgttttgtttgtttgtttgttttttaaataacgagatggagtctcgctctgtcgcccaggctggagtgcagtggcacagtctcggctcactgcaacctccgcctcctgggttgatgccattctcctgcctcaggctcccgagtaactgggactacaggcgcccgccaccacgcccggctaatttttttttgtatttttcagtagagttggggtttcaccatgttagccaggatgatcttgatctcctgacctcgtgatccgcccgcctcggcctcccaaattacaggcctgagccaccgcgcccggccaagcgtatacatattttgcacccctcacccccgatacactttttagaaatgcatttgtgaggatcctatccatctctgtatcgcacctggctgtcatcacttgatagtagcctggggacttggggaatccccactgcagtatgttgagcttcagttactggttttactattccatgatgtggctatatccacagttacttaaccagggtgtggtttgttacagtgcagcaacagagtgacgttctgagaagccagacactattggggcctgcattttggagtcatcatcattgacctttcagttttccctggaccattagggtcactttgcagatcctctaaggccacattcccatttttctgcaagagtagtcgataacagaaagaagtgttttccaaattaattggtaatgctgttcactgatggtattaagacacaattagttacccctgactgagcgcttgctgggtgtcaggcccacgctagtgcgttcctcgcatcatctgtccacgggtaatgtttgtctgcagcatgttggggtggtgtttgggtgcacaattatgcaaaattttgcgcccccgatatttagctcccaatgtgtccgtgtcagtgggaggagagtagaggggcagtgactggaagtctttgcgggcagtgcagggagaagtccgcctcccaggcatcttcttcctcagggctcttgggctttcctcctgagctcctgcagatgggcctctgccggtctgctctgccagctggacaggcatgttgtgccccgaaagtctctgccctctagagatcactcagatctcctcctgatctacccagctgtcctttcctggagcagggagtgttcctctgacgggatgtctcactcggcatcgggagacccttgacgctgtcattgcagggcccgtggcatctggtttgctgcacagttgccctccccatgaccccccccccccccgcccagaacacactgggcagatgtgccccccactctgtgacctggtgggttgtgctcccccggcgtgtgacctggtgggacgtgctccccagcgtgtgacatggtgggttgtgctcccccggcgtgtgacttggtgggacgtgctccccagcatgtgacatgatgggttgtgctcccccggcgtgtgacttggtgggacgtgctccccagcctgtgacatggtgggttgtgctcccccagggtgtgagatggtaggacgtgctccccagtgtgtgacatggtgggatgtgctccctccccagcgtgtgacctggtgggacatgctcctcatttgtgtgacctgatgggttatgctcccccagtgtgtgacatggtaggacatgctccccagcatgtgacctggtgagatgcactccccagcctgtgacctggtgggttgtgcttcccaatcatgtgacctggtgggacgtgctccccatcgtgtgacctggtgggttgtgctccccagggtgtgcctggcctccttcagatgctggttttgccctcctgtgtcacacccatggtgtggttagccccttggcttccagccctgcatccatgcggtcctcatatcacacagttctgtgaaggtgatggtgtttcttaacttttaggcatcttatgaatcaggtcacttcttagacataatgtagagtgagtaagtttcagcattggaggacaatatattggaagtaaatcccatgtggaaagagctatttttctatcagtgggatgcacctcctccctctggtccagcccactcgtcatgtgttgcccgagctgccatgtgatcaccaggacaaatgatgactactatcatggggtctcatttatgataagaaatggcatgtggtgggtgtggaaaactgggttgcaggtaaagccatggtcgtttgggtcatctgtatcgggtgggtgcactgtgcacaggcagtcaggggaggcgggggagagtgcacctgcagagggctgggctctgtagaccaccccatggagcttaggagtcctccatctttctgacatagtctaaaccatcctggctgggtcttcagtgtttaatatctttgtgagggtcaaaactctagcaccagatctttcttctgagctgtaacctgttacttacaaacactgaagtgttaacttacactgtgagcattcaaatcttcaaattcaatcatactttttgctgtgtgtgtgggatttcagaaaaatgactattgtagtagacaagcaaaagaccaaatgtggaccgacaggctataacagaatcactcctcggaaagctaggtgtgtcctcaaatatctccacacttgccaacaggcacagtcaggagggtctgaagatacacgctccactgaagggctgtggctttagcaggggaaaaatggaaagttcgattttcagtaacttttgaagtcattggatagagcatgtgttaccgaccacagacttggacctggaactccccactggcatctagctgagtgtcgtgaactgggacaaactgatctttctggggtgagagtgacacagggaggcttgtctgcaccatcttcagtgaccttcggatgtgaaaatggcccattggaggcattttgacttggcctttacgtgagttatggtgtctgactttgtgtcctcctctttttcagatgccttcgtgaacagccaggaatggacgctgagtcgatctgtcccggagctcaaagtggtgagtggttccctctggccctggcacctgtgggaagggaggggctctgtgcacacccaagcctgcattcccaggcaactggtcatcgcctggggcccagagtggaagtgtgactctgggtgtgttcctgggaagggccaggtatagttgatagcttgggactagagtccaagttcctgagtgcccctgggacagctatgacagccatgactgccactcagccagggcggtgtctcatgtgcagggcagaggccatcatcatcctctctctcacatctcgtgggtgtgtgtgtgtccacacacacacacccccatgggttgatttgtcctttgcaggatgtcacggaaggctccacacacacacacccccatggattgatttgttctttgcaggatgtcacggaaggcttctgtcatgagtcaccaagctttggtatccatcatttttgaaatgtgactatttaccctgtgaccaagtattggcatgaaattaaaatttttgtcttttacgaaccttaccctttcggtgaaattatgtagagcttcaaattggcacgtgtaaaaagtggtccatcgcagccaccctttccagccgctcccctctaccgtaggatggaaggaaggggcaagtctaactttgaaacaaccaggttctttgtcgtgaaatatgtggcatttgtgtgtatggttatgtatctgtgtatgtatgtatatatgtgtatatatgtctaatttccgtgtgtatgtttatatttatgtaggtatctatgtatgtatgtatatatgtctaatttctgtatgtgtgtgtatgtattttctaatttgaccgtgaaagcaaagcagatgagctcttgctgttctgcagactccggcatgggcctgcctagtgtgtctgtcctctgcatttctattgatagcaccagatcccctgcggcccgtggactcctccccactgaccccaacctcattgcatgcttggaggacaggacaagggccaggagacaggatccttccggtccttcatgtctgagatgaggagatagagcaacaaagaacttctaggtctttgaagagacttttgtcaccaggaaaagtatttgtttttaaacttaggaaatgaagtacaatgagtgggaggtgccctgaggtgggaaggccctgtggtcactgtgccgtctctctcattggtgtctgacacacccatccccaccgcaaccgcggggtgtcatcagctgggcccatctccttcccggtgtctgccccccgccccattcctccctgaaggtctctgggctgtctctgcagcacttgcccgtgggagacaaagcgtctctcagtcctagtgctgtctcagaagcctggggttccgcaagactggcctggaaagagccgcctctttctgtcttttgtgtgctttgtcaccgcggcactggcagggtgtcttaagcctattgaagccgtccaggaaatgtgcgttgaatgaatggcacaggcttggcaatgctgttaccaggagattctcagaacaatcccgcagtttccgttacttcctgttaagacagccgctgccactcgggtgctgtgatgggcacggaacagtagtcacggtggtttactggtggtgatggtgtggatacagcgctggctctgtgcgggtcgtgttctaagtgctttacaaaattacttaatcctgacaagtgccccatggggagggataggtacggttatccccatttcacagatgaggaaactgaggctcagagacatgaagaacctgcccaaggagccacagtgagtaagtgggggagctgaggtgtgagcctggagctggtgcttccaccaccgcactgcctgacagaactttctcgacggtaaaaacctcctgcgtctgcactgcccagtgccgtcacggctggcgccatgtggctgttgagtgattgaaacgtggccagtcagtgccatcaaggagctgcattttaagtttgattctagttcatttaaattgaaatagccacacagggccagcggccaccctactgccagcattacagactaactgatcgtcaagtattgaaccacctgacttggcagttcaaggtgttacaggttcagagagggcccacatgatcataccagcccataatcgaggatgcttaccaccaaaaacttgtgctctgccggtattttgaaagcatatgattttctggaatatctgcccagagctgtaggagacagttgcgtttgaggcagcatgggctcctcattctgaaacggactgtcttaaggcttgcttcaatttgctgacaccgtgggcttcgatgctgttggttctacagttctcagaacggtcctgtccctggcctgagtgtggatggacgagatcctggcaggcccaccagctctgctctagcccaagtgccttcttgttgtggcatcagcgggcactcgtcctcatcggcacccccagcagatcccttgtgtgctgaggagtgctcagggactgaagaaagcgctgctttgttccctaggcagcctccaagtgcctatagggctgcaattgtttccctcctagcgcagcccccccaggacaggtggcactttaggtcagcgtctcaggaacccagcccctgcttcacaaacgcagcagtgacatgatgtcatggcaagcctccaataggccctttatgtaacattttgcaataaatcttttgaaatctgtcagagaaaaaaattcaatgttcgctttcttctcaagagtggtagtaccatgccttatgttttattttctttctttcttttttttttgttacggggtctcactctgtcacccaggctggagtgcagtggcgccatctcggctcactgcaacctgcctcctgggttcaagtgattctcgtgcctcagcctcccaagtagctgggatgacaggcacccaccaccacatctggctaattttttatttttagtagacaagattttaccatgttggccaggctatgctcaaactcctgacctcgtcatccgcctgccttggcctcccaaagtgctgggatgacaggcctgagccactgcgcccggcctgatgttttctgaagttgtgctgtggtcagatcgtccatgaccagttgcttttggtgctgcacaggagccaaccgctgctggctgcagatgtgtgcccaacagcaaaagcttgatgcttctgtcagaggggaaggcacataggctctggacatcttgcctgtgtaggggacctcagtccccagctcctcacatcctatttgtgtgttttcattgaactccaactggaatttttactaaaagccttgatttccttttcagcaaacctcagggttagtgtggggctctggagaaatcagtttaggaagacattgcattccctttggccttgtgatgtgaagggccgagtatgggttccaacgcacttcatgtgcctgcacagacggtgacccctgcacagaggttgacagtggcaacctcttcctgccttaagtacgtagttctgtgattttcaagacacctcattcctcctcatgtagctctttggctcgctctggattgatttcctccgtcttggtttacttccagcagtcgctccgacagcttcacgggtggcgtgacacacttgaaacggcattttgaccccttattttattttcctttcaccatcaactgttaatttccaccagcgtttcaaattaaaatgatgccatcgtgtgtgactgaggtggtctgtgagatggctgttccagccaaaccaaaccccttcccactccactccaagattgattgccctaagggagaacttaggggagagcttaatctttgcccatcttgttaggtggaagaaggcaggaacgttgctatgcagagaaggcacagaccaaaggatgtttggttttggagcattttcttcctcgagaaagagaaactgatcttaattaaaaatttaattctgtggcatactgttttggattttcccagcatgaagctgacatgaagcgggtgcccttgagcaaaagaataattagtaggtagaaattctccgattatagaggcccagggtaaaaaaagatgtacgtcggattaggaggggaaacagctttatttagaatctgtccacacagcctggcttgagcctggctctgagccttagtaataagcatctcattcactcaccagcagtgcagtcatgcatgtactcatccgttcttttactcggcccgtgctcttgagcgtctgccttgggctctgcattacgcagggattcagagaacaaggcaaatgagacaaggtgcctgtccttgaggaattgtcagtattggaggaagccagatcaacacactgatgtttccaaaataatgtgttcccttgtgagatatccttggggcagagacctaagggagctttgaggaaaggcacccagttgaggctgtggcatcaggaaggtgtcttcgtctcttctggctcctgtaacaaaatatcatacactgagcagctgataaacaacagaaatatatagctcacagttctggaggccaggaagtccaagatcaaggcacctgcagatttgatgcctgaggacctgcttgctggttcgtaggtggcatcttcttgctgtgtcctcacgtggaggaagacgcgagaggtctttctcaggcctcttctacaagggcgctaatctgctcccacaactgccacacctcgtaatacaatcaccttggggattaggtttctttgtttaaaattttatttattattttgtttttattttttgagacagagtctcactctgtcgcccaggctggagtgcggtggtgcaatctcagctcactgcaacctctgcctcccgggttcaagtgattctcctgcctcagcctcctgagtagctgggattacaggcatgcaccaccacagctggctaatttttatatttttttagttgagacagggtttcaccatgttggccagtctggtcttgaactcctgacctcaggtgatccacctgcctcggcctcccaaagtgctgggattacaggcgtgagccaccatgcccagccaggggttaggtttcaacatatgagtttggctgggagtgtgggggtaggacggggaagcacaaacattcctaccatatagttgaaggcttgtcagaggaggtgacatctgaactgatagtaagagtaggtttcggggaatgattgatatggaaagctttagttgcctggagacagcaaggcctgttaggatggggcttggtagctgattgactagaaggccaagcagggagcgggcagatgagaggcgggagggttgtaactggggtgtaagaggacaggaccgagcataggttttagaaaggccactctggctgatgagtagagagtgggagcggccaggactgggtgacagagaacatttggatccatgagccatcactcagacagcagaccacggtggcctgtaaatcactgagaaccttttttccacactgtcatgccaaatttgttctcttatatgtttgtttgttttcttttttgttgttgtttttgttttgttttgagacagagtctcgctctgtcacccaggctggagtccagtggtgtatctcggctcactgcaacctccgcctcctgggttcaggcgattctcctgccttagcctcctgagtagctgggactacaggcgtgtgccaccacgccttgttatttttttgtagttttagtagagatgggatttcaccgtgttagccaggatggtctcgatctcctgacttcatgatctgcccgcttcggccccccaaagtgccgggattacaggcgtgagccaccgtgcccagccctgtgtttgttcttaatagctattggcttcatcatctacttaaccaacgttccttcctccctcctgtctctcctcctctcccctttatttccatctctcctccctcccatccttcttccttgtcatccatctatccatcgacccatcttgtgtttaccaggactttgttggagccagggactatgacaagtgtacagattcggagctggtgtcttggcccgtatccagagacagagatcttggccctcggggtcctaagtgtagtgggaggtggagcccagggcctcaccagccactgtcaaggctgtctgggggtgaggggaaagcagggaagctttcccaagagaaagtgaagccctcctcaggtgaaaggggaggggtgctcaggtgacaggagcagtgaagtgttcttgcggcaagttcatggacctgctgggcctgttagctgccagcaaagttgtgtgcgaggatttggaaggagacagtttgttcctaaaatgtttggagttgggcctccaggcagcaggagtctcccacggcttatgaaatgaaggagtgccactttctcatggtcactttgtttctaggaacctctctggtgttctcgggttgaaaagcaggtgcttgcaggcagagagaggccctagaggctgcttccttgatccgtgcacactggagagtccacactgaggtggcagcaaggtgcccaggagggagcggactccctgacttccagccactgggagtcggggatggcctccagctttctggcttgagaggctgggtgtgatgtggcctcagaagctgatgaggagactgggagagagaggcaaggtgtggacccatcgaggcgtgaataccgcataggtggcgtacggatgtatataaagtcctggtgggagctaagtaggggcgcctggagctggggtggacggcggccaggggatgcgatttgggaataggcagcttttttttccccccacatccaaccttctatcaatgagttatgattccagagtctgcagggtgtctcctgttaaatggaatcgcagctcattgagagaaggttggatgtggacaggcgcatgttgggacattagagtggaggatcagctggagatgtgaggatggagccctggcgagtcccagtatgtccctgcagatggaggaagaacccacagggctgggagggaggtagaggcggaagccagtgtgagagttggaagagagtgtcttaacagcagctgctggtgatggggccaggtcagagcgagacaggctagtggctttgaaatggaagttgcgggtgacctagtgggcagtttcctggtagcaacagggccagagcttcagataatttgagtggaggcaggagggaggtcaacaagtggaaccgagagcaagcggggtgagtcccagctcagggaatggcaggtggccttaatgagcacctgtgcctggggatgggtgccttgtgatgttttgggctttttaaggaatcgattagatcatgcttaaatttgatcactagcgatgttctagtgggggaggaaaaggttaaaatgcaggagatttttgatgagcagcttcccagagaaggcggcatggggggtatccagctcccaagcacagggaaagggaggctccctgtaggatcggccacttggaggctgggaggccaggtgtgtctcctgtgtcaacagggaggcttcctgtgaagaatcccctggaaagtcagccttgccgccaggttactgctaggacagaggccctcatgtcaccctccctcctgagggtcgccttctaatccagcacaaacgagcacctttgccgtctctcccagcagccctggcactgtcccctttttctcggagatgccttggtgggtcctgtgtctgggaggcaggtgtgtgccctcctcgcctgtgtggccggcccctgccttgctcctccacccccaggtctccccacactgcccttttctgctcctgttgtcctgcccccaagtctaccctagactcatcccctaaagatgctaccatgcatgggtcctcgccactctccccacgtcactcacctctgccctcgggtgccacctcacctgctgcttttcccagtctctggagggtgcacagtagatgccggcgggctaactcaaggaacacagccctgatgtaaacaatgtgcttgttttctggaagaatgccaaaccagtgtttataccagcattgctgatgccgttgcagctgttgaggctgatgagaacgtgagatgttaattaagagtgttggactcccttttactccaatggaagtattgaatgagcttgtttttggccatccagccagtgcttggttatgtttgtgtttaggcctcctgtctattttagcctcttagtatttgcaaaatgccaaatagagtgatttgatgatgcttaacggttgtccgtttctgtttcagggaattgtgggtaacttggccagcggcaagtctgccctggtgcaccggtacctgacgggcacatatgtccaggaggagtctccggaaggtatgctgtttggcaggcagttgcaaacttaagaatgtagttttttaaaatttttccttagcatattataaatcatgactttgatgtatcacaggtcaagaaagcaataaaacataccaagcggtaaaaacccttaagtatgtggtttcttctgtagtatttttagcaaacccgttatattcactttgatatctggaatagcgcagtagaaccatgaaatactattgaatttatttcttatctaattgttctgtcctttcaaatgtcctttttaatccagtgtccttcttatccattgttgctcctttaaatattgactggacattcctgtgatctggatattgaatttatacataatttgtatgtaatgttacttagtcatagataagagccttccgggataagacgttcagattaccaccaccatatgtttgagtatgtttccccccttatattataaacatttaataatcattttgcatgagagtaagatttttttttttgccattaggcatttgcttcttcagttaacatgtccatattttattttttgccttaaataaaattatgataatggtaggaagcatttagctcccgtgtcccctaacgaaggggtgtagttgacaagcagttttctaaatgaaattttctctccgtgtaactttgttaaatccaactctgagacactgaatttctggttccttctttttcttactggctgttccattctttgcagatatggatgcaggtaactattcattttcttcatggcagcgcttgtcttgttttggagagagaggaaaggcaccactttgtactgtagcgttcccttccctccttgttctgtgtaccatcctgttttgtttcattttatctttttcttcagttgaacattccaccctgttttgtcccttagttgtctttttagcagtagtcccaagcagcttcacctgttccctgtaacacctgtcctagcatttaactcttgtcctgaatactgcggaaccgttcggagaagtataaaagtggcttgaggctctgccaccgttttgcagaattgtgtagtcatgtcatgaacacctcatgcatcaggaagagaccttccatactgaaatgatgatctaggaagattagaggtgataatgaaggcttgtatgtaggggtcaataggagaaagcttgcctgttcactgagaaatgcatacagatgccagaaaatggcatgatttggagaaatgagcaaaggccacattttgtcagggctctgtccctgggttttgacggcttttatttgctcctttgtgtcggaatatgaattttagccacggccagctggtgacaccttttagagaatcttttagagatttttcctttgggttttccacttattttcaagggctagctattgtagaggttatacagaggttaactcacctgcaaatgaaatgaccaccttttctaagtaaatctactttcagggccctgcaactctgtggatttcaagctgggaccacaggaagttacatgagtcgggcctggttttgttgctgttgctctggcagtctctggccctggggttcaggtgtctggtggggcagcgctggaggccctgggtttctggagtaagaacaaggaccacgactcactcatggtggcctttctgctatatggctatttggtcatttttgtggcttttcgctgttttccctttgggcattcacagtgtgttccattgtatttgggcccagctgggatgtcttttgcagtgcataattgacccttacatgttgactcacaccaaagcatttctcttgaacgtttatacatcaaaaggaaggattgtggggtgacctaaactgatcactaacatccctgcttctttgatttttcaagtaatgcattttactgcactgaaatttcatagtattgtgtatggtttttaaaaatacattatttttaagagtaggagcgtgggtgagtaccttcctttcttcatctgcaaagtggaagtagctcatcccctccatggggccccatgcccaaggcttcctgggtcaggggaaagatcatgatccctgaccttttctcatgccctgcagcagccctccctgggcatgtggcctctcaccttttgactcgaggtcccagggattgttctgtgggagtgtgaggagctgacagcagcagacacccaggtgcaccccagtgggtgtgtgtctagggcccctgggtgctgaaagaattatgaatacatggctccttgtgcctggaagcttcttagtcctgctgaattcatgcttctcatggctgagccacctttcccgtgtagaaccaagcaggtggccactgtctttgcccctcttaatgagaccagggaatggacttctacttcctgttcatgtgactgtgtgcctcatgacagtggcaggagggagccataacttgttgtaatgtcacttgtaatgaagggagccatacttgttgtttgggaaagaaaacaaatgagaagccgtgtttctttcataccacggtcttgccatcctgaaattccctctcatgctcagggagcctgtacctggaaagtgatttcaatttttgtccagtgagttagtgttgatcaattacccatgctttgcttaattgagaagctttaggtatagagtgttgtgggtttgggatataatttactgtgttgtcacctgggtgtgtggagactatcaaagggatgtgttgtcctcggggagtgctggaggctgacaaagctgatgatggcccagcctcacctgtggttacttacccacacaaaggtgagggcactcccacagtggtgggagtggttggcgcccggttgagggattggattttgagtgagctctgtggccttcccatttcttggtgtactgctgccttctcatcagacctcctttcctcttacaactgctagagcgatcaactgggcagctactttgaatgaaaggcattttgctgtgtatctgcctgtccagatagttccttggattctccctgcgcttcttaatgtctgtgccctgttcttctgatttaattagtgcgtgagtatcctttatgtcataatcctgacccgtggctgggatatgtagactgctgggaggggtgagggtgagggccttcctgtcttcaggggagagctctctcgtggtagaaacatttctggtgcagagccgtctccagatccaagcctgcttttcctcagatacatcagatgcattttagctccatcccagagggtaatatctgctgtcttttcgttgtatgatgcattttggttgatattttattcttgtagtgaagagagccaactcacaagatttagattattttattttatttatttatttattttgagatggagtcttactctgtcacccagactggagtgcagtggcgtgatctcagctcactccaacctctgcctccaggattcaagtgatcctcctgccgcagcctcctgagtagctgggattacaggcaccccccaccgcgcccggataatttttgtatttttggtagaggcagggtttcaccatgttggccagactggtcttgaactcctgaccttaagtgatccacctgcctgggcctcccaaagtgctgggattacaggcatgagccaccacgtccagccaagacttagataattttaaagatgcagttcaaatgagggaaggatataaatattctgtttttcaattagtgaattaacaacacaaaagtgggtaacaccgtagggaacttgtgattccatgaaatcagtcaaagagtaaacctcttggattgacagattccttaatattatgtgtgtgtgtgtgtgtgtgtgtgtgtacacctaggtgtgtaatatatgtatgtgtacttcagtcctagcactgtagtaacgaactgccacacacagtgtggcttaaaacagaaatgtattctcatagttctcagaagtctgaaatcaaggtgttgacggggttggttccttctgcagcttagaggttgaatctgttctatgtctgtgcggttctgatttaattagtgtgtgcatatcctttatattctaatcctgacccatggctgggatatgtagattgctgggaggggtgaggtggtgagggccttcctgtcttcaggggagagctctcttgtggtagaaacatttctggtgcagagccgtctccagatccaggcctccttttcagcagatacatcagatgcattttagctccatcccagagggtaacatctgctgtcttaattgtgtgatgcattttggttgatattttattgttacagtgaagagagccaactcacagatttagatgattttaaagatgcagttcaaatgagggaaggatgtaaatactgtttttcaattagtgaattaacagtgcaaaagtgggttactccatagagagcttgtgatttcatgaaagccatcaaagagtaaacctcttgtatagacagattccttaattgggtgtgcgtgctcacacgtgtgtgtgcacatctgggtgtgtaatatatgtatgtgtacctcagtcctagggctgtggtaacaaagtaccacaaactggcttaaaacagaaatgtattctcacaagtcggaaatcaaggtgttgacggggttggtccttctgcagactttgaggttgaatctgttgcatgtctgtgcacagttgttctgatttaattagtgcgtgaatatactttatcctaatcatgacctgtggctggtatacgtagatggctgggttatgtagatggctgggagggttaaggtggtgagggccttcctgtcttcaggggagagcttctggtggctgtcagcaatccatgctgtttcttggctcatagactcctaaccccagtctctgcctctgtcatcacagtgttttcctggctatctgtgactgtccaaactttttcttataaggacaccagccattggatttagggcccatcctcctccagcatgacatcatctttacttgatcccatctgcaaagaccctctatccaggtgaggtcacaccataggtcccaggggttagggcttgaacgtatcttctaggggatacaattcaacccacagcagtgtgtgttatatacctgtgatgttctccagggatgtccaatcttttggctttgctgggctacattggaagaggaagaattgtcttgggccacacataaaatacactaacactaacaatagcaaatgagctaaaaaaaaaaaaaattatacacacactaaaaactcatgtgttaagaaagtttacaaattagcgttgggccgcatccaaagctgtcctggttggcaggttagagaagcttggtttagacggtcgctgcacttagaactgttggagttggccccatcacttggtggtggtcatggttctgccagtgatgcttttgcaagctctgctggtgttctagaacctcacaaggactcatcggctggcagtgaccttcacacctctgaggacaatttcacagctgccgttcacttcctataaagagaatgagatgaaaattagttatttgccaattgagccctattaatggctgctgattagaatcgtgtgacattttgggtgtgtaatgtgacttccctcgtggtgtgtttatgtgcttaatattcagcgtcccccaacacagaccccacatgatgccactcagcttttaactctcctttcaaaagagaaaaagtcaaaggaaacaaagctaggatgtccagtattatgtggacattagataggaaatgtggacctgcccaagacacttcaccccctgcaggtggggagagtgtggcgtcctcctgagatcttttcaggttgcagaactgagtcattgctctgagacccgttccccaggacaactctctctgtgtcacccatggcatcacaggcaccctgggccatgggccctcccgagctgtgcaggttagcttgtgtgccagaaggacctgaggaccagaaaagctgaaagccagcaccacgctgagatcgtggcacacctgaggagggcagaaaggtggccccacaagcttcccaagatgaaactaaactgtatatggattgagtgggagcttttatcgttggttggttggttggttggttggttggttggttggtcgatcgacagagacttaagaatgttcatagaccaactccaagctgcaaaatgaaagtaccgagaggaaggtgggccatctgagagccgcctttatcccagatctggaagaaacccacatctaggtgtgaaagtggcaaaaggagggccggggcctgcctgccactgaggcccagcggctgcctgcgagggtcagtggtgtcgtagcctgctgccgccacacagagggatttgcagggaagggccttagccaggcatgatgtgggagcgttggccctggcattcccgggtcttcatgagcttaattcagcaggggctccttccttcagtgatggaatctggagtttctgactgattcttaaccaactcaaaattttaggcagaaagctagctccaaggctgaggcagccctgaatgtgcctaggccaacagccagcgagctcctggccgggagcctggtaatggggatggctggtaaaggctgtgccggccctgcctccctcccagaagggcgaccctccagccccatgtccaggctctcccatcttcccagctcgggccacacataggcagcagctgcccccatgctctgtcccagagacggaacacactggtcactgggagattagcctccctcattcattttcccgatagaatatgatagctgaggtagctggaagagtatggtcaaggagctcaaggcagctctttcactcaggagcctgccagcgtagggcaggggaagtcagtgccctcccagatggaaaaggtacctgcggtggtggggggagggggagttccctatgtaaagaagagtccaaaacagataagggagactgaagaaacctgaacatccagtgctcatgaggaaaagctttaagagaaaataccaggtgctaagagtaattataactaccaggtaaggaccagtgagaaacagtgggtgagattaggctcgacagttccctaactcaggaaagtcgagtttctgagcataagtcataggaaattctcaaacatacttttgctttgtgcctgggaagcaggaaagtacaccagacccacctcatttcttacatctctccaagagaagcctttcgcttgtctgtttggtttatttggttcacatcagagtttgctaaaggcttggaggttctgtaggaaggaatgagccgcttcacctcctggagaaaggacgtctcgtttccagcatgtcgggggtcaggctgtgctgcactgaggctgaagggttctgggattttccactgtgtgtttggtttctgttgcttgttccaagctgctgacgcggtgtgctggatgagagttctactggccactggcttctggcctccagggccagctggctgtacagccacctgcaagtctttgttcccggggttagccttgccaccctccttcaggactgcctagaattgtttcctgtcatcggggtagtaaatgtgttctcaggagcacgtgtatcttaaatatgttttaacgaatgtttacttagtttcttagaaacaaaacgtggtaaacacccagtcttattttctgggacacatgaagtgtgtttaagctgtcagctccaaaaaccctttccaagtcaaataacttaaaaaaaaaggttgtcagctaccactgcatcccagatgttagagtttatttctaaagctgttcttgggtgctgtttaatgttccagtggaaaaaaaaaaaaaacacctgtaatactccagtaacatttgactagtcgtgaaatctagccatttagatttttcaacctcaatttgaccgttagttgcaaccaagtgattataaacacatgataattttttaatgagaattatctgtaaacgttgagatgatgagcctgctgctatgttggtttaatagataaagcagaagtcagttcagccatcttcactgatgattttcagaattaacctgatcactcaccatggaaataccattcccctttgttcttgtcttcctatgtgtgtgacagtccctaacttgacccctggcatggaagccatcagtgaggatcaggtgatattgtctaaaaataggtaaaggatgctaacattattattagatgttcaaaaaaataataaaagggaagcatgttctgtttcattttgagcaagaaaaaaagccgtaaaatcagaataaggagatagtcatgtttttggcattgatgaaattggcaggacaaagtgtgtttttgagttggctgtatggaactcagaatgtattgtcccatattgttataattaatttgacaagaaatccagggcttaccaaaagccatactgggcctgcattggagcctgtgttccagagaaaatacctttctgaataagtaactgtgatgcagggctgggacttacacccggtctgggagcgccctaaagaggacaagcccgctggcttctgtggggagtcactgtctcctgagggcagcgcacagaggctcatgtgtgtcccttcactcacagagcccaacaacagcacagcacatgctgttgacacaactgttgctttcctaagaaacctcacggcatcagatattttaacaaaaccgttctttaagaggaaaatggagactagagcctagaaagtttcacgtatgtaattacaaatcatttttcctagagaaattttaccccaaaagtgttctgaggctgtgggtgcatttacctgtttattgcggattaacagagccattgaatctatcccaatggaaccaccatcacacactttcacctgtgttcactgctcctcccgtctgcccatgtctttggccttgatcacgccatctctctggaagcccagctccaggtccaggaaaccagattatagcagaccactgtgcccctggccagggaaccgcctgctctggtctggaagccccggggccatgctcgctgtgttagtcaatgctcttttggttgcatgagatagttgaccaacttaggttagctaaaatagaaaggcagggagggggtgggccagtggtgaattattaacttcttaacttgcatctctggagctgccaaggggatggatttagttttagaaagaccctaatctcctgatgcactgaagttcttgaggagccctctcccccatttcttgcctgtgttgggtgggcatcatgcccagcaaggtctccccacttggtagcaagcccttcatggtggtttcggtccttagtgctcagatgtggtgaggagggaaaggtgaggatttttgtcaatagctacagcaaaagactctaagtcagttccatgtggcctcatttgagtcaggtgcttttccctaaaacaatcagtatcacaggttggaggggatgttttgattgttctgtcccttcgggtggggagatgaggtcagcctaattgagctgagtggcttgagcaggagtatgatagactagggctgggcagaaggtggactccagaaaaggccgggaggcaagtcccaaccctgtgtcttcagggtttgtccgttttaaacattttagccagggtggggctggggggagggggtgttgtgcaatgcagttctctttcctaattcacagatcacgttacacccagcttgcacggtttgaacttgggtgctaaaggagaagcacctggggtatgtttgaattcaccccaaagctacctctggtaagtgtctccttgtgacttttacagtctcacttgggctgtggacctctgacattttcaggcaagtttttgcttcttaatctccaatgctgaaagcttagtctttggaatgttatacattgtttggatcttaaaaatgtcagctcacaaaataatgtttttacatccttcctccaacatcatcaaccgcattagctcaccaccactcctcctctccgcttctcccccaacctgttttatcggtgtcaggaaaggggagcgatcagtctctcaggaggtacccatattgatcataatatagcctttcttaggcgtagcagtccagcaatcagggttcaatggtttcctctggaaggtagcatactgaaaaagacgaagtgcagagaaaagacagggtgggggtgcagcatgtctagtttgggggcctggctgtgggtcagaatggagagattgacacttcagagaaggccgggaatgaaattgaatgtgcagagcacacgttccactcagcaccgattagagctgggattgcctctcgcaactccccaaagaaaatgctgcgtccttgtaagaccgtgtctgcccagtgggggcctggacactaagtgccacttctctgcccatggcaaattccaagggccaggacgatggagacaagggaagtagaagttgaaagaaactcccaacggcaaattaggtcgagtgccagaaagaattacatcaggagaatctgagatgtagtgaaagtgcccccaagctccccgctccatttcatgtgctactggctggctgtgagatctgaaaaggactgggcccagactctgtgtgtgtgtgtgtgtgtgtgtgtgcgtgctcttaaatcaatgtaaattaggctatatacagctgccaataatctgcaaaagatgacagtttcatatgattccaatggcttaaactaacaaattcatgaatgattgacccagaccagaaatggaaacctgattcaactcacagtgtagtcctttatccatgcttgttggcttctggaacgcacagtgttcaggaggattctgaggcagggtctgtgtgcaggaggagtgctagtgtgagagctgctggtgcctgccctgggtccgaaagctggtggtggtctgttcttgttgtatgagggcagcccatgtcgccagcatttattttctgagccccatttcttaatgttgtatatttttttaaaaattaacaccaccataagcaagaaggaaaaaatcaacacttgctctttgaaggccaaatacattgaaatgaaagcgtgcctagtggagcaagagcggggcggggaggaggggaagccagcctgcagcattgccctctagacactaagaagaagggagtaggtttaggttggatgaagaagggaggtttggagcctggacgagagcaggggttgtggaggaatggtcaaaacccaggcgtgatgtgaccacaccatctggcaggggaccaggccagctgctgtgtgggtcttccatgtcccagggacggagagaggagaagtggggttggccaggcagaggcatgataagagtcagagtggctgggctccagggctccagccaggctattagcaggagcactggctttggagggggacctaagaggacagataggggaatccccaggccacctctggaccttgacattgactaatgggatgagctgctggaacccatcaccatgaagccccctgcactaactagggcgtgtgccccttgaggagccgcatccgcttattgggcctaagaaaaactgattcccaggtgtgtttgggccgtctagaaccatgtgacctggcagccacttcaacttgggcagcatctcggctgggagccccagggagcctggcagtacctcagtggcagatgcagctcgttccaagatgttccagaggcaggaggttcctggaagaaccactgggccttgcagggtcagctcagcctgagagccagtgaccccctcccccaggaggatgctgtaggggcagtctcacggcggtctcacctctgccacctgtggatgagaggctggaccgggtcttggtgctttccagctcagggcgttggtccacttggttattcttggggaccaaaatccaagctaggatggggacagaggcctggagacaacctgctggcctccttccattaaagccattacagtgtcaccacaggattgtaagaattacaaatgcgttttccagagtccccagagaaaaaggagtctggcagttagaagagtaaagtgcatctgtcaacaaaagaaataccaaagatgagactacagcagcgacttgtcacctcttccgtgttgctactgcctgagaacagaggtttttagtttctttaaagggttgtaaacataaaaacaaagaaggatacaacatgcaaggcctaaaatgtttactttctggccttttacacaggcagttcgccagccccctaccctacagtatggaaaaaaggcatagaacagtcaaatcacgtaggatttcttagtttctccatgcaggctcatcgaatagcaaccatcctttcttagtttcttgaaacaagtaccttatttacattcagagaattatatgtggacaaacagctcataagcccgtacttttacatactcacttcctgaattgcatattgaaaaagagagttcatgtaaagccgattattatttaatctaaagttatgttcacataggaagcactagtgtagagaaatagggtctgagggacaaggagcctgtgtgcccgtgtcggcagccgagtaactgccaagggtcccctgcttggcactctgctgtcccacttgcttcctgccctctctggattctaacacttgtgccattgtgcatccgtctcaggtcatggtgctgttacttggtgagaaagcattatttaaataccccagatgaggagttaggcactttctccagttttgcaatgctcttttgtttaccttttaaaaaaaaaaaaaaaaaaaaacgagacaaggtctcactctgtcacctgggctggagtgcagtggtgccatcatagcccactataccttgaactcctgggttcaagcgatcttcttgacttggcctcccaaagtgctggtattacaggtgtgagctaccatgccatttaccttttttatgcttaaaataaatgtataaaatattaaaaatcattttcctcccaagaaccaaacgtgtattactaaatatgtttagttgaccatgcaggctatttgagagacagtgggagatgctgaaatattcaagcaccactgttttggtgggtatcggaagattttcaatcaatagtttacttatttggttatgtattaggttgtattgggtggggccaatcattatgtgactatttttttcttcagagtggtgattgaaaagcagcccccaaccgttttctccgagaggtgcatgctgagcctgcctgcagcttacccccaacccccagcccctagcccggctctccttgtcttacatgagtcagtttccttctgctgctattctggacaaaaacctctatcaggacagagaccttgtcttgttcaccctattcctggcatcaaggctgtgtctgacatgtaatggggatggctgtttgtttggtggtggttgagatgaccaagatgttcttgacctgtgtagggtggtagtggagaaacaggcacaggcccttgtggtgtagttgcgaaaaaggagctcacactaatgggaaccagattgtatcattggctgagtatacagcagatgcgttcccctttgttattttatcacttgcttacctggaagctctggtctgactttaggaacatgccacacacttggataaacatggactcctttactagagatttatagaatctttttcctagagccatttgagaagcacttgtccaagacgtgctattttataggctattttgatgtaagggaaaagacgtatcctggatcttccagaaagcatggaattatggctgcgtattaggaagaggcctggctttcctgtgggaattgaacagaagacaggcatctctcatgttctggttgttgcagttttgcttcttctgttcattgaattagcgtttcagagctctccatgtgtgagtttccatttggaaatggtatagtcatcatcgtaatgtagcagtcattcgttaatttttatgagccacttgtgacgtttcaggaagctgacagccgacatggattagctcatttatacctagggaaacagaggcaccagaggccacaaaagctattcagggtcacacagcctatgtgtgaggtttacataataaacgtcaaaaaacgcaggctctaaggaacaaaaaggaagatttgagctgggtggaggctccttatctctcctacaacctgagccaacaacaccccatcacttcaccccaaagtgcgcagggaagaaatggaaggggcagccgtggcctcatcttttgtgctgtttttctccagcacaaaaacctgtgtgctgtttttctgcagaccttggttttctcatcttgaaagttgtgaatctgtgtcacattttcctggtgtatcgcgtgcacttttgatctgcggattcagatctttctgcgtctcaggaacattcctttgtcttttatcttcgaatagtctttgagttcttttgttgtggatgtgttgtcagagataccatttatccttttgtttaggtccgtttgtcaatgaacttctctcttaaatactttacctctgtctttttaatctcattgactgtgtctgtttcaagccattcctctgtgtcagaaactcagctttcagccttgtctcttctgctccttactttttctaattttattcatcagttccccaaatgccgttttgatcctcagatctggacgtttccattttatctcatattgtttcaaattctcatactggaggttctcgtctcctggaatggctgttctttcttaagtcacactggagtgggaagcggttgtaagggacttccttctgctttttgagctttgttttcttctccattgttgctttgtttctcttctgttcccttccctccttcctctccccaagcctctcccgccttcccattttccctgctggggagcctttgcataatgtccccagccctgctcttcagccttcttggcttggacctctcttcccagacattgtctttccctgagaccgatgctgaccactgggaagacttctccctcattctgagtcaaatctaggctgttgggagcccgtgaccgccctgcttcctgtggtgggagaaggtgagggagaggagatgctctcatcctgagtgtcctggacgagatgggccagaccattctacccacactcccatttgccagacctcagccacctcccccagccagccccaggggtgttgggggcatctttcgagtctcactgcccacgctgtgggagctgagactggatgctgttctggagatcccaggatttactgagcatccatgctctgccatccgtctagttggagggagctgcctcccgttgaaagagtctgcccttctttagggaccagggctctgctcttcctgggaatttaccacatcctcttccaggttcccttcacccatcctgcggggtgggaggaatatatcattgttccccttgaggtgcccccctgcgtgggtcacttctcccgctcaccaggcaacacgggcatcttctttgcctccggagagcctttgccggccattcacttccaaggctttcttatttccattcctcagtcaggagacgaaaaagatgaggccacggctgccccttctgtttcttccctgcgcactttggggtgaagtgatggggtgttgttggctcaggttgtaggagagatgaggagcctccgcccagctcaaatcttcctttttgttccttagagcctgcgttttttgaggtttattatgtaaagccgtgccccttttcctgttggatggtgaagttccttccttctggctttaatgtttcccccttgttttattaggaaaggaggaaaggaaattcagttatagtgaagttctaatctgccatcttaacctggagtttggcttttttcttgttctgtgttccttttgtaccttacttagatctcggttaaatgaaaccatgagagaccgtggcctgcccaaggaaatcgtgttaagtgctcacttcactgcgggtcagaaccccggagtgtttcacccatggaaatagtcagcagtcgccacatgcagggtcctcactcactgctggtacctttgtgtagtagttactttgtattttacaatgtaaattaaaaaaaaaagttgggagaggaagtgaaatctgatttggctaaattttgtaaacaaagatgttaccaataaaacctttttcccagtgtataaataatatgtggtccaaaattccttttaaatgtcacaatacaaaacttttccaaaaccccaacattagtgactgacttcagtatttttatcaaagttaaatgagccaaacttattttttacaaatttctggcgcattcatgattgaaattttaaatattctcctagggaaaaacgagggctgattgtccttttcaaggtatccatctcatcccacttgttaaaaataattagggaataatacagtttgcagattttctcccgatgtcatcatggcactcagtaacaaggaatattgtagatgaattttgaaaatgtttttcctggaagagaatcccaaacgtgtggccgaaagggacccaggacctgccagccatgctcctcctgtctttctcccttccagtctgaaccccacagcgctgggcggttgacgaggtgtggccagcttgcatctgctgaaagaaccggggtggccccactgcatcttgatcagacactgccatgaggtccctcccctctctgatggcaaagggaaacagtgggctctacacatggagctttgaagtcaagagtcattttcatccttagctcaggcatgaaaaaaaaaaaaagaatagtaaaaattaaaaaccctttaaaaagataaaaatcaacagtaaaaaatgaaagttacagacaggtgtctgtctttttagtttcctaagcacagtgatgattattggagctaaagacagaggccacccttcccaagtgtgagtggagtaaggataagatagtcccgcctctctgcctgtttgatgttggccctgtggatgctgcaaaacgcagcaaacacggaggctgccggctttgtttctgtagggcttgtcttagcagaagttcacatggaagagaggaggcgtaagaagcagtcagaacgtctggattggagtcttggtcctgccgcgtgctggccgtggagctcttgctctgtgtctgaactccttttcctcctgagtggatttgggtgttgccagtgatgtttgcgtcataagatggggtgagggctaacggagatgatgtgggaaaacaagtgctttgtatcctgccgcgcactggccgtggagctcttgctctgtgtctgaactccttttcctcctgagtggatttgggtgttgccaatgatgtttgcgtcataagatggggtgcgggctaacagagatgatgtgggaaaacaagtgctttgtagacgatggcgttggaaggcacactgtcgttgccatagctgtcgcttggaggactgttaatgatacgttgatagctttcagttcaattagccaaaatgacagaaatgccaaacatctgttgcaatgttgactcccaaaagggccctttttttggaatgggaaaattcagttttctctttattttctttttcttaaagcagaaatgacagcatagatgatctccctctccgacttgtctctgtgtagactgcacttgtgttcaagaggctccgctgtagctcaacctcgcgtgagtgcagaaacttgaaggaacccagttgttttacttcccccagcaccccaaatttaaaactggctctcacattgtgagacagcattcagaatagtaatcgtgaaaggctatgaggacttagaaaaaggtatttaaaaaacgaaagagtgtagctgtatccttttcttcctggtgcgctgttcattcacggtgaacgcacccacttcagcatcttggtggaaataactcagttccaccttccatatacttttctctctgcagtgtgggatttagggagaaattaagacctcgactcgcttatgaatacaagctcaagggcaaactaaggcacccagcgcagtttccacatgttctgggaaccctgaacacttgccttggggtgaaccagaaacctaatacattgcacattgcacttgaagttgagttcagacaagaagatgggaccgctgtatccccaagtagctcgggcgaggtgagagcactccattctgcttcaaactcagtgcagaaagccaagcccagaagggatgcgggttccgttctcacctccctctgctctaagctgaggattccaggtgatgctgtttacctcctgtgatatccttgtgtcctggggaagcacagatttcagtgagactgggactctgttttcccctctcactgagatgcggtcacagctgcccagcgacctggttccaccttagggtcaggcagctgcgaccgatctgtctggttcctcaccctgggggtgcccgccgttgggaggtgctgtggttccagggtgggcgctggtcccttcccacggagctcgcctagcacctgttcacaggtgtgcctgggccagatgcatgtctgacagggacatcaggtttggggagactgaaaaccatttttgaaaatgaagttatgctgatgtcatttaatcgtacgtcatcataattggcagcagagaaggttgcacatcactcatggcagatccattacatgggccatgggccaagctgtgcaccaggtgctgggaggataccggtgggcgaaccagacctgcaggaaaatacatggaaatggggacaaaacaggcatttcagaagctacattcagcttgaaactggatgtaaaatttgatggtatcctctaaaattctggtggaaaaaagatctccctttgggaggctgaggcaggtagaccgcttgagcccaggagttcgagaccagcctgggcaacacaatgaggccccatctcatctatccaggtgtggcggcacatgtccgtggtcccagctactcagggaggctgaggtgggaggatcttttgagcctaggcagtcgaggctgcagtgagtcatgtccgtgccaccgcactccagcctaggcaacagagtgagactgtgtctcaaaaaacaaaacaaaacacaacacaacaacaatgaaaaatctaatgactgggatgagatctgatgaaatggtaggttgaatttaaaatggtgcaagtggtggtgcctgcagagtaccagcttgttgccaacgatgctgtcatcctaaggctctccttctgtggttaaagtggttcaagtgtagaaaatgaattttaaagtgttacctacctgccagcccagacttctcaaggcccagtggtcctattgagctgaacctgctcccatcagtagtgccctgcgggaccttttgaaaatctccccagtaaagacattcttgctttcatacaacctggctgctggagcacctggctgaattttatcttattattcacctttgagttcgtggcaaatacttagcagtatttaatttttgctttctgatttaagtgtaatacgaaaaaaaatcatgcaaatcaattaccagtatctggtgtttgaaattgtaagatgctgaaaagaactgttaattatactctgtatctgccgggggaatgtaaactgactttaggattcgaagagaccttgctgatgagagaaggaatcactgctccttttagaggcaatgaaagttgggcctggagtcctttgcttgagatcacaaagccagagacttcaggagagcagaaatgagaaggctcagtgccctcctagggaacctttcgtaacttgaatattgtgattcagccacctggaagcttcacttgtgaacgtgactctgcaaaaacatgttagaggaagcaaaggagaggatggacgtgaaatccgtcctatgcatgctcacctgacatgcaacagggagggtcatctgccagggcgtcacggtcattccacgagagctgggtggtgacgctccccaagttcccactcctggagaggtaggcagcgagggacactggcgttgcagggcccctgggacaggctccactcctcccttcttgctctggaggtgacacagtctagggatctagtgaggaatgggacctggggccagcgtgcttggacaagacgaagcctcatcaaagttgaaccttagggttcatcaagcagggagggcttccacatacccttgtatctggggcaaccatcagagggcagggctggagctggggccctgtagggcactcagcgtccggagggcacagaggagcacatgtggggctcaggacacagggtcgggacggtgtggcggcgaggtccctctggctgtgatatatgttaggggaaggagggactgaggccgggagtgggcacgggcaggcaggaaacttgtgcagaaacctagcaaagaagtgtgggtgatttcaatgaatgtgaggggtagggaagggagagcagagggagattaaaaacacttgggggtgagataaatggggcagggatggtgaggatccctgtttgctgagctcctctgtcccaagcagggttctaagagcttttcatgcattaactcattaaggaaggctctgtttaccctcatttcacaggtgaggaaactgaggcatcgagcagttgagttacgtgctggaggtcactcagccagggagggctcggcagggatttgaacctggtgggctggtgcctggggccacacacagaacagggtatgaaggagaagattcttctccaaagaaagaggaacagatttccttttcaaatgttatttttctttctttctttctttcttttttttttttgagacacagtcttgctctgtcacccaggctggagtgcagtggcgcaatctcggctccctgcaacctccacctcccaggttcaagcaattctcctgtctcagcctcccgagtagctgggattacaggcccccaccaccacacctggctaatttttgtatttttagtagagacagggtttcaccgtgttggtcatgctggtcttgaactcctgacctcaggtgatccacctgcctcggcctcccaaagtgttgggattacaggtgtgagccaccgcgcccagccttaaatgttatttttcttaaaacagtcaaattcaattcacatcaccaagatacagcaggtttccagcatctctttttaaaaagtttttttaaagggaaataatactactatcactgttgcagacttttctgtcgtaagcaggcttattcaatgttaaatacgacttttattaaagcaggttaaaagaaccttggcagaaatttcaaataagactgggtcgggtactgttcagggtgctttgtgtcaacttattactcctcgcctgctaggacatcatcccctttgcatctggggacactgagatggggcgaggtggggcaagactacacagctgtatgtggcagagccagggttcaggcagagctaggccagtatcggggtctgggggcgaccgtctgcagcaccgtcacatacgtggggacgtccacctgtgtcagatgtttcccagcttgtttcatgatgacaacagctctgctagaaaagcatttcttttttgcctacgaggactctcgattcagggaccctgagtctttgggaccctcgtgcagctggggctcaccctgtctggacccagcggcctgactggcctggatgtgtcccctgctaacgggcctcagcctgaccatttccagtgggccctaccgtcttgtttcagtgactggggggacagcaaaatgagagtttatctgctttaacatcaaaaggttttcttcattgttgtgttattgaatgaactgaacagcagatttatttgctttagcaaatgcggctgcctgtgatggtggcataggtgttgagtgtgagcacacgagcatggcaggagctcgcgggaacgggccaacgccccactgccccagtcagccctctgtggcctcagagggtagctgcccgtctggagggcctcggacactttcaggctgggatggggactctgattttttgcttctcaggcactgatgtggttcagacccaggattctaggagggaaggttcccgtcgcaggggagggaatcagacgtcgctctgggcggcagtggagctggcaggcagcctctgggctctggcagcattgtcctctgggtccagcgatttggggtttagacagggtttctggacggcatctgcacagaggagcggaagacaagagctgggaaccgatgcgtgccttccctctttaaaacaagagtttcgaatccccatgagggttccctagcgtggtctcagagcccaggatctggagggggacgtctgtcattggagaaggcagaggagccagggtggaatccttcccgctgcccagcaggagcagggctggcctagcgggccgggctgggcactgcagcaaccttgtaccatcccctcctgagagcatcaggggccgggacgtccaaggtagcaccaggcccctcatgcccgcaccccctcctcatggtcacctctgttcctgcagggtcccggtggtctcccgctaaccccgcgtggtctctaacgcctcctgtcagccgctgctctgctgtctccacccgtgcggaggtcccatccagtagtttctgtctaacccatgtgtagtagtgaagcgtccctccctaattgtggcctgtgactctggaaacaccattctcatgatgttctatgtctccctttcaagaactgggtttctcttgaggagaatacaggttctcggccctgtaatttaccaagaggttgcagatcaggcacctgttaagcatgaaaaatttgtttcagttttgtgaacccaacaagagaatgacaattttaatgttctctgtttcccagtgagtgagaattcctgaatttacatagaaagcccacatgagaagtccacactaattggccacgagtgtctggcattgcgaaggaagctgtgccttccaactggaaacgcacaggggttcttaaagacaaacatttaaatctgagttcggctctgttaaaattcagcatttgctggcaacatcctaaatactcagttgcctccagggcgacagcctagggtgtatttttccacaagcgaagcccacgtctgtctgccctcctcactctctgttgttctcgtgtaacgagatgttttgtgtgtgtggcaggtggcaggttcaagaaagagattgtcgttgatggacagagctatctgctgctgatcagagatgaagggggccccccggaggcgcaggtgagtatacatgcatgccccaagcctgctttttttccctttgttttctaaggtttgattcaagaagtgcttctagaaatcggtgacttggtttccaaaaaagtggaaaccccataaaaaatgtttcctctcactgcatttttttctcatctctaagaagctaattctttttttatttttttcccagactaaatcctgcagggaagttgggtttatgtgatggcttttcactttctgtgtttttaaaaaggcaggaaacgcacactctgccctggttggggagcccagttgaaatgacatctggaaatttctgtcgtttggtttgttttttggccttttcctttgagtggtttgatctctagagcagtgagagttagagagcttgctgggtgcaattgggagtcccaccttctctctgtctctggtaactacaggcattggcccctctgtgccgccctggccttggcccaagcaaggcagtctccaccgaaagccggtatgaagcatattatgatttctttggaagttcctggaaagatggtcattctggaaataacaaaacatgagtgtggaagatctctttttttggtttatttaacctgctttgttttacttacagcataatttaccagttaagcactttattattattgttattattattattgttgttgttgttattattattattgttattttttattatttatttattttttttttttgagacagtctcgctctgttacccaggctggagtgcagtgacgtgatctcggctcactacaagctccacctcccaggttcaggccattctcctgcctcagcctcctgagtagctgggactacgggcgcctgctaccacgcctggctaattttttgtatttttagtagagatggagtttcaccatgttagccaggatggtctcgatctcctgacctcgtgatccactcacctcggcctcccaaagtgctgggattacaggcgtgagccaccgcgcccgacccatttaaacacttcaaaggagccgagagctggtaacggctagtgacctcaaatgcaaacggaatgtcagacattttcttggcattatttcctggacttaacctttttgtgaacgggcagcataggattgtaagatggagaaagtgaaagatactgaatacaggacttcttaggcctcaggtctagtactccacaggttggagggctgtgcggttatacagaagatgccacagatttgccatgttgcattgactctgaccattgacagtgaccattaagatgtaccagtattcgaaagaaggatgctgccaattaaactatgaaacagccgcaataattaggtgcattctgatttcaaagctgttaaagtgtgtaacattttgtttcttagcattaacgataccatgaacttgatcataacaaggaaagaccttgaagacgtgttaaaagtgaaaacttagttacaaagcagtttgagcccatgttcagtgaccgtctggtagtttatagtatggcagggcaaagttagaggtctgataggatcctatcagtcagatgctgataaaagtcagctctttcttagtcccactgaatgtataggaccgtgtttgttctgctacaaaggaactcttggaggcaaggtccctcctgtggctggtgataggagaaagaagtaggtaacatttagaatcacctgagttgattttccgttttccccagcacataaatgttttgagtgactggaaacaagcttttttctccacaactgaagagcaagtcttaccagtatatgaagcacaaaagcttaaatatagagaaaaatctacagaagaggctaggtgcagcggctcacacctgtaatcccagcactttgggaagctgaggcaggcagatcacctgaggtcgggagttcaagaccagcctggccaacatggtgaaaccccatttctactaaaaatacaaaaattagccaggcgtggtggcacgtgcctgtaatcctagctgtttgggaggctgaggcagcagaatcccttaaacccagaaggaggtggttgcagtgagctgagatctcaccactgcactccagcctgggcgatggagcgagactttgtctcaaaaaacaaaccccaaagcatagtttcagttttctgatggtgaacatgttagattggggggttatttattgggtgccccccacacaagttgctggggaagtcagaatgcacccttaggagatgagagccacagttcacgtttcctccgggtggatgctcagatgggcttcagctcccggctcgggaactgaggtctggttccgggtcagccagtactctttatgggcgcagtgggagtctgctcctcctgctttcttagaagagacaggaagagcctttctcaaggcagagaagaggaaaaggagatgccttccgtcagccttggtcctggcactctctgtgggagctgctatcacgatcttcccaggtctctcccggccttctttgttttcaagtcctcattctcatttaattttgtatttatcactagaactttgggttaagttttaccatgtacatgttttacatataactgaatgcacttttcacttacatgcagaagtcagagtttaacctgttaaaaacttagaccaaatgtattagaggtgataaccttggccataaaaacctatctaggaactacagcttcttttagggaaagcagacgggatggatttcggttttgtttttcaaatttgcacttggaaagagaaggatctttgttgccagatagagctgatgtcagatgtgctgcgctggttgcagtgagtgtgggaagtctctgccctgcaggcagcctccactcactcagctccagttttccaagatggctgttggtactaaatgaggtactagtatatgcctgacagtgtgggtatctgtcaaaagaggatgtgatgtaggttcaactggcaagacaagaataaaatgaatacggcaaagcaagaacaaaatggcgagagtgaggctattgtgaagttttcttccctaagttttgttaatttccctgaaaataagtagtcatttctttgcagaggtgcagcaggagttcagccaaggatgagcctgggttgaatctttacccttcaacagagtaggccagccgctgcggtagcgagtgggaaggactgaggggtggggaggttctgagcaggcatgaggggtccagcaaggcttccttaagaggttgagagtacagtggaaagccttagggcttgaggggctctggcaggaggtgggtctggccttctgtctgcggggccgccttggcaggtcggggcagcgggcggacaggccaggagcatgaggaccgcggggacactgtgtggtttgtgtcctctgaagacagagtggcttgggtgggaacaggatgaagggcccattcccaaggggaacaccaggcatggtgtgctcaggaggaggacgtggatgccgtgacagtgtgtaaaagtgacagtcaaaagtcaagcacccagtgtgtgaccgaggggattcctgcagccccctgctgcctgccgccatgcagacatctctgttcttaatcaagcctgctcactcagctcctgctctcctccccttcttctctccctagtttgccatgtgggtggacgctgttatatttgtcttcagcttggaggatgaaataagtttccagaccgtttaccactactacagtcgaatggccaactatcggaacacgagcgagattcctctggttctggtgggaacccagggtgagtgatgttcgtgtgcagattgttttgaaagggttctaacagttacatattttcagtatggaggagtttaaaaaatgctttaaagaaggaaaaattgcctactgaacgctcacttttttgggaaaaattatggaactgaaatgatcacatttcctgatttgattctatggtgaaaccactcatttaacaacctgaaaacaacacacacacacatatcccaggtgctttatgaaaaataaaatctattttcccttgttttctggaaaaaaaatatatatgtgtgtgtgtatatgttttgtatatatatagtcaaatacatatatatattttctgctatattttaattctctgttctataaaatgatttataaacaatctattaaagcttatctttcagtgcaccttgaaaatagtgctgattttgaacatagagcagttctgtttattaagttctgtttgtcaccgtcttatgatctgtatcttatttttaatctgacaggcccctcagacagagaatccaactgggcacatttcttgttttctctgagggtcacttcgaacttggtctcttagtggagtggccgtcacatggcctgagacacaatgtcctcgctcttgatcacagacctatggttgtgctgggtctgccactagggtctaagatgtcacgtaggatgtttgtaaaagtcagatggaggttagctttacaactgctttgtcagaaatatgggtaacatacaaataatcctatcaggaaaaattgtatatcccttcatttttgttgtggctatgaatagactgttttgcgaattcttttagaatgagcctatctgacatgcccatccatgctctgatgtgagacgcttctctttaggacgtcagctgtacatactgcactaggtgtggtctaagtaggaggttgcccaggcagatgattggctgcttgatcacgaacctacaaaagcccagataaatagtgtggcataaaccacaaacattttccagccagacgtggtggctcacgcctgtaattccagcactttgggaggcccaggcaggtgggatcagttgaagtcaggagttgaccagcctggcccacatggtgaaaccctgtctgtactaaaaatagaaaaattagccaggcatggtggtgcatgcctgtaataccagctgctcaggaggctgaggcaggaggatcacttgaacccaggaagcagaggttgcagtgagctgagatcacgccattgcactccagcctgggtgacagagtgagattctgtctcaaaaaaataaaaagccgggcatgttggcgggtgtctgtaatcccagctacttgggaggctgaggcaggagaatcttttgaatctggggagatggaggttgcagtgagccaagatcgtgccactgcactccagcctggtagacagagggagactccatctcaagggaaaaaaaaaacaaaactataagtatcttttcagtgtgctagatgagagatgttagagttgggcttcctggagagcacctcccccaacttttttttttttttttttttttttttttttttttaaagcgtacgtggtcgctctcactcctgaaaccttcagagccagagctctgtttaatcctaacacagaagggaggagggattcttaggcctaatgcaccctctagtgttcaccaggagacaaggccgcaccacccaaaagtccttggttcttgtgagaatgcagagttgccgtatttgaggtggcatcttgaaaatgcctaatcgtgttttaaagtggatgctcatccacagcagattctgcttaaagctgccttgaagtcgaatagagaaattccgaataagctccccttcctgcaggcccgaccgtggcatttttgagcagggtccttcggggctgtgtgtgcagacaccactcacaggctgctggagctcaggaggtttgactttaggactcagaatgggcttttgcttagactcactgtgaaaagtgacagtgaagttcccagcctggaaagatcccctgcgatcaggttctgttctctgagttctgagtacacatccatgttccatcagtaggaagggagtgtctgagatcccgggagttgggaccacacacacctgcgtgtgactggctgctggctgggtgaccttgacacctgggactttggtggggttcaacaggaattcccagaagacactcagtgcatccgtgggtatgtgataggcatcttaacaatggctgcttttgttcctcatatttcaatctgcgaccagtgttccagggtcctgcctggaatcctgaaccccaccccccactgtccctgcccctggaggcagcgtatccctctgagtctcctgcctgagccaaggggcacatcgagcctcctgccagggtggctgcttagattctcgagaaaccctgatgaagttgaagtccttgagtaaaagaaagtacccccatttattcccatgaattccatgaacatccgttgatcggatgtggaaagatgcccaggaaggccccaggggagtgtgtgcgtgtgcgagggtggcctctggggttgggaggtaagtcagccccacaccctcccggggtgaacaggtaagctggccccacgccctcccggggtgagcaggtaagcgggccccatgccctccctgcaggactcctcttagctgggccacccccagatgaaccagaacgaaaagttgcaatcagggctgtattcctcacctgcgggattctcttggtccttccctagacttcagggagcaccccagaaagcctgatggcaggaagctggcatgcacgtgggctctgagggtccctgccgcgacgcttgcttcctgcgtgcagacttgctctccgtgaagcccgtgctcggctgctctttcaggggtttggcttcctgggatgccagagacaaaagagggatcaggttgtctaggaaggcacctggcatttctcttcctgctgctttggggtaggcagcgttagaggtcagagcatatgggatgggaaagaacggaagaggaattaggttcattgccaaaggattcctgggctggggtgaggcctccgcccgctggcgggaggggcagctctgccagcaggagctctttctgggcagtagccaaggactgcacgaatgttcataattgggcaagatgggaatgaatgaggtaatcatttaatgtttgttaaacaagttctgttttaaagacttgcaaattaaattgatttgagggagaagcacgatctgtaaaaagctacggagttaaaagtggaatgaaaatgagacaggtatagaaccgaaatgcgagtgcagaagcccgttttggtgcagtggcagagattcccgtggtgcacctttgaagccgaaatttgacagaaaccaagcgagcatgccgctgaggacggaggggctgcgggattgctcggccgcaggtcagggtctcatggaagctgggtggatgctatgtggcctgtgttttcaaaattatcctagagcattgaaacatcatggacttgtaacttctttttacaattaaaaagaaatgtttatacttaaaaaaaaaactttcttttcttaaatgttgtgaaatgcaagtcagatttactaatcagcaagacaagaaggcaggacgaggtgccctttgaccgtatccctggaacgggggtgcagcctatggaggctgtagtggtgattgtcagagaagaaacccttaactgcagagttcacttgccttccagtaacgaggaaacgtcagcccaaccctatttcatagggctaagaaaataacatgagaaaagagaaaagaaaaaactgaataaattcctcaggacatcactttttaaatatacttcaaaaaatgaagttctcaaatgccctttctccacaaaaataaaatgtcaaaggtggtcgctctgttgtataactttgctgctatttctttgactggtggagaaatcctgttggtggatttttgtttaaagagttgtttattgttttctttggcataagagccttcaagccctatgaaaaagattcaggttaggaaactgtctctgaaggctgggcgcagtggctcacgcctgtaatcccaacactttgggaggcccaggcgggtggatcacttgaggccaggagttgagaccagcctggccaacatggtgaaaccccgtgtcgactaaaaatacaaaaaattagctgggcatggtggtgagtacctgtaatcccagctacttgggagcctgaggcaggagaatcatttgaaaccaggaggcagaggttgcagtgagccagctcacgccactgtactccagcctgggcgacacagtgagactccatctcattaaaaaaaaagaaaaaaaaagctgtctgtgaaaagtcctctctcctccctaagccctgtggctgttcacattccagctcctcatttctctgttccacgtgccactgtaactcaatagtaatggaatggatggggcagggctgggggtggggaatcctggcagctgagcttaaaaaaaaaaaaagctcagtttcttttttaggaaactggtgccgacatccctgtgcagctgctcaaacgcccccgtgtgcacacatgacttagattggggggatccaggtcacctgtgaccctgagggggtccatcaaaacctcaggggactcgctgctcccctctccacacacctccctcccacccctctaggcctcacccctacatctccctcatatacaccagctgtcctgctgccctctgcctcaggcgttctgccccaggcagtgcctactgcgccccacctgctgcaggtgagggttccctgacctcttgctctaaaacccagagtcacccaagcctcctgacctccttcccggcatcagttaacagtgtggccatcttacattcagaaccattcatcacattcatctttcttttctgcttgcctctctggccaactagaatgtctgtttcatgagagtgcagattgtgtctgtttcaacaattcactggggtatccctgtgcatagaacagaaacaaaccccaaatgggggctcagtgagcatttattaagtgcgtcattggacaagtgaccacacctagaagaagaatgccagtgtagggagtatgcttagccacctgcgtggtgcacagaagggggcctgcacatagggactgtgtgtgtggtttttcctcctttctaaagtatgtatcctctagacccatatttaagtctttttccttctttctgaacattttaaaattgcagtttcagaagcgctcctgtaaaacaaatatctacgaatgaataactttctcttgtgtttgagtctcttagttgggaggcaaacgatgctctacaattccagattcataaactaattacatttctgctgagtaaggtactggttttccgtgttgtggggagtgtaggaagtatttagagctgtcattgtcactgtgccgttactttttggtcttctgttccagatgccataagttctgctaacccgagggtcatcgatgacgccagggcgaggaagctctccaacgacctgaaacggtgcacgtactacgagacgtgtgctacatacgggctgaatgtggagagggtcttccaggacggtaaatgcgcgtggctgggagtttaatttcagttcatgatagacgggaggcacttcaagaagtcagtcctgcctgcacttgtgcatgtgggtggtggaaatatgtcgttgatgggtgggcattagtatcgagagcagtccattccagaggcaattctcaggtatgtttcatataaacagtgctgtgttcagaagagacaacaaggcatggcttgagaacagcctggtgttgggtctgtgtgtctcctatggggcctttttgtgtacaggatagaacatttcttgagctgttactcatccatgtgctctgtaaaacttgtttgtgagcatttctttattgtaattgcccattcttaatccagtcccgtcctttaaagcagtttaaatatttgatattaggctttgagaagagaactgaaaggaggagagagagagtcaagtttggacctccccccaccaaaaaaataataaaatgacacgataccactcacagcagagggtgaggaccagccttttggaattgtttttaggttattttattcattattgatcacctaccttcaggaacagccacaaatcagacagaaaattctcctaggagagcatgaggttctgcaagagggtcacatacttgtggatgatcatagcgccagacgtcgtctatgagagaggagcctgtgcagatgcgtggggtgggcgggagaggtggcgtcaccctggggataggagggtctggggtaaataaggactgatacttctaaagccagtcttttcaagttggaagcttgggagaggcatggttctggcagagggtccccttgctggtgggagtggtggaagtcacttgtagggtcctctccccttctggtttaaatccatgggggcagagccacctgtccccctgctctggtgcccagggggttgtcgggggcagagcagggcagccacactcgggctctccagagagtgctggagccgcttcaaggtgatggaggactcgccgcgctctgaccttgaagacccacggtgaaagcagtggctgcaggactgttcccgggacttcctccaaatggggcaattttctattacatgtttaaattagtcttcagatgaaattgtagggattctgtacattcactgttcaactcagtttcaaagatgacatcagttctcaaacttcacattttctttcctggagcagtgaggttcctttctaagcctgccgtctcttcccgcgcatctctgcctctcagatacttacctgtttttcagcacgttggtcctagttactgcttcatggcttaggtttcttctcgccttatccagtgccaatgctgaagaagcgcagggtcccctgaggatcagcacaaagtcgctggggtcccacagccccttcttccctccactaacgtatatctcgggcacctcctgctgcctctgtcgggagaatgtcctgtggggagtaaacctcatttcaagccgtgctggtgaacatgagtgagatgttagtgagacttggaagaactgtgcagggaggcccttagagctcttctgagaggtgcaccctaatggagcaaggtcactgtcggccgctgcgctgccgaggcccctgtgaatgttgaagtaaagcgtcgtagatgaagggtccccaggcccgtgcatgaggccagctgcctgttttcataaatagacttttcttcttttttttggagacagagtctagctctttgcccaggctggagtgcaatggcgtgatggcagctcactgcaacctctgcctcccaggttcaggcaaatcttgtgcctcagcctccccagtagctggaattacaggtacacgctgccacacctggctaattttttgcattttagtagagatgggattttcaccatgttgcccaagttggtctcaaactcctgagcccaggcaatctgcccaccttggcctcccaaagtgctaggattataggcatgagccaccgcgcctggctgtaaatagacttttcatgacgcagagccacgctttgtgtcgatgggctgcagcgggtttgggcccctctccagctgtgacagcagagatgagggtctttgcggcctgagaagcccagaatattcactctctggccccgtgcagagagcttgccggtccccgatgcaggatatcagggactcagttgtctggataagtttagtttccacagtgactcctttgcttttgtatttatcacggttaacatacatgagttttccataaattgatgagtgcttcttataaaaataatgttgtcaattaatgaatactgggggttgtcaggatgatgctgccttcctgccaaacagcctttgtacgttctggctgctctaacaagacccagtggcttatacaacagacttttacttgtcctacttacggaggatgggagtccagggccaggtgctggtgggtgtggtgtctgctgagggccatcctcctagtgggatatgtgtttgcatagtggagaacagaggacacaagccctcgccagtcccttcccataaaggcacttaacccatcacagggttccacccttgtgatcagtcacctggcagaggccccacctcttattcccctgggggtcaggatttcagtataagaatttgggttgagttccataccacacccagcacgttcaaggcagaggacaggcagccacccacctctgtgttggaagcatttcgttttcttcaggttgggggtggcaagaggagaataaggactgatatttctaaatattagtttaaaatattcagaaaaagcgtttccgttactgtgacagctcatgtcgcacctccccaggtgatgctgtgatgagtgtccgttttcatgggcacaggagatttccgttccagtttcgtattatagaaataatacactctcattatgtattcggattttggctgggcgcagtggctcaggcctgtaatcccaacactttgggaggctgaggagggcagatcacctgaggtccatagttcgagaccagcctggccaccatggcgaaatcccatctctactaaaattgcaaaaaattagccgggcatggtggcaggcacctgtaatcccagctactcaggaagccaaggcaggagaatcgcttgaacctgggaggcggaggttgcagtcagctgagattgcacaattgcgctccatcctgggtgacagagcgagactctgtctcaaaaaaaaaaaaaagtaggattttatggaatttgaaaagcaaatacctgtgaagctacaacttccgtgactattgcgatttttttgtccttaaaatattttcatatgaagataacatttttaaaataaaatcagttactttgtatattttatatcatagttatatggtatatggtttcttatttgtatatgtattttcatgtaaatcacaaacactctcattgttagtgagaaaagtagttgctgagtaggagctttattcagtacttagcaatccttaataacaaagtaaaaatcctcaaggaaagttaaacattgtaaggtttatataaagttgaagaaattgaggctcagagaaatgacatagcttgacccaaagggacacagcctggactggatcccccatcttgggacctgagagcctcgacttaaccacagcaccgggacattttgtcattaaaatggaagcaaatcaggtcctggggccttaagaacacaccagctttgcccacaggtctggggagggccttgcaggggatgcacccagccagcagggcccctgcctgctcgccgactcagtttattcacatttcttgataactctctggcttcttttttgccctagggcttactttgtttatttactttttatacctgtatatggtagaaagaaaacataaaggaaaagcgtgtaatttctacataatgtttggcttgtaaataaaaaaaaaaaaaaaatccagctgcttccattgccctgcggaggccatgttcctgattggctctgtaccgaggttcatttaaaaggccagggacctcattctttcttctccaacatttgacttcttagtgtcttgtaacaaaaggacattgtaaaaatgaatggagaaaccttgcattcactttttgttcgcttgtgtggtcctgtttactttgctttcatggagtttccagatggctactggcaagtggctgtaggtgttgggaagcagcctagcaggctggttcatccacccagtcactcgttcatctgagcaccagcttcccacacactgtgcgtctggtcaggggctagaggcagattgggaagcgcaggcagggtcccttcctccgtgaagttaaggtccactagggagggtaaacatcaaacggtcacccagaaacatgaccttgtgtcttgctcaggggtggaaaagaagtgtggcagcccaggctgctttctgggggtggagcgttctcgctcctgctcacaggcgagtttgtgtggcttgcggggctgggtgagctggttccacaagatggtttctgcttgacctgggcagctgagccggacgtgggctgtgggtacccaaccgtttggattctcagcagagccctggggaagggaggcactgggggctggggcgggctggatgtgcggacttggcagctgggggctgcaggtccgtctgcagggactgcacagggctctcgttcctagattgcttcacagccagcggctctgtgcctgtcagattctgcatggctctgtttgcctcttcctgcaactgggaaataacctatatacaagtttttctatttttaaagttaaaatggtgatttcagtgtttggcattaaatttttcaaaagtccctgttgatttgttctcctagggcctggatacatgaacatgaaggattacagaaaaataaagttcattccatgtagacattgttcctctggtcctacgatccctccccttccccttcccttttttcgaggcagggtctctgtcacccaggttggagtgcagtggcacgatctagactcactacagcctctacctcccgggttcaagcagttctcctgcctctgcctcctgagtagctgggattacaggtgtgcgccatcatgcccagctactttttggctatttagtagagactggtttttgccatgttggctaggctggtcttgaaatcctggcctcaagtgatcctctggcctcggccttccaaagtgctgggattgcaggcatgacacactgcacccagcttgcgattcttctttaaagagacatttttcccacttcatatgaagaagcagctttctgagtggcagcaagcagctcttctggacagacagagtgtgtgtctgacatgggactgtagtcaggtctccggaaggtcaggaagggtatagttttggtgatgggatttttcagcctacatgctgaaaggtcacctaaaatagttataacttagtgacaaaaataaatcctcccttcagaaggccaagtcatgttcaaggtggtagcaagctgtgtataggtagcaacagggcccctttgagcattacacgtgcaccttgggaggaagagagtggagagcgggctctgcctgtatattcttggagatggtgcattcagcactgtcgttccctgcagttaggttttggagagtgtaaattttagcctgtcttcaaatgctttgagtttctcgtcttcctgagtagcgtgttcggagctttctctgctgcgggtggcggtgccacagaggaacacaggggcctgtgttgtggcatctgttcaatcggggagacaggatcagggtttttttgttggttttgacattcttgagccaatgcaccctaacttttattgggcatagtttatgattgttaaattatggtgtctttgtggtagctgtatggcatgtgggattttaaaggcccctgattcctaaagaaagaggggtttccctttcataggcaatcaggagtacaacctgatagtggtacaaagaattgttttcatttcttctccaagcagctcgatgccctttctctcttcactccccctctcctagaatgagctgataaagatgtacgtgagtggtccacagtgtggttttatgcatggattgtttatttgcatcccagcatgttttgtatacagcaggggtccccagtcaggctgcacaggaggtgagcagcttgcaagtgagcattactccccgagctccgcctcctgtcggatcagcagcagccttagattctcctaggagcacgagccctgttgtgaactgtgcatgcgtgagatctaggttacgcattccttaggagactctaatgcctgacgagctgaggtggaaccgtttcatcccaaaaccatccccatcccccacctgccccccaacccctgatcctcagaaaaattgtcttccatgaaaccagtccttggtgccaaaaaggttggggactgctgctatatagaatttaatattcttgcatgcattttctgaaccttctagtcacttgttaaatcccagttcagaacatcacattagatatatgatctgcactgtgctaggacgtgctccccaccaaaacgtcagcgtcttaagcttgtattcatatgaccataggaaaacctacatgcagaactttgatagtagttgttagaccaggtcaagatccatgtcaaagagataaattacaaattatcatctctctgcttaacggtctccagggccagtttggtgatctcacatagacttctgtcctagaacagatctgcattattgtggagggagagacagtaggttctaggtgtatgggaaagctgggcagtggcactggaagggcgctgtgtgccaggtgctagcgctcccgggccctgtgtgccaggtgctagtgctcccgggctctgtgtgccaggtgctagtgtggccacagccttgtggcttattagggcttcctctgttcacacgctgtgtacatcgtcctggtggatgggtgtttatctggtagagtagttcctggtctaggcagatccatgtcagtcctttgacctcattgcccctggctttttatgtttgtgctgcagttaacattctggaaagcacttttatagaagccattccatttgtcttttgtcccttcccagtaacggctcacctgggcctatctaacccatgccgagagcccgagctgggagaggttgcatgatttttaccaaggttgtgcgggaagtcagggagcctcggtgtgctcttgatgctttgcttccagagattgaaatcctggtgtgtgcaaagaaccccatctcacattaaatggctgcagctgcctggtcctaattacaggagtgtccagaaccaggggagctatgttaatgagtccgtttgtgcaacctaattgcacgcactagagcatctgtgaatgtaagcagtcttctgggcctcttctcctgggtcctgcatcatcttggaccattttgttttgctcacaccacagtccttgtgctgttaaaggatgtatcagttaagcctattccattctttcctgaaatcagcttaattttcattgtcggggtggcctgttttatgatttgtttttgttgctatttttttctcctttattacagattagattggaactagtgtgtgtgtgcatgcgtgcatgtgtgtgtgtatatgtgtgttagcgagggaatacttcaaaaaataagattttttacacttgaaagcaagccatgtatatgtgtacattaggcacttgatatatgttgaaaaggtggattaatgggtcattaattgtccattttttaatcacttgtagtaatgactaataattatgcaacaatttaacggcttatgatgtaggatagtggatcttattaggcccagtttacagctgggactacattgttggaaatgctgccttcccagaggtacatggtgcagctggtgtcaggcgaggccatcatttcccgtttctacctgtggtcttggctgtgcacctgtactcatcactgtccccgtctctacaccctcaccccctccacacattgaaagtcttatttctaagacttcctgggacagatgggtggtagatgtgtattgggacagtatgaaagaggttcagctgcttaaattacacttcattaagggggttcatatttgaacattttctgagaacaaagatgacatgaagaaagtgacctctgtaaggctctggcagcacttatgcggtaccaatacaaatgggggttgggggctgagcagaaaacattcttcaagagttaaatgatcaagtcacgtaaggcgtgttgtttttgttttgttttgagacaatgtctcactgtcacacaagctggagtgcagtgacacaatcttggttcactgcaacctctgccttctgggctcaagccgtcctcccgccccagcctcccaagttgctgggattacaggtgcgtgccagcacacccagctagtttttgtatttttagtagaaatggggttttgccatgttgcccagcctagtctcgaactcctgagctcaaagcgatccgaccgcctcagcctcccaaagtgctgggattacaggcatgagccatggcacccggtcatataagggggtttgatgctggtttgggagacattctggtgtcgttagccctagggttgttgatgtcattcttttttttttttttttttttttgagatggagtctcgctctgtcacccaggctggactgcagtggtgtgatctcagctcactgcaagctccacctcctgggttcacaccattctcctgcttcagcctcccaagtagctgggactacaggcgcctgccaccacgcccggctaatttttttgtatttttagtagagacgggctttcaccgtgttagccaggatggtcttgatctcctgacctcgtgatccgcccgccttggcctcccaaagtgctgggattacaggcgtgagccaccgcgcccggccctggcagcttcacatgtagggccatccagtgcatgtgagaatctgcagatggtctccagaagagccacatctgacctgcctagtagcttatctcccagcgaatgggagaggtgcagacctgctgttgactgtaaggagacttgattcagcctgttggtgggggcgcacatgtgaggaagaagccttggtgggtttgtgtgggtctttctcttatgccatatccctggtttatatttggatgggaaaatacataaatgtttgatggtgatcatttttatgaaacatgacattgtcaactcctttcttcatatgcattttcgaattcagttcttaaccaaagaagctctttctacaacagggttaaattataaactgaaatagcaaattaataccaaaactaaaataaagctttttgtatagtaaaccatacattcagaggtttaaaaaaatccaacaaaatgaaaaatacttttgagttactatttttagaaaaaaattagtttgggttgaaaaattcttaccctcatgaagctataaaagcacatgttttactgatgagagaagcttctggcacatcaactgagacaaaaatcttccatattcactcggtaaatacaaatacagaagatgggctgggcgcagaggttcacagctgtaatctaagcactttgggaggctgaggcaggcgaattacctgaggtcaagagtttgagaccagcctggccaacatgccgaaacccccctctctaaaaatacaaaaattagccaggcatggtggcgtgtgcctgtagtcccggctactcgggaggctgaggagggagaatctcttgaacccgggaggcggaggttgcagtgagctgagatcacgccactgcactccagcctgggcgacagagcgagactccgtctcaaaaaacaaaaccaaaaacaaaataaatacaaatgtgtaagatagaattcgttatgaagctacaccagacattttcaggagtaatttgagaatgtgcttgaggtgattatccttaaatcatccaagtgtttttgaatattatttcaattatttcatcttagaagtatgaaatcagcttgtttcttgtttagagttgccctttctttttattattatttcttaattgagacaggatctcgatctgtcacacaggctggagtacagtgatgccatcatagctcactgcagtttcagactcttgggctcaagccatcctcctacctcagtctcctgagtagctagcgctactggtgcatgccaccatgcccaggtcatttttcaaaatttttgtagagatgagggtctcgatgtattgccaaatccagtctccagctcctggtctcaagtgatcctcctgtctcagccttccaaagtgtgatgggattataggcgttagccaccactcccagcagcccaacttttaaaggattctctctcagtctatcgcttgatttgcttaacaccagccatttaatatgaaaatgtttaggtgggggagggaatatcttaattatcattgtgctccatacgctacagatggcacctgctggccttagcaatatggggtcaagtatgaaacatgatagagtgacacccaaggaacctataaggaaaggaattttgattctttcagaaataacaggaagaaattatcttaaaatcttaaggttgatgctgcaaacaaccagagacaataaataaattgttatttagtgatgttgcagaatattgtgttaatagagcctgtgatctcttctggcaatttcttaccctaagtctgggatttttcctgctgtgcttctcttactagaaacgttaagtgtgcacagatgctcatacgtgtgcagagaaatgcctgaattaactctcacactgccaacattagatcattaaacacactattagtaaatgttctctattttgattttcatgttaagactcatctcttttgctcatagaattaattttatcaatgacatagaaaatggttattttaatacttctctgcactgcggtatcatagctgtgttttgccccaggacttctctctaatgacttgagccagcttgaattagcgtgatgtatcattaatgcatacaaatggcttttatttttgttcataatctgttcataatgccacggcattctgctctttctaatgtttttaaaatgattaagtagtgatgtactttttgacctagttaaccctccatggaatcgatgatcaaaagaataagagaatattacttaactaggatagtcagaagttgttataatctgtagctgatgttttccagttattttgaagttttttataatttttttttccttagggaatatggacataggccgggcgcacagtggctcatgcctgtaatcccagcactttgggaggccgaggtgggtggatcacctgaggtcgggagttcaagaccagcctggccaacatggtgaaaccccatctctactaaaagcaaaaaattagccgggtgtaatggtgcatgcctgtaatcccacctactcgggaggctgaggcaggagaatcgattgaacccaggagccggaagttccagtgagccgagattgtgccgttgcattccagcctggggggataagaggaaaactccgtctcaaaaaaaaaaaaaaaaaaaattgcagagaatatggacatagccatgtggtccttttttctaagtaaacttcactcatcgaggagctacccacaaaccactgggttagcagcactgaatttgttcacttgatgaaagatgaggaatagtaatcctttttaagttgtgaagttctttaacctcagaaagggtggctttgtctcatggactttgatattttttgcatagtccttgtaggttgagcctggccagacactggctccaagaggatgtgaggaattcaggctccgagcagatcaggggcatccctaaaggttgggttctggaatcgggtgagtttgtgtattgaatgcagagcctcatcgaagcgttgtgacgaggagagcgatgcactgacggccttaggagtctccctgatataagcaaaagtcagctgggaagagtggatttcaactttgttttcctaagagaaaaataggccagatgtggtggctcacacctgtaatcccagcactttgggaggctgaggcaggtggatcccctgaggtcaggagttcaagaccagaccggccaacatggcgaaaccctgtctctactgaaaatacaaaaaagaacttagctgagcatagtggtgggcacctgtaatcccagctgctcaggaggctaaggcaggagaattgcttggacccaggaggcagaggttgtggtgagctgagatcgtggcactgcactccagcctgggagacagagtgagactccatctcaaaaaaacaggaaagaaagatagattgtaaaaccttcagtgagtacgttggatgttgtgaaatttgccaaagagaagaaagatgatttttaaaggatataaaatatggaaataaaaaccactgacaacactgccacccgggggcaatgattgttaaggctcgggtgtgtgtgtgtgtgtatgtgtgcgcgcgcgcgcacacgtgcacctgccgtgtttgaaaaaaatggactgtcatgcattgtgagactttatagcatactctttcacatacacgtggagcatccctaatctgaaaatccaaatcttaaactggaaatgctccaaaatccgaaatgttttgagtgcagacatggcacacaagtgctcacgcagaatttcggattccaggttttcagtttagggatgctcagcctgcaaatattccacaaaaaaaaaaaaattaaaacaccctggtttccaagcattttggacaagagatccgcgaccgtgaaacttttcccaccctgtggttattgatttttgcacggcatttccttgagcaaacagaacagcttttggacccagtctccaattagacatttggttggttttttatccctctgtatttgatttagatgagtgcttccgtgcatggttttctttactgaaagctgtgtctctgtccttcctaatttcccgaggatccatctctggaagtgagactgtgtgtccacatccttcagaatgttaaggctttgaatccttggtgttgactggccttccaggagacctgtcctaattcagcgttctccagcagctgccctttttctgcacctggccacactgggtatattcattttgaaaacctctatcagtttatacacagaagtattatttcatgtaagtcacccccaaatatgaaaataagtccacgtcctgtaatctgttttgttatctgatttcccacctgtcctaggtaggaaaggtgtactcctgaggatgacacgtgggacccaggcagtccttgctgctcttacagatgcgcgcttttggggtcatcaggcggttgcaaaggtgggagcagccgtgctccccagaatgctgacagcacagagcactggtctgaagatctgtgtgtggctgtgatccgtgcgtggctgtgacccgtgcgtggctttggcccgtgcgtggctccggcccgtgtgtggcggttgcccatgtgtggctgtgacatgtggaggcgaacttccacggcagaagtgccatgcttccgtaagctcttccgactggttggtaggcgcttttatcggcacatgagcaccttacagacaaatatctgaagtacacttcaaaggaggcaaagaaaaagcaaaactgccagttccttgagcatggctgtgtgtcgttggtgctctgaagggcttgagaatctctctctacccttcattttcatgcacagaaaccgattttcagggaagagctgtggcccaccacggtcgcttcagcccctccccgttgcccatgtttattccttttctgcctttcctcattgtccatctggactggggatcttggtcacgtagatccatgtttcccaggcacctaaagcacatcccccccactttggtgatcgtaaaaatctgttattccatgtttgaaatatcaggatttcagaactcagtcactgacaggtcactgccacaacagctaaagaattaaaacccaaacatgtctccttatctctgctgcgtcctgagtcggctcggctgcctgcatgttcccacccctgatgggggcacctgggagcgcccgtggggtgggggcatctgggagcgcccgtggggtgggggcatctgggagcgcccgtggggtgggggcatctgggagcgcccgtggggtgggggcatctgggagcgcccgtggggttgggggcatctgggagcgtccgtggggttgggggcatctgggagcatccgtggggtgggggtatctgggagcgtccgtggggttgggggcatctgggagcgtccgtggggtgggggtatctgggagcgtccgtggggttgggggcatctgggagcgtccgtggggttgggggcatctgggagcatccgtggggtgggggtatctgggagcgtccgtggggttgggggtatctgggagcgtccgtggggtgggcgtatctgggagcgtccgtggggtgggggtatctgggagcgtccgtggggttgggggtatctgggagcgtccgtggggtgggcgtatctgggagcgtccgtggggtgggggtatctgggagcgtccgtggggttgggggtatctgggagcgtccgtggggtgggcgtatctgggagcgtccgtggggttgggggtatctgggagcgtccgtggggtgggggcatctgggagcgtccgtgggggtgggggtatctgggagcgtctgtggggtgggcgtatctgggagtgtctgtgggatgggggcacctgcgagcgcccgtggcagctgctttgctttccccatgggtggtagtctcacgctgcccccacaggcccggcccctccagtgggaacatgtgcctgcactttttagtcgaacatgtaaattaatcagcagcagtccagcctaaaaagagaagctgaacactgttcgtttgggggctcatcggctcactgccgcgtggtcagtcctggtgccgtgagcacagccaaccggactgtaccacatgttcccttctccctgggctgagcaatcgcttccccgctaaatgttcggcagcactttgccttgtacgtgtctacgtctgcaggaggggctgtgactcatccccagccaactgtattccaagcacagccatagttcagagtgaatctttatggtctgtgaattctggagtttcagaaaactctctcattcaacgttgtgagtaaaccgtaagaaaaaatattgaacaccaacatagtcatctgggtactgggaaatactcccatgcccgcaccaagatttcattattcaatgaaaagtccaaggtagtgcttacatttctggcctgacctctagatgtgtagaatttcagagctggaaggacagagaccccacctagctcgacccttcccttcacaggtggacaggaccggtcttgtcagatagagtgtttagtagcaaggcaggtgctagaaattaggtctgtatcttttggctgcacagttcgattcttgttttatgaatgtcgtacttagaagccattggctacattaaaaaacttggtagtgagctaaaataaaatgctcctttaagttataattgtttttagtaaaatttaagccattttaacacagggtgcttggattaaatgcagtacgataacacatcgattatttttataagctaactaataaaaattcacagagcgttttctgcatgcaacagaatatgtgggtaacaggacattgggtctgtgacaaggtctgagctagaaggaccgtatggcccatgaagcacagtgtatgcaagtgctgttgtaatttagtaaaccgccactagggggcattgaaagcgcgtctaaggattattctcctgcgcaaatgttttccttttgctgtcaccatggagaatacagatataataaaacacactggtttaagagaccatttagacctgtaataagatacactccgtaaagcgtgtgaagttactggatcagcagcacacaaatgcagaagtaaaaaagtttcattcattggaatgaggaggagaacacaattaaaaagatgaaatgttatattctgtggttaaagaattctacattctgtggttatatattctgtgattttgccctgcatgtaactttacagaagaatcaaagaaaagttggccaaagatacaaagtttttcttttgtatttttttgagaaggagtctggctctgtcgcccaggctagagtgcagtggtaagatctcggctcactgctacctccacttcctgggttcaagcaattttcatgcctcagcctcccgagtagctgggattatatgtgcgtgccaccacaccggctaattttttttttttttttttttttgtgagatgtagttttgctcttttgcccaggctggagttcagtggtatgatcttggctcactgcaacctctgccttccagattcaagcaattctcctgattcagcctcccaagtatctaggattacagcccgccaccacgcctggctaatttttgtatttttagtagaaatgggatttcgacatcttggccaggctggtctcaaactcctgacctcaggtgatctgcccaccttggcctcccaaagtgctgggattgcaggtgtgagtcactgcaccctggcctgatacttctttatagagtataataaatggacttattatttagcccatcattctctcttaacagaatgcaccaagagtttctctggcttgagtgattggccaggcacctcacgttagcgtctgcagccttgaatcgggaggcaggttgggcgcaggcttctcgtgcgcaccagcgagcacccgggccaagcgtggaggctctgcgggctgggggtccggcccacaccatcagcctctgtgcagccgttgctttttccgttgaccaaagccatgaccttacctttatgcagtcgtgttcagagagagatgaagcctcaaaggcaaagtcagactgacactcctgggagcatgacgggagttgatcattttttggaaatgtagatattccgtttacaaatctaagcaccgttaccaagagtggtaagtttctgcaggcagtaggacctttccagaggattagcagctgctgtgttccctgtggggttggcagtgggctgggggcacagcacggatgggattgtaatgtataccatttatcttggtatagaatcttccagtttcttgtctttttttttttttttttttttttttgagacacagtctcgctctgtcgcccgggctggagtacagtggcgtgatttggactcactgcaacctccgcctccgaggttcaagcaattctcctgcctcagcctcccaagtagctgggactacaggcacccacgccatcatgcccggctaatttctgtatttttagtagagacagggttacaccatgttggccaggctggtttcgaactcctggcctcagccattccactcgcctctgcctcccaccgtgctagaattacaggtgtgagccaacatccctggccagagtcttctagtttttgaaggtttttttcttttccctcttagtttttcttaccctaagatagagggcttctccctaccagtttttcgtttgtttattgttttcaccctttattttctctcactacacaaggttcattagaatttgagaaattgtagcatctcatattagaacactttcaatttctatatttgtaaaatgggactaattgtattttcagtacctcaaatgagaaatagatccaatcacaaactcagtattcttcaaacattttctctatcagaatatgtacaaattgaatgtctagaatttataaagattttggagaattttactactttcagtatatagagtagtgaaaatttggcagaaagtcatgagaaaagaagttaagtaaaagtgggtatttcatcagagcggagagccacattccccttaggagggtagctttctcaaagtagtcttttagtgccaaaggacaatgttttaccatcctctaagatgtagggcattctgtggggagccaatgggtagagctggggcccaaggttcaggtgttgcagtcgaatcagtaaactccggcggcatccagggatgtgcacggtgccggggcacattcacagaacctacctgcaggtgggcacggctttgtagagagggtaggcacagccgccgtgggatgaagcctgctcccagcactgttagcggttgacagtgttgtcggggatctgggcagccatgtgggccaggccccagtttggccagcgctgcagcttcctctctctgattcatcgagttcccagatctgtttcttacagaagaagaaacacctgctgccgaaatacagtttgaaaaaccctgatctcagaaataggattcctgatgacagaccttagcaaatattccaataattataccaactgtactaaagatcccagtactcgagtaattcaccataaatgagtgaaaattattcaactggattagaaattgccagccttggatccttttctcagatattttgttttcctgggtattttccctcttctgggttcttagtgcccgtcccccgtagctccgtcacacagtcctgttgctgctaccttggggcccaggcgtgtcttttgtcccccagtgcctggcacggtgccctccaggagtactcctgggattggtggcaggtcatgcagtcattgctcaccagagccaggacatgcctgggctgctgagtggggcgtgcccaactctttctgctttgagttttctttttcctccagtggcaaggtttgcgtggtcttcactcttttgcagaaaattgttggcattgcatcattggcttatgctactaaataatgttttaaggaattggagttttgcgaggagatggtgacaagcctcactcaggtctttggtttctgtcctccttcctgggcaggccctttgcccaaatggttgttaaagaaatgcaaacagttagttgttccgttcatgctgttgcgtgagataagttaggatgctcttgaagaagtttagtgacattcagaggaaatccttccaacacaatatacaattaattgctgtaaaatatcgtggtcaaaatctcggggaggcagtgaaaaaaaaacgaaagcagtgactaaagggcatctccaggtgccgcctctcacctggtcctggatcatgggggaggcacaggcgacgctccgaggcagcctggcttgtgttagctgagttctgctttggcacaggggagggaggacatggccctcggctgccaaggagcatccagtcctttccaaggactttggttttccagagttacacttcacatgtatttctattaagatacacacttatgtatgtttcatatattagcaagtgtatctcatatcttctgaatacacacatttaaacatgtttttgtgattaaaataacttgtttgtaaaaatacaggaaactgtaagacagcaagtaaaaatcacctataatcccacctcctagtaataacacatatatatacacacacatttttttctttctttgtttcttttttttttttgagacggagtctcactgtatcgcccaggctggaatgcagtggtgggatctccgcccactgtaagctccgctccccgggttcatgccatgccattctcctgcctcagcctccccagtagctgggactacagacgcacgccaccccacgcctggctaattttttttgtatttttagtagagacgggtttcacagtgtttgccaggatggtctcgatctcctgacctcatgatctgcccacctcggcctcccaaagtgctgggattacaggcgtgagccaccacgcctggcctctttctttttgagacagagtctcactctgtcacccaggccggagtgcagtggtgccatctcggctcactgcaactgccgcctcctaggttcaagtgattctcaagtgggggctccggagggttcctgcattgcccatgatggatattcacgcaatcataaaatctcctaaagtagaagatttaaatagaagcttaaactgaaggacaaggcttagaacactcagaatcatttcagacttttatttaaactgcttagaaaagctggtggattttgagaaaaaaattgcctttcatggattatcacagtcagtgctaggataattaagctcaaagtggcagattccaatgcttcaggaatgtctgacccctgtaccgagatggtgtggtgagcaggaagatggggtcccaaaagatactcaagttctaatccctggaattgacgaatattatattttgtgtccaaaatataaagggtctttgcagatgtggttaagaatcttgaataccttctgattgggccctgaaagcaattgcatgtatccttataatagggagggagaagggtccacgtggagcagaggagtttgaagatgctgcctggatgttgggactaacatggcccaggagtgcggccgccgcaggtgctgggaggcccacagataactgctcacctgtagtctctgggtccggcatggcccccagcaccttgtcagccaagtgatggcgattttggactttggcgtccagaactttgagaaaattaagtttctgttgggccactgggttcatgggaacttgttagagcagctgcaggaagctaaggcagatggtcagaggcaggccgcctccagagggcttctgctggggagcacggtctccaggctgcgccataggtgcagaaggttcaggtgcacctgaggagccttggggccactctggggctcccaccacacgtgggcacagctgggagcagggcacccccaggaacccacggacctgccacaggatgcagccagggtgacctaaggcatgtgggcgtgcaaagatgacgggcgtggcttttcaactggagacatgccggtctctgccctgtggaactggtggccgtgtgttcacgtgacttgagagctccatctgccctgtctggtcttccccgaagagtgatccccacctggagaggcttagagcccaggaagctgaagcgaggagaggctgtgtgactccggccgttgtggtgggtgctcatctgcgtcagttacatcttgtgcagtcaggggctccctccttccttcttccaactcactccttacctccccctcttcccagcactcctgtctctccccagtgttagaaatgagttctgaatttctcttcaaagaatcagtatgtcgttttaaccttacaatatttcatattttaatcattcatcctttttacttgtttcgaggcctgtgacaaaaaattcagatggaattacataactgttctgtttagaaaatagaagtaaatgcaatgttccggagctgacatgtttcttgtttctttttttttttcttttcttatcttttttttttttttgagttggagtctcactctgttgcccaggctggaacgcagtggtgcgatcttggcttactgcaacctccgcctccgagttcaagtgattctcttgcctcagcctcccaagtagctgagattacattaattaaccagccaccatgcctggctaattttttgtatttttagtagagacagggatgtcggccaggctggtctcgaatcctgacctcaggtgatccgcctgcgtcagcctcccaaagtgctgggattacgtgtgtgagccaccacacccaaccccagatatttcttataatcccgctaatgacaagacaagcagagctgatgctttatgacagaccacactgagaaactctgatttctcttgacgaacttccctaaagacagctgttgacaaatagctcctcaccagcaggcgcatgtattccagccccatcagatctccatcttagctgttcctcagtcagctaccaagaagccagcacttgtaggttatggcttgtggatggataaactctgggctggaccacagagtcctcccattcatggtgcttcagcatctcacttagtcagttgacccagctgtgaaatggatctgccttttcttgattatcttcttctgggaatgcctctcatagctgaaatgtgtctgtagcttgggcctaagaaggtgggtgacactgaacacaaggcagagagttcattgtcacaggactgagcacagctgagcggctgtgaccagccttcacatggaaccagccgcgagtagacaggcagaggccgccctcggagcctgggatgcaagcgggtctctctctgaccttcaggaggtcactgagtccttgtgggccctgcattctttatgtgcccagtaaagctgtcgggatggctctgtttgattttgttgggatatggagtgaaaagcaccaagctgtctgtagccactttttctcccctctgtgttttggaagcagatcaacttactattgttcctggtggagggggtccaggtttttggccttttgagcaaagaattgaacaaaatgcacaaacaaagcaaggaaagaatgaagcaacaaaagcagagatttattgaaaacaaaagtacactccacagggtgggagcagccggagcataggggctcaagaacccagtaacagaattttctggggtttaaatatcctctagaggtttcccattggccatttggtgtacaccccatgcaaatgaagtcatggcccccagtcagtctgatttgttgcagaaagcaaccaatccaaggtggaagtgaggttacaaaggttacacttctatgcaaatgaagatttggcctacggtcagtctgattggttgtggaaagcaaccaatcaaaggctgaagcaaagttacaaagttacactcctatgcaaatgtctgattgattggttgcagaaagcaaccaggtggaggcactttcagttttccatctgccttgcagaaaaggcagggagggggttgcaaagggagcagcctcaggtccttttgttacttaggtgtggaaagttggggttttcgttcgatttagttctaggaagtcagcgtgaatcggccttaggttccctgcccccatactctgttctactacctcactatagattctgatccttttaaataatagcgccagttcattcattagaaacagtggttggacctgggaatggactggtgagtcatgtcctctcctatggaagtttcctgagatgggggctggttttcttcggagaatcacagtttatcttctaattagttgagtgccctttgttttcctttactgtccttgcaccaaaaaaagaaaaaaatctcgaaaatattgccaacatttattgaagagacttttttcttcttttcttgcttgagatattttacgtttgaagacaatcaactcttcatctcacctgctggtccattcagccaactttttttccccctctaagatttttaacaaaaataaaacaggaccaagagatagcaattactactactattatgactacgatgaacaaaagttaaatttcttaatctcagattgttttactgccttgcaattaaatatccagatctaggagaaaactatttgtagaagtcttgaaaattcaactcataaataaatgcccttattcttgatattatagacatttcttctgtaaagtatggcacatctataaactaaaaatgcacatctggaaaatccgtaaggcagaaattccagcctcccctatccacagccatcagaggagtccctcacacacctgtcgccagcccagggctgggaagatagaggtgctgctgcagagggagttccatgactcacccctgcttccagtttttaaaaagggctgagtctgtcgggttgagtacttcccttccatcacggcaggcagtcacttttcccaagtcagcgtggacttgggcaagaccagtaggctaatgggaaaataagattccaaacctttaagtgtagtagcctaaaaattgctgataggaaagcgatcaaggactgaaaactgtcgcatttaaaatggaaatgaagccagggctctgaagtagagctgggcctaaatgcagtgattaaaatagtcgttaggctgctcgcaattaccctagatgcagcaggctgcctgcatctttatggcggtactttgattccaatcagagatttcacatgaacttattttggtcttttcaatgacgtctcagagtagaaaacagatgcagtcctaaagtaattactaacctttttatcttgtgaaagagaattcagatgagcgagatctctgcggtgggttgatctgagtgattggcgcctgcattcactcgcccattcattcacctcctgtgcttgtcaccaggctacaaaaacgaagccaccacccctctctggtgccaaaatgtcagtttggggaaagctggagctcccttctgagagccaaatttatttttttttatggaagagattcccctgtaaattctgggaaagtttgagagaaagctccaggagtagtgacaaagcaaaaggactgggtgaacagaaggggcatcggagattgtcctgtctgcctgcagccagctggggaacagagaaggtgagtggggacagagcccacaggtcctgcaggtgtccaggaaccaaccagtgatgagcagtaaccaatttgggattcctgtcccagactgtagcacactctttggcacaggattttgtcatggggtgtgtcaccctcaacgaaaggaggtttgcatcggtatagcctgtgtttggtgccctgatgactgaaagaattcctgtgagatcattttgtgccagccaaaagtgagttgtattagcggaagcataaaaagctgtcctcttaaatcataggtgtaatgacgtcctttccaggacgagttaccatagaaagctttttaaacaacatttattttcctaccttctgaacctatttcttaaagacaaaaaagaaaaataaatgtactttgctctgttattgtcagcctagatttctctgtctgccaggagataaagccttaataattcacggccactgagaagtgtcatagtccttcctcccaccccgccccgagttaagtgttaaccccagtacatacctggtcacgctctaatttagtaatgatgatactttgctgttataaattttctctggggacttgcggggatggaagagcctttactttgtcttaaattctatgtacgtgtaattaatcaaaacattgattaatacccctggaagtatttcaaagatagaaaaacattggaaacacattttaggaatttctgatataagttttcaaggaggttgtgcagaattggtaaagagaattgagtatgaagatggcctgttgattccttttaagcgtttaagtttttccgtgcctgggattgccttatgtgcaaccgccagcttctgtcctttgaaggttttcctaagatattttcctagtttaataggaagtgtggacatgggacattgtacggcttaggagactgcgttgtgtttggttttgaatatatattagatgcgtgaccctccctcttaagaactgattttgctttgagaagatctacaagggccaaaagtggacctgtttcaaaattctggtcacagtgtctaggatgtggtgaattctccatcagtgtggcttaatgaatgagagtgacaagggaggagggtggggctccaaggcctcgcaggggtggtcaggactggtgttgcctcctccctcagcctctctccccctacctactgcccattcggaagtccaggcctcctcctcagtcactgagactgctttgtcagcctcctgcttctgtatccaggcagatgaccccacactgaatctttgctgtgctggcctctgctcttgcctgtgacagagctcagataggattctttcctgttcgaaagcctttgatgcctccctagcacctaccatagtggtttccaaacttgtttttggctgtgaacccctcttgtcgagggtctcctaagttgaaggccagtgtgtaaggcagtgggcagtgcagggcgccagtatttccgccctctgaatgtggcaccacctgtcccagtgggcgtcactcgctcatgagcagctattcccagagagcctcctgtgttgcaggtgctatgccctgcagggagcggagggccctcccccttccccttgcacaccttgtactccaggcactgcaagctcgcaccctttccttagcctcaaagccttgctctgagcgaaaacctgcccgtccctcaggcatcggcaccaactcggagccccttttccaaaatctcgaggctctcctagccctttcttggctgcaacctctctggcttttccgccaaactggaatcagcctcggagcaggaaaagctggggccgtgctcacctttgcttccctttgctgagtacatggtgagttcccagcacgttttatcatgtgagcgtctgctcttgagaggccaggctggatcctgcagagaaacgaggaagtattagacagaagtgatgctgggcgcggtggctcatgcctgtaattccagcactttgagaggccaaggcgggtggatcacgaggtcaggagatcgagaccatcctggctaacacagtgaaaccctgtctctactaaaaatacaaaaaattagccaggcgtgcgcctgtaatcccagctactcgggagtctgaggcaggagaatcacttgagcctgggaggcggaggttgcagtgagccgagattgcgccactgcacttcagcctgggtgacagagcgagactctgtctcaaaaaaaaagacaaaagtgatttcctgagctgctccgagctggagacagaaccagcagacatgggacagaagaagaattacaggtgtgaagcgcccgtgtggggctgattcccacctgcctcctcgttatcagcaggcagccttgcgtctgcctctgggagcagaaaccgttgtttcaccagcaaattacgctggctgtactcgccatgtcctgttgccatagaggacgagtcacagctgtctcacctgcacccctccaatcgccttctcagaatccgacgctggtcctaagtgccttcagctgtcacctgagcacgttcaagcctcctgcccagcaccttcctagagcaccgccattggcataaggactaggtaggcagatgtcctgataaaggtgcacgctcaagtgtttgagacgttaacgaatgatggctgtgatgtaattgactcagttgacacatacagagatagaacaaatatggcaaaggacttgtatttattggatattagtgggtttatggggtttatctgttgtatgttacattttctgtacctttgaaatgtttgtagtggttggaaggaggggacttccttggcccctcctggctctgccctgagcccgctgccctcaccctctgcctcagacctgggcgatctcatatctgtgtgtttcaccgaggcactcacatttctggccactgagaccctttctctgagcttgagacttaaatatcagctgtgtccttgacatcacacctgggccccagctgggtggcccctctgtccctggctcaggttagacccctgggccactctgactcccctcccttcctccctgtggctgcttgagcaccaggttgtattggttcatgtaccttgtacgacccttgccatcagagccctggccccagccaccatcgccccgcctgggtttccttctgcactttccactttgggtatccacccatttcccccagttctttgaccagtgcagccagcagggaattttatttcacgtctaatcagacagcatctctttagtgtctttctcagaccaccactgtgctgtgggtcctgagagccagaaggttcttcgaggttcttaagagtccctgtcctcatgcttcctgctccgtgctcttcctcctgccccaggcccctcactcactcgctccttatctgtgagcatagagctccagcttctggcttcccagggagtgtttcttccccctctcctccctagttcagttctgaggtcggaattcccggctaccatgtggctcccctgactggagacgcagtgccagggtcctcatctgggaaactggtgatgatagaggtcctgccagtgcttggagcagggccccacacaaggtaggactcagcatggcctggagatgacggtggcctctgatggctgtgttcttggtctagactgtaaaccccatgggatcaggaacaaccacatctagaccctcatattagggatgccagcccgggcaccacatctttgtcacctgcatctctgtggcctctccagccccgtggcagtcctcactgcaggaggctggcaccctctctgtgcctcacatggatcaactgacttccctcaccaaccccaagaagcatatcctgtgtgtatgttttacagataaggaaactgagccacaaaagggccaggtaacttggtaaagatcatgcaggtcataaattgcctcactgagctgggaacccaggcagtcagcttcggcgctccccacccctgttaggcaacctatgaacatttaccaagaacacagactcatctgcaaggaagcctcagtaacttgatgaggagcagctagaagactcgagggagaaaaatccttgtagacacatcagtggattcaggtgacttgtgttatttttaaaatacagcctcgccaagatacaattcacacagtctccaacctaacgatttagctctgcttttaagactgtgttgggtttgactttttttgaggggcctcggccactcttgggttgtttgtaatctaaaaataattggggatgaatattggttacatttcatcccgtaggaccttagtctgtctggtcaccacttacccctccaggctcttcgaatgccatatttggctatgtgagaatttgtcagagctcagctcagcactcagaacccgctggctctccgggttctgcccttcagctctgcgagtccagagcccaagctgctccttggaaaagcggaggccactagatggcagtaccgccctggctagaggtgcccttggggctgaggctcagacatccctgcccctggtttccttcaggtgagatcatcagtaacctacaggctttgcagactgaaggtgaaaaccagttaatgtgctacatccattttaatttgaaagatacaatgaattaaattaggcataaagtgaatgtgataggaaactggaagctcatggctgaagcctggaccgctgtcagaactgtgcagcctaaagccgggacccctggtagctgctttgtaaagggcagcagcagcaaaatcctcaccactcgtgcttggaatgtacgctgcaaagtttgtacttaacagcaaatggcataaatagcctctattccattaaagaattggactgcacaatctccttagagaaaatttgatgaagcggttcatgcaagacctggagtgatggtatcaccacgttagcctaaaagagtgtttgaaataggaggtgacattcctggggggggctgcccctcccacctccacccctacctcctgttttcaccatttcttgatacagtggtgcctaattttatttcaagaagaagatagtttgttgctttttttctttttttacagctttaaaaaataagttgaggaatttaggtttaagaaaattaatagctacaggtaactgcaaaagatatcattggcagatgcagcaaaatatatatatatgtatttccacagaaaattggattctgcccataaaacttagtaatactaataaagacaggtcattaccagttttaagccaagtaagcaaactcaaagagatcttctgtcagtgtgattcttggtggttttttatttttttggagaagtgtaaatcagctttagtgcagcaagcacaccacagatttgctgaaatcattcctgccccttctgacggtgggtagagttgctcggccaagtaatttacagtgctgtggcaaggtatgtttatatttaagctgtgcaacggtgtagctaatgagaaagataagaaatttatagtccttggtgattgataggattactgcctaggcattaattgaaatctgagggatcacagctgtgggtttaagttgggggaaaaattacttcaagtaaaggaaaacttttagatttgcttctgaacattttgaagatagttctcccgctgacagtctggttggtggtagaaacagttgatcctggccgaggctggggtaattatactgagataatgatggtatctgctgtgtagcctcttcaaggtaggtggtttataagtgtgggaaaaaaaattaaatactgtggggtttttaaatggctttaaaattttacatgtataagaataaaattctctgcagccactctttgctaaatattctctggacaattatttaagacattttaaaaaaagaaacccaaactaataatgacagaggcaaacctgtgatattagtcattgccttaaaatttccactgattatatttaatctgggtatgtctaaagtaatcttacagacctttccctacctgtcattttttaaatgtaccattcttgttgaagctcagtcttgtgaaaatgtctaaattttcccattaagtgcttaaaaagtaataaaactaaagtcattagacttcactcatcagagctatattgggagaaatattctttggtgcaataaatctgtccaggggttcgacattcatatcccttggattcattccctggaaatggacgtttgaaggtaaattgcttaagtagggcagtttaaatttttaatacaatcttattgtaactgttatcacatgattaaagtgcaaaggggccttagatgttttgtaagatttataataaatgctctatgatgccttttctgtgctgaattatggatgttatgacagttaaatgcttataaaggccagaaaggcacaaatgaagagttgggtctttattggagactaaatcacacttattgaatgcagacagtttttcactggacacgtgttcattcctagattcacagtctcggaggcacctagaagccttcgtaagccaaacagtatccagtgcctctcttttctaatgcagtgggctctggaagggtaaggcctgagccaatggaagctgttttgaaaaatacccaaatagcaaattattgttcccatcaccagttggcttttttggggggaggagggacttttttttttatgtaaataatctcatcagaggcctgattctctaatggatgccgctagtgtatacggagtttccgcattccttttgtagaatcaaggaagcttgaagctacgtcttcatgcatcatgggagctgtgatgccctttaactttctagacccagtgacacaatgtggttcctttcatgttcactgtttggccatagttgattggaattgttgttttaaggcctagtttaactggacagcaggactaactcttcatttcagaaggaaggcctgcagcccaggagatggagctgggcaggtgccctcctcacgagaggctacaggccagacgcagggcaccaagagcatggcatttgattcaaagccatggttgagtggattttcaatctatttgaaggataactttggctactatatagtatttacactcctgcccattttttttttttgtattttttccatcaaaagagaaatctgttttgaaaacagaggtaatgtctttaccatctttctcatgtatattattttttggaggaaggaaatagccagttttctatactttgacaatgtcaccatttgccatctaaaatttcacaagctgtaatttgccttttacttacatatctcatccacagatgtatttgagtgtccacagtgaaatggttgcattactttcagattacttcctttaattctttagatgggtgctaatggtttgggttattaactggcacagatctgagttctttttgtctatgcttgttgtttttttcccccttcaaaatgaatttgcaaaagcatcactagaaaagcttatgtgtaaacatttatgctagtaatagataaaaggtgctgtgtagcagtaccagtgggagaacgctgaagcccagaaggaaagtctaccttctttggaataactgaataggagtcccagtcacctattcccactttctctttaactatcacccttggatggtattgaggaaaccgtattgcatgcctaattttcacagcgttcagtattaaggtaaacctactgattgtgtttaagttgaagtataccttttccaagtagctgtgtaactggcagtgacagaataggtgttgtatgggaggcagcattttcagctgtaagtgcaataaattgtggtttgtttattttagtttttaaccttttagactactttgtgatcggcaggagattgtgtgtgtgtgtgtgtgtgtgtgtgtgtctaggttgcagagtgaggatctggtcagtgattgacacttgttttcaaagtgttcaccatgaattttttttcttaaataccatttttctcagtgagctttgaaccatgatgtcaccaaagacaaagtgtttctcaggcttttcttagtgaaagatactttcctaaggtagtttatagcaagatttggggattaaaaaaaagagttgaatttatggcctgaagagtcattataaccttttacctatagctaacatttacatacctcaggtcaaataaatttagatgtatgcttaatgttctaaaagctctttgttccttgctcatccttggccggaccagagaagttattgataatcaggtgttgctttctttgtggtaggacatcaccatgttctcatagagtcctgttaggaagcagaggacggactgctgtgtgtcactgtggagagaaaaagaccttgtgacgtccctgtcatcacaggattctagtatcttgttatgccagagatgtggtttgaaaacttgtttttatggacgtacccacaaaacattatgctctgtggaaagaggcacgcacagaaaagaatgattccatttatatgaagttctacaacgggcaaactgattggtgatgaaagaaatcggaagaatggttgccaggaagtgagaaggagggattggttggggttgggggtggcccagaggaactcctcagggggatattttcatcgtggcttgggttacacggcatctgtcaacattcatggaccggtacaactaagatgttttgcatttcacagtatgtacatttaatctcaaaaaaagaacctaatagttaatcacgtgcatgttgaaatgtgtgggagtgaactgatgcctgcaccgtagttgaattgcatcagaaaatgaaatggacggacggacggacggatggacggacggatggatgggtggatagatatataataaagcaagtatgtagcaacatgttacaattataaaatgtagccggagtggaaggaggtgttcgctttcaaattttttttgtatgcttaaaaaatgtgttaataaaatatagggggaaatcaaaaaaattgttactacattaaaaatgtcattgtaggtctcgtacattaagatgggtccagataaacctaatttaatgtgatgtgctttctcacaagtagaagtgtacagtataatgaggagccacaatttttacaaaaatgaatcctgccagaattaaaaggcatacatgattctttgaagaatttcactaatgcatagaaactgcggtaacagaaaagaatactttgacttcctcactattcctaaatcacagcagattacagattcaaaatcaatcagtattctctgctgaactctaattaacacttaacattattagtcacaaatgtgaaatcttgatcggagatggcctcaggtattctaaatgtaaataaaattaggtttagatcccttttaattacctgaggtgctgtgagcgattacaatggcaattgataaacttaatttcttattaaagcaaaaaaaaaaaaaaaaaaccatgaaaagtttctctctgctatatacttaactcttcagtagccatggcctatgcaaaaaaaatttacctggtttatatgttaatcatatagaatttagatcgttttaaaaatgtttatgtggaccctcaaattcatcatgcatctcctaagtttgtgggtaatgttactataacatcacaaagggcaaaacttccccagaggaacttcacgtatcagaaaaggtaggtttctgggaggtaatgctggttaagtaataataatggatgggtgctggggagagtattacaatgacttaatgcacaaagccctgttgaagaccaagtggaaatctgttttgtcatctcatccttcttcctaattgcatcacaatacattgtataattcaacctgtgtgtcactgtcacttcttcccgtgcacagggccaccgctgctggctcattattaacagagcagggaggagacgaataattctctcaggttccaaccaagacatcttctctcccccactttaagaagaaaatgtcttttttatgtagattgttgtaaggataattatttctggaaataggaaaacagcttcagttgtggtagatacatccatttttcttaaaagtgagaagctatccgaaggagagtgtgcctgtgagaaatggaaagattacagaagtttctaaactccttcttctgttggtgttcatatctaaaaataggaagcaaattagacctgataagttgttaagcctatattaatcaaactgtgttaattttttaaaaagaaaaccaattattgcacttaactggatctgtctcaaggttcctgatttcaaaatcgacttttggcctttacgtcttacattttcccttctttagaactcttgcgtctcctgttcctcatttatcttgatcttctcatctttttttctttataattttgtgtagtttcttacctggaataatttagcataatctatttttctttaaaattttgtatagtttctttagctggaataatttagcataatccatttttctttaaaattttgtgtagtttctttagctggaataatttggcataatcagtctggcacgctatcatgttgttggtggtacctttttctctttgtatgttttaaaatcctttgccagtcactttttctgtattctgtcttcatagtttatcgtattcctttgataccaccatgtttatctgcacttatcttaggtctttctttcattccactgacaaattgtgttagtttactttgtaaccccaaatttgggccttttaaaaaaaacgtggatggaagagggaagtcccgtagctttgcctggcgtggaagagtgttgaggagcctcacgtgcagattgaagaattgccgggtgagccttcaccttcaggggatggcagaaacatttctgctccaggatcatcaactttctctgcgagacagcttgatgagttgagaagaagtgacaggttcatctttcccttctttgtttaagtcatttatctttgagatccttgcctgccatctaaattgtattgccaatttactgggatattcacttgcctcgtcttggaagacgctgatttgcatccagcttgagaataagtgagagagaaagttaatcatctcctggccttttgaacagatttgtactgtgtttaattgtagcatttgaaatgttacatattttctaatgagagtctatattcaactcttgtgttaacctgtatcatgaggagaatagcacagtgacctagtctagaaagctctgctcttcggaagatctttaatttatgctttttgcatatctttctccatttcagattaatctaagctatgttagctgcttttaaattctgcctacttgtttttgatgatgatttattcaattaagtggaataattaataatgaattatagttgggcatggagggaaatggtacactcagctctctaagagattctgaaatttttatcgagattgttgtaggggtaattatttttggaaataggaaaacagcttcagttgtaataagtccatttttctggaaaatgaaaagctatctgaaggagaatgtgcctgtgacaagatctcgtctagtttcttgtgccctgtgacgagaagagcacagctctcttactctgagcaggtgaggtcttgaagaagcacctcattaataaggtcctgaagaataagttcatttgtttatagggttcaggagacccctagagttccagtgagaaagcgtgagctccgtccattggtcctcctggccctgccactctcttccccgcttgttctggctcccgtattcttgacaccttttcccagcatatgctagttttgtttccatcaggcttccttgagggagctgtcgccccccaaatcagggtcttgacaccagctcctgccactctgacacatacttaggcagtgctcagagtcgagctggcctggggccgtggccccacaggcttgtgatcagtgggctccggttctcacttcttgtctttgagttctcaggcttctcccctctcctgttgtaagagttgagctagcaggggccgcctctacccttggctgctgcttccaaaccatgtgggtttcctatgtcatgaaagcttttcttcatcacgtgctaatgacttcctgttccacaggcgtaacactttctaatgtttcattcatctatctgagtttttcctgctttaagtgcctcttctatgtctgtgcaacattcattaatttctcagtatttcccccttgcagattattccttctttgtctgcatcatagacacacgcctctctttatagcactttctatatcccacatgctgccacttatctaacacattgggagagaaaggtgcagacaaggtgtgcaggaggtggatgtgatgttgtggttggttggttgacattttctagatgatgcagctggcagatttgtctggatttcacaatctcccacatctagcaaattgcctggcatatactagttgctcaataaaaacagtcagtaaatgggatgagtgagggatgctataaagcatagtaaagaaaccttccttgacacattaaagggaaaagcagccaactccacatattaaagaatgggcagcaacttgcttggtttctgtgaggacttgcttaattctgcattgaccaagagcaagctgaagagcattctgggatcaagaagatgaccaagtacattgtgggaccaagagcaagatcaagagcgttctagaccatgagcattctgggaccaagagccatgaccatgagcattccgggaccaagagcaagcaaggccaagagcattgtaagaccaagagcatgaccatgaacattctgggaccaagagtttgaccaagtattatacattctgggaccttcctaggccattggcatcaacgctgcagcctctgagtcatgcatgcctcatggggtcatcctgacttaacctgatgggtaggacttacttgagtagggcaggaggttttgaaaggacatgatcatacacagtacttagctcaagtgcacagagaagcagagtgccatactgggaccctacggtacagccagccggagacacagggttccagacacagcttaattccttcacgctggagtatgacttggatgtacaaactcctaatccctaaggataggaaaagacctagaagatttgaggattttaattcaggaaagtccaccaaaaggataaacagctaggagcccactagtaagccaggatggtgtggtgcggatcttggatgaggttagctgagtttgaaaactggagaaggcatggatgagagcaatgctgagggaaggtgaggcagggtggggagaggagtgggagggtaggtgaggcggggtgaggagaggattgggaggcaaggtggggcgaggagaagagcgggagggtaggtgaggccgggcaaggagaggagtgggagggtccatcggtgtcgtcagtgcacatcccggtgcttggaactgactggtgggcgtcctgttggtgcatggggcagactgaagcctgagacatgacccccgagggttctccagacaggatcatttggagccccttctttcccaaatggtggggagaagtgctggcggaagcagaatggagccctcagaagcgcgcattcagaccggcagtagacaaaaccagctgcggggccacaccacgttagggtgcttttcggcatctctcagtggggtgaacgtttgcatgttggtgcttctgaacacaggatccctggtcctcctgaggcctggagcctggcagttggtcagctccctggcccctgctgccctctagcccagggtgactatgggaacagacattcctgatttttggcagctcgactttgggattaaatgttaaggaactattgtgctttgaaggagtgcatggaagaggaagggatgtgtgtttcctgcagcgtgatttgaagtcccctttaccacaaataactactttataccagaattggatacacatattaaaaatgtcaaatacaccatatttgtttcagcacagggtttttgtttttgtttttaattatgttctttccccttttctctgaaaggaaaagggaaatcccgctgccctagacatggtagaaatttcccctcattctaaaattctgaaattaacgtcagcagccttgactttgctctgtcctgaaggtaactgtttattacagtcggcatttaaatcccccgattaataggagcaattaaacaatagcttcatttccagcaaattaacaaccctaataggtaattgcgacataaatgaagataaatttgttttaatacaacgagataaaaagaatacagacaagaactgaatttcagattaagaattcagacttcagtacttcaggaaaaacttaaaagcttcactagaagaaatttaagcaagcttggctttttaaccacagcctattttagattagagggttgtttgctcaaaaaaaaaatacatatatatagtcatattttgtgcttcgatactcagaaggtaaggcatcaaaggattactttgatatacgcaaggtaagtcaacaaaggattaccacccaccgaaccctttctcctgctggcttgcttggggcatggcatgtcctaatgacttactcgagcagttgaatcttggccacagcttctcattaggctttcagtgacaaggaaccaaaaagcaaatgcatagaagagcatttcctatttacacacccctaagttaaatttatgacctgtttagttgcaggatgtcttaccttccttgttagtatttgttctgattggaaaattactctgatggtttagaatttgtcctgttgaaatgtggaagtagctggaccagacttgttcataaatgcagcatccatgtgaaggatgggtgggaatcggtagatttggggtgaatagctaagtgctgattttaaaggtagtggcaaaaaaaatgatgaaagcctcttctagaacaaggataatgaatttctccttgtggggtcgccgtgcttatgggaagatggaacgtacattaaagaaattttcggagtttagctaaaactgtatcactgagcttgtatcaccttatcagaactcattttggtagcttagaatcatcagatgacacataattagcctagaattctgtgtgctgccaaaatactaatccagtaaaagggtagagggacagttttagatatgggagtctcaaaacaaaatatatgtgtgcttctcgggaaaccgctggaaccaggctgctgagttcagcccctgaggctctttcccagcccctccgctccccacacccctgcacactccctttcttgagtgtccaggtagaaatgacctgtatcttctaaccaccccaggtatctttccaaagcatagatctcttcacttctctattcaatttgaataaccccccattgccttaaggacaacttcacacttgccactcttctctgcatatcaggtccttagaaatgcatttctagttgcctgtttcagcatcttctcccactaccttcttataaccttcccaccccagccccactgttgactcatccattcattcatccagttgttgtgtgcccactgagtgtcaggcaggccctggccccgggaagttaaatacagcatggcctcaagcatttccagaagaggtcccagctcggtggaattggcccattgtcttggaacatgggctgactgtactctttagtagacggcacagtttggcaggatctccgcaggtgtgtaagtgccaggctatgccatgggtcccatggttcactgattgtcattaaggaacatactgtagccagaaaacccaagagaccatcatggatgtgtgtgcttcctcacatggctatgatttgacttagcttttctttatcgctgaaaacacagatcatatgaaaacacatttaggagatgggcttgaattatcaacaatatagagtacaccttctttaacatttaactttgagattttcatggtgagaaaaattctacatatttcttttcactccgaagtcacacattctgaactatatagataatttggtaattaatttcttcttaataagatagtttaatgatcactttactgtgatttaaaatggagttgagacgttaggggatcttttatttgttactggaagattacagccggtagtggctttcattatttatgggagggtctccaggtaagccccctatggttcgaatggaagattctttctttttcttttcttttcttttttttgtaggggcgggggatggattagggacaaactgtccctgatatgctgatatgccctgtccaaactcctgacgcacagaatcgtgataaacaataagatggcacgttgatttgatttgattttttttttgagacggattcttgctctttggccagactggagtacagtggcatgatcttggctcacggctcactgcaacctctgcctcctgggttcaagcgattctcctgcctcagtctcccaagtagctgggattacaggcacacgccacaatgcctggctaatttttgtatttttagtagagacaaggtttcaccatgttgaccaggctggtccaaactcctgacctcaggtgatctgcccgcctcagcctcccaaagtgctgggattacaggtgtgagccagctcacccagccgggaagagcctttcaatgaaatgtgaagtaagtgtcacctttgggtggagacaccaaagacagagacaagacatgcagtgccctcagctgcataaattttgcttttaaaatattttcgtggagtaaaattagtgtttagtctcatgtgaatttcatcagtgtgtctatggtgagcatttaaaatacggttttattggaggtgtggttcgtactttataatccctacctaacagtgcttactcggaattgctcccccgcctcccaagttactggcctcactgtgctccagctttcccagtagcagaggaaccctcttcccaaacgtgggcttgatttacaccgagtcattagttgtcatctaatggtggctcttcagtgtcactgcaatctatacgctttctctgtgtcttccttagttctctgcccccacttttccccacccttcacgtgtcatctggtcccccacaaagcttttgcatggggttcatctgcctattccaggagagactatggtccttatccagtagtactaatgtgcggaaataccaggagtggacaagccaccttccccaaacatgaaagagcccagttttgctaaggagctgttgaaaaactggaaatagaacagcgctgtggtaagatttgcctttgaggtcgccctgtggtgtgttaggggcatttaggggacagtcagggagactcatttggaagttgctttggtcaccagctgtggaaggataagtcttagaccaaggcagtggcagtgaagacgaatttctgagaaactctggtggttgaaccaatcatctgttaggtctgttctgtccatggtgaagagcgggttgtgccatcgactgagctagaaaacagacgagaggcaggtctgagagaggctaggaggcccaggctgggcggcgcggacttgaaggcgcctctagcagatccaaggggagatgccgagttggtcattggctacacaactctagaaggcaggatgtgaggcagagctcttcgtggcagtggcgatcctgggagctcctggcactgaggtggtgaccgagacattcgcgaggaggttgcccaggcagagggcatgggaaaaaggacaccaggaggatgccagggaagcacccgcacttcaggagccagcaagggaggatgagaaagagaagttccagccggaggaggaaaaccagggacgtcagggttcatggaagcccgaggaggatgcagaagaggaaaggagggaatgacgaggaacgccacatgctgctcagaggtccaggaaggtgcgacctagcctctggaccactcccagtgaccatggcaatggcaggcccagcctagggattgcagagagcaggagaggcagagtcgagcagcatccccgggctttccagaaggcctggctgggaatggggcgtggcacacggtgtaatccgggcagccttggcgagcacctcctgtgtgccagtcaccacactcagtccttttcagcattttgtttagttacccaatccatttcatttagtcacccaagtagaagttagaaattgatgacaaactgagggtgcagggcaaaagaacacatgattcgtgctgtggaaccaggacagtctgttggggtgctggcagggtgttcgattgccacatggtggtgtcatgagcagtcccagagccgtcggattgctctggtgcacttgctgcctggtttttctcacctgcaaaatgaaagagctgacaggatgaaatgagttaatagatgggaagtgtgggccgcctagccctgctcagcctttgagcagcaaaaaggaggaagggggaggaggaggagctgtcctctggttatagagggcgtgaggttggcccggaggctcctagtgtgaccaagggctattccttgcctcattttgtgtgatttagaaacaagatggaagtagaaattgggcattatgtcaggatttaatgaagtcttgtttgggagctgttgtcttatttttaaccactaattaaagggtgctatttccctctatagaatagaacatttacagtttgtggataaagtaaatgtatacctcactttttttgttaagttcttaaactttttttttattattgaagaatggaaacatacatgaaagtgtatttgggcttaaaaagttgtcacaaaattatcctcaggtcaaggagggcctatttctagaccccagaaacccctgtgtcctgtcccaggcacctgcctgctctgctccctgaagatgggcacaattctcccttctgaccccatggtgaggccagcttggttttcacctttatacaatgtacacacacacacgcacacttgcacagttgaaggggctagttagaggtatcttttatctgttaacccaaataaaattttaaaattatagaggaagtgacttttaaaagaacactgagcattactcttgggagtctcaggagggtaattaaattggtagtgtcagtagtaagcgcaaatgttttcagtacccgttgacaccgttttagatttgggagtagctcatgtgacagagtcatagggaagtgtgctgcccaatttgagaaaagatcaaatctcagtgacaaagcttccagattttttttaaattaaatttaatttttttgcgatagtctgactctgttacccaggctggagtgcagtggcatgatcttggctcactgcgacctctgcctccccggttcaagtgattctcgtgcctcagcctcccaagtagttgggattacaggcatgcgccaccacatccggctaatttttgtatttttagtagagacgggatttcaccatgttggccaggctggactcgaactcctgacctcaggtgatctgcccgcctcggcctcccagagtgctgggattacaggtatgagccaccgcgcccagccgcttccagattttttttaagtaaatccacgtgattgtgtttctgatctatgcaccaacacacatttacattgaacatatttatgtctatgcacccacacacatttacattgaacatacgtatttatatgaaacaacacatttatttcttggataatcaaatatagacaaaaactcaatggttataaaaagcttcccagacagcacagtctggggtaatattcacatgttaaacctattaacatttaaatgttctaaatagtatgagtaattaacgattacagccacagaagagcagctccctcccgtgacattccatccattttctttgagttgtttttttggggtgggaatggaggggggttcctccactcacatagacacaccaagcttttccctctaggagattacccagcctgctgctgggttgtgtggggaaggactgcggatgtcttggatggcagttgtcatactagttttttgcttccccaaacaattcatttagggatgtctttaagtgaggcgcccagagattccaccccgtccctgggacatcaagcaaatagcagcaacagccgttggcaaatttgtggctatttgcagcattgactctgtagtcagtttgcattttcaagatgggggagacatgggcagacattacaaaggagtcctttccccttcctattcctcatgctcccgctcctcctcctgaagtcagatactttttgttcttcattaaagttttcccttattcgtatgggttaccctgtagttttaaagcattcaagcagtccgtatattttagaacaatatatttataaatcattttctttccttgatttgtgtatggaagcaggaaggacataacaggtagaggggaaataggacaaatatgaaaaaaaaatagtagagtttaaaaactactaccagttaccggatgttgtgacttcattttattttttaattaatgtggtagaatagtaattaaatggacagaagaattttagcagttaacaatgctaaatactcatactttgtacatcctgtctgtagtttgatgagaggctttgttgtagaaatattctctttactcatgaactgactcttcctagactccatagaaaggatagaacattcatttgcatttgaagtttcatacaacagtcgtttccataacatatttgacttatcttaggaagtttctcgcatcttcccttagtttctacaaatgaaaatgtctgcaaagctctcaaagcatgcatcctagtcctatttaattctgacatctgcacatttcttacgaatgtaaagtcagtgtggccatccagctgaatagtaactctgaagctgggagtaaaatcagatttcagtgtaattgataatcaaagccccttattgctatttttcaaaaacaaagtagcaatactttagcactcacccaggcaattatgatttttggctaatttacttttggtttttgcaatttcaagatacctagacaacacattttgcatctgttgaaatcttagattttatttttgagttcacataatgactttaaaatattctaataaatgtcttcaaagaccccagatcaatatgccaatggttctgagatgacagagtgctgcgatattcctctgtaatttaaacatgattagctgatgaaggttatgtgatatcaatacactaccggaagataaattaattgatatcatcctttcaggatgataagaggcctattggaggtgggatgtaactaatgaagctgcttcttcctctctgtgagccattttttatatattgcattttcacttaatcatatttatactatcattcatttacatgaaacccataggctgtggacaaaccagtttcttattaaaattgtattcatttggaaaagaaattatctgcaaacactatatgggccccgtctacgttataacctattgctggggagagatgacaagttcctttccgtggacatcttcgaaaatagcaactatctaggcaaagtcaaggattgaatatcattgaacttaattactgctagtccccaaagacacacatctattcaaatcaaaagtgtagttattctgcggcagtgacaccattggtgtaggaagagttttctaatcgttgacttcctttccaattacattcagtatgctttatcagcgagcctatttgccaagagaagttatggctggttgaatttagatttgtattgattaagataaacttacaatgtgtgcagtcatatatttaaataaaaaaggtctttgatataattacatctccttgaatataattctctatgatagcttgtagagtgaagaggatttctttaggctttgggggaaaaaaaaagatttttgtctttccaaggggtttggttaaattgccctgccttatttaggattatttttgttccaagtaactggaaaaaaagatgattttatgagaataacttaaatgagataggtgtgtatttttttgctttacattcctctgaggtggtctgtgcagggctgctgaggccttctgtggagttgggggaccggctctatctgtctcccatgtggctcctgttcccagtgtcgcctcgtgttccacagtgctgctgaggccatgtaacgtttgtgcatttcaggcaacaagtaggaaaaacatacgagaatttaggcaaagggaggctctccaggaagatccttaaaagctgccctgtgatccttctgctctcatcctgctggccagagcttgtgtacctggccatgttcagctgatgcgggggtggggggacgggaggaggctctggcaaatgtcatgtttattctggttgtcatttgcccacctaagaaccaggaatgctattactgcgaaagaaggaaataacagatttcgacaacagactgatgatctctgctctgttcctgaatttggaaattgattgacatggatttctttttgtctgtgtgtccaccagttgcccagaagattgttgccacaaggaagaagcagcagctgtccataggaccctgcaagtcgctacctaattctcccagccattcctccgtctgttccgcgcaggtgtctgccgtgcacatcagccaggtacgttaggtgacatgagaagtcagactcttagaaccaaagacaatatgcaaatagtgttcccagccaatgctaaggttgattttttttttcttttcaactttataagtaacagcatgttgtaattgacttcacattttcttcagaaactgctgtggccaagtgatttttatgggaatcattcttttatgttttctgtcttcatgctgcctgtgttatgaggcatgctggcccgggtggtgatgggaggtgtgtgctgcagtcctcgctggtgatttaaaccacccttctctggtcttggtcctagtctgcttataggttgaacagttgtgagtaaatcttaatggccaatctcgctttatacttaaatttggtagtggcattcaattataattaccatctcccttaggtcccatagaaactgctatctttccataacaacattttgcaaaagtatttacttggaagcaaatgaaataatggtcactttgaagaactcaaccaacaacctcctaaggaaacagttgactttgtttttgtctgtgcttgttttttgattacgtttcttgggcaggtattctattggcactgtttttttaaggacatggtggaagggttcggtgtcgtactttcagtttgcttgggaagccagtaagttatggcatgtattgtcagagcctgtcaaggtacagtcatgaatgttcatgctggctgggctgagtggcagttgcctgtaatcccagcactttgggagctcaaggcaggtggatcgcttgagctcagtagttcaagaccagcctgggcaacgtggcagaaccacacctctgtatctacaaaaaagagaaaaattagctgggcgtggtggcttgtgccttgggaggctgaggtggggggatcacctctgcccagcagaagagctaggctgcagtgagtgtgattgtgccactgcattccagcctgggtgacagagtgagaccctgtctcaaaaaaaaaaaaaaaaaaaaaaaagaatgtcttcacttgctgtgtttaattttctgtgaatcttgaaatacttttcaaaaacacttagattttccaggtgtcattttcataatgttggctgtggttctgctgatctagagcagtggagggaccatagaatccctttagtttaaccaacccctttcattttcagaggaaagagaaaataatcaaatttgaactctcagaaatcttttaagttaaatgaaagagacttctttgtcttcagtcacttttctcaggggatgccactgagtgagatgattggcatgttccaggatgagactctgtagacatgacactaatacacctggcaaagccatagacgcaagtcagccattcccatgcatcccttccatggggctcatgctcacttgttggttatgaccttgcctaagtggaggtcttgggttcctgagtatgtcgttaatgaaaccttggattttaatcatttcagacaagtaatggaggtgggagtttaagcgactattcctcctccgttccatcgactcccagcaccagccagaaggaacttcggatcgatgttcctcccactgccaacacgcccacgcccgttcgcaagcagtctaagcgccggtccaacctgttcaccgtgagtgtcaaccctgggtggagatttgaatgcgattccgaagcgttcccattaacgtaaacctggttgccacatggttcagtggtatttgtagaatctcaactatattaaagtgaataacattgatttctgtggaggactaagaaaattaagagaagcaaagatttggatgttgagtagaatgggaatttcttcatgtagacattcctgacttcgtgtgtctgaaatgaagagctgggggtgtgtataaaggcacttgttatcctgtggctccagctaaagatgtgtcacagtggatacaaggagatgacaaaactctaagattcccagatgtgtgtctctaaccgttcagatgatatataagctattactgtccacaggccctcttcttcttctgctggggtgcctggcgctgccctcggggtggaggtgggggactgggaggtgcttcctggaggctcattgccatgaggctctccacttgggttttttgctgtagagcatgttgaaagcagagatgagctatctgggttcaggtttataaattcacaatctgggtgcactcgggcatgcattgttccttttttttttttttttcttttgagacagggtctcactctgttgcccaggctggagtgcagtggctcagtcatggctcactgcagcctcaacctcctgaaatcctcccacttcagccttctaagtagctgggaccataggcactcaccactacgtgtggctaattttttttttttttttaaagaaatggggtcttactgtgttgcctagggtggtcttgaactcctgggctcaagccaccctcccaccttgtcctcctgaagtgctgggattacaggcatgagccatagtgcacagccagcatgtgaagtgcttgaaaactccctgggtgattgagatgcagagaatctctgagctacagaggtggcaaaaatgctgccagcctgtcccttccctgtgcatagcagacattaccaatcaatctggattctacacagttgagccgcaaactccaggcacagctgctgtcaggtgactgaagcatttggacttgagaagaacgcttttcctccctggatcacgcattacaagtacatgcttttgaaacagtgcttctgaaccagggtggttttgctctccaaggacatttggcaacttctggagaaactttgggctctcacaacaggagtatgggagtgggaaggtaaaggttctgcagacgtctagtcgtgggtagcaaccaggggtgctgcaaagcatcccacagtgcataggtcagcccctcacagcagggaattatccagccccacatgttagtggtgccctgttttaaaccatctgacttccattttggttgattactgctgacccagatgcaaagctctagaggggtggctgggagtcagatttgctgcccctttgtgaatctgatcttgatgttacattgcgattcctgccaagtctgggagatcccccgcccctctgccacatgtctggggcagtctctcattggatgctcatgactgcggaggcggttgccagctgcacacaccccctcgtccccagcctccccttgcttttgctagttgccttgcgccacatcagctcccacagaggccactgctgggcagcagggtgaggactgatcagacagaccaagctcccatcccggcctccgctgctgacggatgtttgaccttaggcaaattacttgacctctctgggctggaaaccatagtacttctgcagtggggcttccgggaagacttcctggaggaggcagaagagatctggtggcattgcttccatggttttctcactccattgatgctataaaatgatttctgatcgtgttaagcatatgtgatagattaggaggtgggtatttaggtttctgtaaaatacaggtgagtatctcacatgcttaaattagtgcatggataacatgttttattgggcagtttcttcacacacaccgagaacagcagcagtcacctaaatagctgcttcccagctccgtctaacacctggagcagcccctgtctacccccaggctggggggctttgggttgaagtgtttcctgctagaacaggctgcacagtgactcggtggcttgagaaaccaatagccaaagatgcagctggattgagagaaggtgggctgtgggcaggcggcctgtgccccgggaggaggggcgggcttgtcatcgtggtggtcgagaacaccttctgtgtctttgttaagggagtggaagggggagagcactcattctcagacgccttctgagggccacattttctgcttgttgactttgctttctcttttaaggagagaaattttaaaaccacaaagtatctttaaaaatgagactatttataaggagaataccagcaccttcccatcccctccctttataagctctggaactgcagtgtgccagaaagtagtatcccactgggtacctgacaacccaggtgacttagggaggagaacacttgaaggcagagagaatcaaaataacagcccatttaataaatattgacttaacatctgctctgtgcacagccctggttttgctcagtgtctaggaggaagactcactgccagagtcaacccatgttcaagggaaagcgatttagggtgaaggagaaggggctctgcacactaggaggagagaccctgttgctgcggattcaccctgcagacacacaggtgcacttacaggcatccatgaagaggccgggcagggcaggtgcagaagccagtaaaaactcattgttacagtgaccaaaaatcaccattaattatttcaccattaatgtgtcacataatataatggtctgcctatggatctaagggtgaccagtgtttgttatctttctccttaatcttggaaaataaatttgagatcagatcagaaattgaatccagctgtcccatggcattagtgggaatagaaatttggagtcataaaagaagctaccactgcaataggtttgcattgtggcatttaaggaaaagacagtgaaagttctgggcagggatccatatgttggtcctcagtgggtttgacactgaacaaaatgatggtggtgatgatggttgtggtgatgatgatggttgtggttgtggtgatgatggttgtggtggtgatgatggttgtgataatgatggttgtggttgtgatggtgatggttgtgatggtggtggtgatggttgtggttgtgatgatggttgtggttgtgatggtgatgatggttgtggtggtggtggtgatgttgtggttgtgatgatggttatggttgtgatgatggttgtgatggtgatgatgctgcttgtggttgtgatggtgatgatggttgtgatggtgtgatggttgtggttgtggttatgatggttgtaatggtggtgatgatggttgtgatgatggttgtggttgtgatggttgtgatggtggtgatggttgtggttgtgatggtggtgatggttgtgatggtgatgatggttgtggtgatggtggtgatagttgtgatggtgatgatggttgtggtgatggtgatgatggttgtgatggtgatgatgatggttgtggtgatggtgatggtcatgatggtgatgatggttgtggttgtggtgatggtgatgatggttgtggtggtagtggtggtggtggtgatgatgcatgcggtgtagtcttaagttgaagttcctggaaatagtaactccactagatgtcagtgtcatccaaggaacaaaaagaaggcaaattaattgtgaaatcatagcaattaagatattaaatttttatcatgaccagttttcttctatttttaaatatgtaaaattgaatagactcttcatccctggcagttgttggtgattataggcataaactgtcaaaatgtgtatttatttggaagtgtctagtcagaggacagatgcatgatatgcagacaatcttagtgaataaaaattcgtgcagactgggattgtaacacccagctggaggggcactatccaccttatttattagaacatcataaagaggccatagttaattaagtaatgcatgtatcattttttccaataccattttacacattttataaagtacactgtaatgcactgctctgggctaacattttgtgctcccagatgtttgtttgcatatattcatatacaatttttaaacaaaaataaatgacttttttataaaatagtacaaataaaatctctgtattagtccaaattatatgttacatttgcagtaggaattctactttactaatcaaacactgagttatattttatttcacttatttctttggaaaaaaaacaaacattaaaagactgtatccatttaatccctagtttggtaatatgggttcttagagcaattaatttagtttagcggccctagtttacacgtggttaaagtgttttattagaaaaatttttcaaacatacagaaataaacacgtgtgtactcaccacacgcttcatcaaatacaagcccttttctgctacgctgctactgcaagaaataagcaaatcctaagtaaaagttgcagctccttccatgtgcctccagaacacgtttctcctgcctgtctgcctagggatcagcattaacctgaatttggtctatattatctgtgtccatgctgtaaacttgttctagtgtgagtcttgaaattatacattacatggccttgtccattttcaagctttataataacgatgttatttatgtgatatttttaaaaagcttaccatataatgttgataccattaaacagagccaagtgcacccaggaaccaaagattgtgaatatacattgcccagctcagaaacttgccataaaaaaataaggcagcaaaattcatagtgcgaagagaactgtttcaatggcatttatttgtttttgcagaggagctcctgggtacctcccctagtgtgttccagcagccgttgacttagccactggttgaaagggggtaaacgggcttctctttgatacagagggctcttggcaatgatgcgcttgttcctgtaggcaggtagttagttgatgggagtgtcctccatggcttctctcaccacggcaggggaagttaaacatttttgtaaagaagcaggtgataattggattaccttaacctttctttcctctgcatcgagtgtttgttggaggctaagcagttactatggtggcttgctgtgcgttgacttaaaatctgcagcccttctgggtgtgatctgctgctgttccatttctggcagtgtgcagcaggctgtatgcagggcagggtcactcctggcagacgccgtgggtgctgagggctgccttgtgtctgatgattcctcggatccattccagcatcacggaaggatgtgccattagtgatgaggtctcccaagttagcagagaaaggaaaccttactgggaatttgtatatgctggggtgtctatgtccattggatttgatttagtctggttgttggatttaaattttatggatacagcctgatgtagacaaactaattgtggggctgaggtacagcaaactcttttgcctaacatcttgccactgttctttcccgaaattttagttttttgactgtctccggcaaattgttaaagttgtcaggaaatttttgttttatttttgcaatgaagtcttaccgaagtttcagtctcttttatctcagagtgtgtgatcagatattgagtttggtggttcacagttcatgttctaaggtgtttacagcagggcaatgagctatttcttcccatttcaagtggaatctgaaattctgctctgagaatggattggctggggggacagatgagctgccttgttacaggaagatgttaatttttttaaagtttgttttgttaattattctggtttaattaaccagaataatgaagatggatttccaaatttagaaatttagaatttgtaaaattcccaaagtactcttaaatattttttgttaattaaaaaaaaatttttttaatgttatcactgtgtgctttgaaattcattttaaaactaggaacctcaggagccagcttttctcatcaactgtgatgtggagaaaagaatttaaggctattgtgtagctcttactatacagtattaagaattaattaaaaagaaaaatgagcccttgacaaagaattgataaatatctctattttccttctagcccaaagggttaaccttacgttttatattcttctgcaacttcatatttgttgcttgatttattccctgtcatctcattctaggcatccaccaacctaagggggaaacaagtgcacagtgcttggcacgtagtaggtgttcaataagcatcagctcttatcaccatctgagaagcatgtttcctaatgagcacagctgcccaggagagtagcaccctttgaagtgctagatctgagtttccatcatgggaactgttctccttgtcctcctccttaatttggtagcagcctcttctggaatcctaaatgcgtcccatcagcccttgtttgtattatgacccatgacattgcccctttaatatgtatgttttttaaatcagctgttccagctcacatccctttgaacctggattccattagcttttcattgtagcagtggacaccacaaagtctgttcatttcatatatcatctcagatttgaaaagcacgtgaaaatgtttctccattttcaatattgtgtgagtaatgttcccattgaaaagtaatggagtgaagttgtcacttgtcagcacagttattaaggaggacgagtctccaatctttctctcataataaaataaatctgtcagaaaatcattgtgctcacactttctcatgccatcgagagaggagactgagacgatggagctccttcagttttacccaagtcaaggtgcgcttttggttggggcttccctgggttaaaggtcaccacccttcctgcccggtggcagccactcgtcgtccgcagcacgtcagcagtgcatcggagataattgactcaggaccttgtcaaataaagctgttcattatttcccaaatactgacctttcgtccaaaggcgattatcaggggttttttttccccttcattattttttgtggtattgtccactagcttaacttcgaatttgccattttccaaccatccagaagcaaaaacggaaaatgttaacagcaccttgatactaatcaagagtgtgccgttaaatcgcacagctgactagtcaacagaattttaaaatcattcaaacattaattaaatacatatgttgatgtagtagattttccaaataaacattgagcagccccttttttcctcggctgtgtgaactgcagctttcaagtgtttttctgttgggcgttactttcccatatggcccattggtttctagtagttgaattttgaactttttaaaaaagaattaaaagataattctgtggtggaaaagtcagggggaaagtttagatgattctctttaaaaatgatgagtcagtggagatgaactactgagctgtctgctcgtcggacgtgtctgtgcgcacacatagatcgcgcatgttttctaaatgtgtattggcaggaattctgcaaacaggggcagagccccgtctgtgaaccacagcccttacccagatgccaactttccttttgctttgcagtctcggaaagggagcgacccagacaaagagaagaaaggcctggagagtcgtgcggacagcattgggagcggccgagccatcccaattaaacaggtgagcagcctccccatccttccctccctgtcgccggagatacacctcaggtcttcctggagatgatgctggctctcgcaccaaggtctgtctgatgtgctctgttgatgaatgtagaagtctctcacttgacatcaattagcagagttcctgtgtgtattcaaatgggatcattagaatgagaagagggaacggagacaacagacctaatgaagtgcgggctgcccgcctgcatatggagtgcgtttccaggctgagagctttcaaaggctgcctttgtagcacggctttgattgggccgcgggccgccgggcaacaggggtaactcagatcgcctacaagagccccttgtgatcacaggaacagcccgacgtggccctaatttgctctcacagacggacatctgaacactgtttcaggctggtttgtaacaacgaggcaattagttgtgataatcatagccggtgtgtcagctgtgcgctcttgtttgtaatttgctaatgaaggaattgtaactttgattaggttcggtttcatttagaccttattatataaaggaacatttacagctgtaatgtggggccttaattaaactttctcattacacaacaggacttgaattcaaccatttgttttggcctatgttgctagcctggaacagggtttcattagcccagaaaccagattctaaatcactttatatctccaataagaaaaaaaaaaaaccctggagtccacgtgtgacgtagattgtggtttgatttccaaggagaataaaaatagagttcaaccccacacagtggcttctgaaatgtcatcttttggtttgttaaagaaagccaattgatttagagtgcatccttcttgagcagaagcctctgtgggcaggagaatggctccgcctctcaggcacagggcttgtgaccggtgtgcacctccggtccagctcactgctttgctctcctctctcctgcgggcacctacacagcatcggtaatcccttaggaactgtgtaggcactggctgcccttaaaaaggggagagtctttccacacatggagttggattattctggtggtgcaggtttcgtccatttgaagcaaataggaacgcagccttagagaggggccagccagtgtcagcgtgaagatgtgggagaggaaggggttaaatagggccacagcatcttgggtgagaccagaggagggagtccacagagtttcccaaggagcccaggaactactgcaaaaaccacacctctgcccacagcgtaaccgaccctgcccgggagcaagctttctccttccgtgctcacagggcacgcctttgccaggcagagaagaaggaggcctgcaggtcatcaccaaggccctcaggcatctatgtaagatacatgatcatctactgggccgcaaatatatggattggcccggggcacctttaggagaaattctcttccctccatatattcaaagacaacaacaacagaactttccactttgatgatgggtggtgttttcactataaaacacttcagaggtccgtgcacatagttgcttattctttcttggtgcctttatttataacctaactctgcataagctaatgttactgtgtaatttttatgccactgatacctttttcaactggaattataaaaatcagttataaaaataattctttttcataaactggtaccaggacatttcctttggggaatattaaaacttaataatagactgttttcttaatgcctgtctgtggttgatttgggtgatttgggtgggagcgctcaccagcctggcgggagtccctctgtgcgagccaggtgggcccccggtataattggaaccttcattcaatttgtacctgctcatctgtggagggggctagctttgcaggctagcttttcaatatgtgtgcagattggaactgaccatcaagcgtaaaatgagtattatccagtccttggatgcctttcgattgtgaatgttcaaaggaatctcgttgaaatctaaatcatggtctgatttcccggtgactcctgggcacagggagctccttgtccctcctaattgtccccctcttgcagccacagacagctccctcctcacatccacacctgtcccagcaaagtgcccccgtggccagctctccaggcctcgggtgcctcgtctgtaaaatggggaactggatgatgtctgaagcccttgaagcagttagatgtggaggttccacagagaatttttaaatgttagcaaaactggatttttaaatcggggcacccttgtcaaagcctctctgtgcatcggacggattgatgtgggtttgcagacggttgtatcgatctatctcacatccctgtgtgtacccttgtttctaaaggaacatagatcacttcaggtagcctgaattcctgaccttcctggtgtgatgacttcagtgtggaaatgaaatgagaggattgcaggggatggagcctgatggccatattctagaaactcaaccaaattatttgttgaataaatgaacaattaaatgagtgcttattatgtaagtgctgttcatacaagatcccacttaatcctcgacattgccacagttatggtagctgtgttctccttattttaaacacagagatagggagggccctataccaggcagctaggaagtaggtccaaggattcggaccaggcctctctgcccctatgtctgcgctctctccactgcccattgatgaaaagccttcagaaagcttaggaagcaaagttacatgttttaaattaagtaagtgaaccacgacctgagacaaaaatatcttacgactgtataaagaaacttctgagactgcctgcagcaacatatttctccagggataacacagccctgctcagccattctccgggtgggaggcgtcattccattcccatccttaccgtgtttgccgcaaacatgttctctgctcttgtcacttgctgcagagaactgtgtcttaatgctcagcccatgtgaaagactcgggtctgcatgatcgaagcctcacacaccagctaatggacctttgcctaatggcagaggagtcgttttagaaccccagcaacctgcgtggagttgctaatgcagactcttctttcccccagcaggagtcttgtaatggatggtttaggatccaggcaaggcagccttcaacactctctgcaatctaaccccagagtttacagatagtacgtgtcgcagtggcttatgttaaccccctttcacttccatctgatacctcgttcgctgtaagcatccaggctccccccacctcagtgtgggagcttgccaaatcatgatggtcaatgacgttgtctctttcttctttctcccgattaaagattccccatcaagaatatgacttattttctggactataacttcatttcttgtggacctgggtctacttctcctttggtgtcctttctggggtcttggaggaggttggttcagagaattcggtttctttttttttttttttttttttactaataaggtctattcgagtaaaaattaagaagcaaagcaagaaaaagccagaggcccggctcagcggcaagtgggtttgtcacgtattaatttttcattgctgtggagagttgtacatacataatcacttgattgcagtgggagttagggagctcctatggtgccatttgcataaatcttgttaagtcaatggcagttaatgaagtacaaatgagcccggagaaggtgacatgcaaatcgtgggtggcagatgggaggtctgtttgggggacagcagctgtgtgctctcctttctttctttctctttagcattttttaatctctatatttgagtacagatacacagtcatacgccttggcctcctccgtgcccttcgcagagccccggccagagaacctgtccatcccctcctgcctctgatgtccaggctgcataaaccgttcaagacttgccttgtacttggtagcgtacgctagaaggatttgaattttttgaaaatcatgctcagtttatctcatcgtgcttacgcaattgaaagcgtatcatttttacttggtggggacacacagaacctcctcactacatcttttgagacgttgtgttgtctcctgaggtttcagagaataaaaaagaatagaagataccatctttgccttatcatgcttccatttgggagtcttttcttcctttttcagacaggccaactgtatttactgattattccccgtccctggttcgtggttggaccatcaggggattggcattcctagggttagtcaggaatgagaaatacagaaagtgtgcggggcatgctctgtacctcaggccatggggacgaccgctccctgtcatgcagacccctcagaggggccgcccccggcccggcccagctctggccagggtgtctcacgctcttggttttgtgtttaaggatttaagtgctagcaggactcacagagagctcttagagattcatgggaaaaacattgcctacgactttcagaagttttgtgtttatttgatcacctggctgatgttttgagagaaccaggtctctgcttgccttgaagaaaggtaggcaaagacgtgtgcatcaggaggcaacagccctgttgacagctgcggtggtcacatgctggggatccttttcttgcaggccacccactctggtccgtcctctgcgatgcccgccaaggtgctgtttctcagttctttgggctgcagggcgctgcgggggaccctccatcaggcacgctcccttttgtgatgctcggtggatgcaccaaaggagcaacatccctcaaaaaaactttttttttttaagtcttcattttgaccttgaaccctgatgtcatggccacctccagggagtcagctgtgagagcagtcatttcccagcagccatctgaagccgtgggaaaagccttcccaagctgtcagaggaagagccggcctgcccggggcaagcccgccgcacccgccatcgggcctgtgaactgttttgaagctgtgcgtgttttgattctcagttgagtagaaagaggcaattgtcaattaagtgaaaggaacctctggagttaatcccctcgtccagcctgccgcaggccaccgacctgtgttgtctggtacctgggatcaacacgaggggtgtattgtgtggcatgggcagaatgaaagcagcctaatgacgccagcgttaacagctcctgaaactttgacactgctcacagcgagttggttgactgcttcaccggcgtgtgctgctttcatggaggaaacaaatgtgaagaccacgctgaaacttgatagagatcggaggagatggagaggaatggcagtgcccttccttcaggggcatggagagaggagctccacaggcctgcggcctctctgcgtaggcagaggtttacaggaggacggctcacgtttattaagccccaccattgaggaaccaaggtgagcgagaggcccgccgagcgtacgatgtccacccacgtggcaaatcagctctgcctgggcgtaggggcccgttttgctccccagaagcagataatttacagagtgaactgccgtgccctgcaagctaattgacctcacttgggtgaacaactccctgagagtcttatattcagcccggttcacaacagacccagcccagttacgatgattaatgtaatagccaggcaggtgtatcagtgcttttactttgactcctcaaatctcatactgtcattgccagaacagtccagaatatctggaggcctacacgtgaaatgacagtcatccgtctttgagtatatcgggcacaccctcccctacatccccgcccttttggcaatgttggtgggtgacaatatgttcctcacaagatgtgcagaatgtttatttggaattactttacccaaagcacaaaatccatcatttatatgcaaatctgcaaagcaatcgaaaagaatacttcccttggccgtgagggttgcatgagggtgacaggaagtagtgtagccctaggtgcatcatacacgaccaactgccatgctaacagaatggcgtttccaagaacggaagttcgttttaagactcagtgtgtcctctgtgtatccattgtccagagctggtgaaacaggaaaagttcctttatctccctcgcagggcatgtgatgggctgtggctcacttcttcggtgtcccgcagctcagacccctaggggggcgggcaggcagtcaggcgggttgtggggagcatgggctccgatcccacagcatggtctagggctgggcgttgacagctcctgaagccccagtgggcgtgtgttacagtgtgcttttcggtttggctgtccacaggcagcctgtgaccatcagctcagttagtccctctgccttattgcaaggacagagggtttctgtatcccagggttcttgccttagtgtactggaagaattggatcacacgtcagcttggagaatgagtgcaacgtttaatgagtggtgccagtagttctcagcagatggatggtagccagaagggcgatggagtgggaaggtggtcttaccctggagtcgggccactcagtggccggactctcctcctaccgcccccgggtgaattccacgtcacccacatcgttctgccattggtggcctgccagagtctgttggtgtgttcttctgccggtgtgcttctctcgacgcccagccgcctgtgtgtgtgcccactagggtctcggggtttttataggcacaggatggggggagtggcaggccagggtggtcttggaaaatgcagtgtttgggcgcaagaactggaatgcctgtcctcgcctatgtctgtgggcacaggcccaagggcggagctcttgccagggagcctgcccttctctacccagcacttccctgcctgcctcccatttcaccgggataatatctaagtgatttgtttcagcaaaatagtgcttattttctttaaaagttgaacagtggtggtgaaatccaattccccttgagctcagaaatacaagctctcctacaagtagaggaaagattctcaaagttaatgttgccagaacttgtttttgtcttgatgaatcaaaaagatacttatttctggaattatttcttatcagatttgatcaactagtaacaattgttcactggtccttgtgtgacatgccctgggtcctctgctacggctggaggaggcagaaagtgtctgcagcccccaggctcagctcaggtgtgtactgacgatcccatcccatgacccccaatgcaagtggacgggtgtcacgccaaggagtggtgaattctactgagttagacaggagagggtgagggaaggacagggaaatggaggtggggacaatcccactggactgggacatacaagtaggtggtggcagaacaggagggaggcagacagcagagctgcggatggaggggttcaggaggaagtggggaggagggtcctaaaggcccagggtatctgcttgccaaggactctggctgctctgcagagaagggttgatttccccatattatttgtaggagcagtggtgttgggggtttagagactcatggccgcacggagtggatctccctccccttcttactctgtccccatagggtttgagatgatgggggttctgatgtaccagagtcttggcggtaaccagcgtttattgaccacttttccgagtgccctgtcctagagctttccactgctgtcccccttacctaggaagtgccacgctcccctttcccatatgagaacattaaggcttggggagacagtggggcgtgcccagcagccccacacagcgcatgagtccccagggctgccctaatgaaatcctgcagcctgggcggcttaaacagcacaagttgatctctcggttctagaggctggaggtccaagacaaggcccagcagagcctgtttctggagagccctctccttggcttgagcctgttgccttcttgctgtgtcctcccgtggcctggactccatgtgcacacgcctggtgtctctttttcttataatgatgccagtcccattgaatcagggtcccatctgtacgtcatttaaccttgtctccaaatacagtcccactgcgggtgagggcttcaacatgcaaattttggggggacgtatttcatcctgtaacacacagctgggtagtagcagagctgggacgggagctgagctctgtgtgaccgagagccatctgccatgttctttccatctggaatgtcctagcttaggccttcctggtcatataaggtaaggccacttgatttctaaccaacatatttgagaataaaaaagaaaaacttacttgaagaggccgcatgcgttagataggaagcatacgagactcaaagtactccgacttgggggtttccattgaaactttcctaagttgtggtaaactgttgtcatttgaaataagactgttgctggaacgaatccttataccaggtgcgtagctctcactctgtgcagtgcgttttacagctgttgaggcctttcagtcccgtccatgggagacctccttcaggctggttttgaaaaccaaagctcccttcccttgcggaggcagctcctcagggccgcgggtaaatgttgggcctgtagctggggatgttcaggaagagcctgtggattgggcaggtgctcactgtccgtcagttgtgtcactggttgctttgacagtggctgtggtgttttgtgttttggttaatttctcccaggtataaaagatagctatatactcacttcattactgaaagaaagatacagctgggcatagtggctcacgccggtaatcccagcactttgggaggccgaggtgggtggatcgcgaggtcaggagatcgagaccatcctgactaacatggtaaaacccccgtctctactaaaaatacaaaaaattagccaggcgtggtggcgggtgcctgtagtcccagctacttgggagcctgaggcaggagaatcgcatgaacccgggaggcggaggttgcagcgagccaagatcgcaccactgcactccagcctgggtggcagagcgagactccgtctcaaaaaaaaaaaaaaaaaaaaggaaagaaagagcaggagtgcagagactccaggtcagacttaggaggcctttcaccttaaaggttaaaatccccacacgtgacaagtagctctgactacttcccacagtctttggccatttgcaaacactacatagaaacagatgtctaccagctgggtgtggtggctcacgcctgtcatgtcagcactttgggagaccgaggtgagtggatcacctgaggccaggagttcaagaccagcctggccaacatagcaaaaacccatctctactaaaaatacaaaaattagctacacatggtggtgtgcacctgtaatcccacctacctgggaagccgaggcatgagaatcgcttgaacccaggagacggaggttgcagtgagccgagatcatgctactggactccttttttgatctctgtctcaaaaagaagaaaaaaaaaaagatatctaccaagaccaagactcctaaggaaattgtatcattaaagtcttatttcagttctgcagtatttatttaacagttcctgacagcagactcagtttctcctcgtgtaggaacttggactgtggaataggacttctcccaagctgagttttgtcctttgtgaatagaggctttgacaaccaaacaagcacctctcctggcagagagaaatcactggctgccagaatttcatgttttgtttagaaacagcaaccgtggaacttatggcacttggcatggctcttagaccagacacattttcccagaaatggtcaggaaggcccagactgtgcactctgtcccaagactgtcgctgtggttctccctcacacacccctatgacatggttctgcttgttgcctactccagagcctttggctccacaagttctaaagaaggtggcggcttaataagtcttcacagtccccttttgaggcttttcaggaaagtcatcagacaatgacatttttatcagatagttttgagtagcaaaaacactttttcctctcctacatctaaaagtaaaagaatttacttttaactgactcactgaaggccatgttttgaaaccaaaacactctttccttggtaccaaagctgacagctataagtaaatatataggaatgtaaatattataaagtaggcatagaagagtttgttagttttaggttgggtgcggtgcgtcatgcctgtaatcccagcactttgggaggccgaggcaggcagatcagttgtggccaggagttcaaaaccagcctggccaacatggcgaaaccccatctctaccaaaaagacaaaaagtagccgggcacggtggcgcatgcctgtaattccaactactcgggagcctgaggcaggagaatcgcttgaacccgggacggggaggttgcagtgggctgcgatcgcaccactgcactccagcctgggcaacagagtgagactctgtctcaaaaaaaagaagagtttgttagtttgggaaatatgttcctagttagacattgtccataaattacctaatactatagttaatgtttgcagactggtgaaaacagaaacatttcaaaatactattaacatcttagggccgtcccaagtctagtcctcctggttcaatccgatctgctccctgcaatatttactccctaacctttccttctgcttaaaaactcatcagaatcaaccacattattatcgtgtgagacttgtaataagaatgctggcagttacatgccgagtacatattgtacattacgttggttgcttcatcacaggacctcatttaattctccaccaacctaagatacaacttgctactctgttctagacgaagagtttgaggttcagggatgttaaggtatgagaccgatgttatatagctccacgtgagtggaagagctgggattcaaatccaggagtcctctctgaaacattctagaaaagcctatgctgttgcatccccttcccgccccatgccatctgtgctcaccatgaccgtcttttttttgtttgtttgtttgttttgagacagtcttgctctgtcacccaggctagagtgcaatggcatgatctcagctcactgcaacctctgtcacccagattcaagctattcttctgcctcagcctcccgagtagctgggattacaggcatgggccaccatgcccagctacgttttgtatttttagtagtggcagggtttcaccatgttagtcaggctggtctcgaactcctgacctcaagcaattctcctgcctcatcctcctaagtagctgggattacaggcacatgccaccatgcccgactaaggtttgtatttttagtagagatggggtttcaccatgttaggctgttctcgaactcctgaccttaggtgatccacctgcctcggcctcccaaagtgctgggattacaggcgtgagccaccatgcccggcccatggccatcttttctgtgcaagatcaagcatcaagtacacagtgtactttcctggtggggcaccagcaaggcaggctgttttacgcagggctgtcctggaaagtctgtgctgtctggcacctggatcaagatcagatgaggtccttgagctccagtgttcatcggagtccctgtgggcccagaggttgcctgagtaggtcagaatcgagtatcgggaaattgtatttcttttcttttcttttcttttttttttttttggagacagagtctactctgacacccaggctgaaataaaatggtgcaatatcttggctcactgtaacctctgcctcccgtgttgaattgatcctcataacagcctcccaagtagttgggactacaagcacacaccacgatacctggctaattttttgtatttttaatagagatagggttttgccatgttgcccaggctggtctcaaactcctgagctcaggcaatccacccacctccacctcccagagtgctgggattacaggcgtgagccactgcgcctggcaggagattgtatttctgtgttctcaagtgatgctgatgctgctaatccaggagccacactttgagatcccctttctaggcacatggagtcacttagggcttctttcctttcccgcctcacaaatagatgactctttgattcgtaccagcccctttaatctgtgctcgtgaaaattttcctagccgtgaggcccgtgtcagatgccttctgttccaggtaaaccaatgagatgtgtgctctttccttttctttcctccgatgcccgtccgatcttgggatcttgctctctatcttccctgtttatagctatgtgcatcattcacgcctcctttcccacgtgtttccggatggtgcacactccgagacatgttctttctcctgcgttgtgtacacagcagggagggtatttggtaggcaggttgctggtggtagtagcactaggtagcataggttaattgtgtaaaatggcttttttttttcttctttctttcttttttttttttttttgagacggagttttgctcttgttgcccaggctggagtgcaatggtgcgatctcagctcaccgcaacctccgcctcccaggttcaagtgattcttttgcctcagcctcccggctagctgagattacaggcattcaccaccatgcccagctaattttctatttttcatagagatggggtttctccatgttcaggccggtcttcaagtcccaacctcaggtgatctgcctgcctcggcctcccaaagtactgggagtacagccaccatgcgtggctaaaatgtcttttcttcaccaaaacagattttgtttgtttaaaagaatatgttatattggagaagttacagtattcattaaattgtattttcaggaacattataatttttaagtcaacattctttaacttttatgtatctaagatagtatgtttaggttacacagaagtggtcacatttttttaatctgcaaagaagaaagcttttgccagtgacccaaaataatttcagaaaactggtttcttgtacaacttttctacttttgagtatttatccagaagaagatttgtttaaataaatgtcttcacatacaaaattttgtttataaggaattcttcaagattaaacccacaaattttagtaacaccggactgtttttgtaattgccaagtttttaccatattgttcagtctctatcagccacagcctctgtgatttcattcatgctaaaaacaagaatgtttatatttttagtgtacataaaaattaattttatacaaatatataaaacagctacacagaaatactagtggagagacgagtaatgtgccaagtaatgattaggcaatgaggaaccacgagaagcagatagctctggttgggtgtgttggccttcctttgctcatatctaaagtattggagatttaagacaatatgaaatcattgtatactaaaatgtatcattaacaaagaatgataaaatcctactctaagaaaaataaggaagagcagagttgtggaaatgcactgctatagtcctgaaacttgacccagtcttcttgaagggcaatctaacagtcatacatgatggacataagaaatttgattcactttgtcccagtgatctgtcttctagaagtttatcctcaagggaataattcactaggagaaagggaaaaagacctttagtgtaaaacagtgtgtatagcagttatttataatattaaaattctgggagctacaaattttcaacaagcaagaagttaaattagtaattgctaactgaatagtaccaggatgtacagccattaaaatggccaatttgaataccctttagagataagtgaaagcataaaacataaaactgtgtataataattggagcatgaaaatatgtatacatgtggctttaaattggatgaataggaacgcagtaacaagtgaactggggtaggtttaaagcagaacttcaatttttttttttttttttttgagacggggtctcgctctgtcacccaggctggagtgcagtggtgcgatcttggctcactgcaagctctgcctcccgggttcacaccattctcctgcctcagcctcccgagtagccgggactacagggaactttaaaaattttaacttcatgttttgaaataattttagatttgaaagaaatttgcaaaaaataatacaaagactccatatacccttcacccagcttccttcactgtggacatttttatataactagtacagctataaaaaccaggaaattagtattggtaaggtactagtaacttatctataggccttcttcacattttaccagtttttcctgaaatgttctttttaatctcaggatccaatccaggatccctcctttcacttaattgctttatttattttgccacttccaccctgagaaaattcctcaagtcttatgtccatgaccttgacactattttaggaatattgatcagttactttgtagaaagctctttaatttggattgcctgatgtcatctcctgaatagatagaagatctacatttctggcaggaaaaccacagaagccttgcacccttcctggtgctctgtaccagaggcacctgacagccacctgtcttattcctgggaacactgaccttggtcacttggacaaggcgagacctattggatttctcccttgagttcttatttttccatttgataaagttagggatgaatgtcttcggggagatactttgaggctgtgctgatcatttttagtgatagacgttgtactcaataataagtaggttttataaaatgaaaactattttcttctgataaatgtgtacagtcttaaataaaatttaaagtgcttttttaactcttcctgtattggagggaaggagtaaatgaggatgattttgaaacttgttggttacttaaagaagacctggggaaacctagaggtgaggaggaactggagaagcccaggagcgaggaggagctggagaagcccaggggtgagggggagatggagaaactcaagggtgaggaagagctggagaagctcaagggtgaggaagagctggagaagctcaagaatgaagagaagctggagcagctcaagaatgaagagaagctgaagaagctcaagggtgaggaggagctggagaagcccaagggtgaagagaagctggagaagcttgggaatggggagaagctgaagaagctcagtggtgaagaggagctggagaagcccaagggtgaggaggagctggagaagcttgggaatgggaagaagctgaagaagctcagtggtgaagaggagctggagaagccctgagtgagcccgagctgggagtggtgagtgtgagtggaccttcccagatagatctggtgagaatggggtggcagttctagaactgaacaagaggggcttcctggtcgtggaccccgacgggtgggcatgcggtagatacccagcacatccgagggaaggatggatggctattgatttcccttcaggccatgccaatatgtttgtcaagcaacagatgcaattcaagtgctactgtgatccaggtgtggctcgctgtttaggtaaagaagcttcacaaaggcgctgccacaaaccaacatgtgttctttgggtttcatctcgtaatttcattcatgaaggttgggaattctgttactcagaatcttacctattttttccaagtagtttctctcagagaacaaaaactatgtatagtatgtgtgtacatatgtaaatttatgtaacatattaacatgttattatgatatgtaacatatcattatgtattatgttaacaattataatctataattctatagattaaccctaagatttatttttccctaccatcttcccattgttgcccaaataactgagtgctgtctttccccacctccccgtatcacccaggctggtctcgagctcctggcctcaagcaaacctcctgccttatcctctccgagtagctgggactatgggtgcgagccaccacgcccagctctagagtgcttttccctgtgctcgcaccagaattacagtgaactgcccaacaaacatgctgtttttaaagctagaagggaccctcatcttatacctagggaaactgagtcccaggaagggtaaagagcttgctcaaggtccttccagatgctcttccagtaccatttccaccactgacaccagcattttcttattccttgtgcacttctcaaaaaaatagaaataacaagtagtggttgtttactgttttgacccagatatttttattgtattgcgactggtcagctttttctaagttgaatctttaagcttcatgctgttttatctgtttttttaaatatgcaagggaatagataaaaagcattacctttgaaagcatgtggttactaagagacaacatgaccatcctttgtgtgtttatgtatctagcaggctcattgattcccagcagtcctgtgaggctaggtggcattcattcctctgcacattttatagatgagaaagctgaggctcgccttgcatgatttcctagagcctggaagaggcaaagataagattcaaacccaggtctgcctatcctaaaaccagtggtcttcacattgaagggccttatgtagcaccgagctcccagtatgtaacttaacttatatataacttaacattctgtttatgttaaaaattcaggcacaggactacacccagggactactgcagaaacgttttctaaatagcgccaacgctgaggggtcttcgattggtggcacccgtgttccacggtacagctaggccttctgtgagatccctttccccttaatacagaaatcctctaagtgtattcgaaagcagttgtttgtaattggagtatctgggattgacagtggctttaattagttgattactagttctttaaaatgtactgtactcactgtgggtcttgcaaattggtaactggtagctaccagtgtaattaaatatttcagagcacttggctacagtagcattgaactgtgaagaaataatgttgtacagccaatcaaaaagagatacttgtaaactcatttacagcgtcagtgtgtgttaggaccatcattgagatgcttattgcaggagaaattaaagatacaattttgtgctaagaggcaatgtagaaattagttcccgaattacttgttaattgatttggtgattccctcgggtctgcatgctccttttccccctttttgttgttgcattcagttaacagtgactattcccagagcaataaaaatatattccacatgtagatgagatgtgcccttatatgagacggcctgcattctttcgcggtaccaagaaatgctcaacctaaaacacaactgtgtttttctcaggcatattgttgttttatgtatacccatcaaggtaaccggtgcattcacgggtttggataatttcaggaaaaggaaagcatgtttttatgtctcacgtttacaggcgcttttctgatttttctttccccctaatggaaaccttcctttttttatcaacagtggaggagattcaggagacttgatttatggaagctttttcttatttgcaattcagcaagaataaccatatgaaagaccatttgtagaaaagtgcaaattgctactgaaaatgatattgaaagaaaatgagacctgtttctccttgttgaaattgagtgtggatagaaggagagacagccatcgtgggtcagagggagcctcccaggcttcctggatgcaggctcccgtctccagaccccttccttcttgaccgaggggagaggacactgaaatgatgcacatattggtgctgctaatgtgaaagatgcagaaaccgttatccttttgaatttccagtggaagatccaacgaccctttgaacagctgccaccatggtggctgtggcttcattttgaggaaaacatttttaatatcttgttggccgtgcttatggcctgaaaagcagcattaacgagtttttgaaaactattattattcattttaggccagtccgttatttttttctattgcccttcccgtgatcacttatgcatataaatatcattatgcttttgcttaactggggcaaaaatcatgtgcattatttcagtgtctgcttttaaaagtagatggtagtattttattttcagttaggtgaagcagaaaaatgtatccagcaaagtcttcattaaaaagcttaagatggctagaactaaatatacattgaacacaattactaatttatcaaatatgtttgcatgttggtcagtatatacaataaaaaatagtgtttaatttgaaatgttaaaaccctctctaggtccaaaaaatagaatggatgagacctactatttgatagcacagcagggtgactttagtcagtaataactatacatttaaaaataacttaaaagagtgtcattggattgtttgtaacccaatggataaatgagaggatggagaccttattctccacagtgtgctgctttcacattgcatgcctgtatcaaaacatctcatgtgcctcataaatatatacacctactatgtactcaaaaaattaaaaacagaaaaaaaaaaatagaaaccctctcaattgttgctgcacccagcgtggaagaggaggtgtgcgaaaccatgctaacgtggcgccatgccctgtgatgaaagagccacctgcttagttgttggctccagtagaaggagaaggaacacaccgtttgcttactggatggcagagcgttggcatgctctttatccctcatagattcctttcaggttacccccaaatagggtgacctagttttcctcatgagcatggcttattaagggccccaaaagtctaacctctgccaactcagagatgctgcttgggcagatacagggcctgagcagggataaggaaaggtaaccatcagctgcataaccatgcatttgcaggttcattctttctactttcgtctccgttgctccgtttcacatatctttttttttcttcccccacccccactcctttttttgagacaagagtcttgctgctctgtcacccaggctggagtgcagtggcacgatctcggctcactgcaacctccacctcccaggttcaagtgattctcctgcctcagcctcccaagtagctgggattacaggcgcccgccaccacacccagctaatttttgtatttttagtagagacggggttttaccatgttggccagggtgggctcgaactcctaccacccgcctcagcctcccaaagtgctggaattacaggtgtgagccactgcacacggcttgcttccccatatctttttaaaaatgtttttttgcaacattagccaccctgagagtttcttcacgaagttcctgtggaggtggctggctgtcttcgtcacttttctccacagaatgtttctaaaacacacaaatttggccaaacagcctccaaagcaatgatttcatatctccttcctcctattgttcactaactttgattaagttagagaaaagtacctgcacttttcagatacggtggctccgcgtgttggagaattcagtaccagatccatggctcatcctaagcagggcaaggaggaggggagctcttcacccctgggcgggtttgtagtgcggcttgtgcgtctccccagattgcagaggagaggaaatacatccccttcaagatgagaggacacagctgcaacgtcttattttaaaaatatgtgtgacttttactttctgcttcatacatgcatcacgtgtttgaatatactttctattatttgtgagttaacattgctgtttttctccaagtgtttgagtgaaattgattctccacgcagactctccttgctcaccctgaggtttcagggctttgacctgagggctgagaccacagggcacagctcctgacccacgtggctgaagggcttggagcaggaggtaagggggctgccggcgtagctccaaggtgatgaatatttctacttgatatttctcctggtatttctgcactttaatgactatttctactaatacttgtactaataatttttaatggttcacattgagtaggtgacattttgatacattaatgagccttatcaatgacttttaaaagttccttagtgtgccaggatactttgctgcagcccttggaaggaaggggagagggtgtggctgtggcccccattctaccctctgagcatgagtcacaggtggcacgcctaagagtaacatccacggctgaatcgtcaccggcattgaactacacttccaaggttagtcagggaggctttcctttaacatagcttgcccgtactaaaagctgtcagaatactggagaaatgtaggccttgaagatagaggggtgttttcaggggtggctgccttcactctggaatgctttgcgcctgctgggatgttgctagcatgcctgtggggagaggcccggagggctgggctgcgagggaggctgcactggcttctgggaagcgctggtttctggagcaggccagcctgcgggactccaggactgaggcttgcccagccactgtgggtcctgacggtgcagtaggggctgcattttgacagacttacaacaagtatcccagagaaagatgagagcagatggggatcctgaattttggtttcctggggacaaatgttttctggcttgttctcatgtttctgggaaataatgggattaaattcgagtatctttcttggctacaggaattgatggaagaggaagtattttgaactcagtgaaatgagcattcctctgcactaggccgacccctttctgtggcagcccactggaacataagcaccccatgttgggaatttctttttttggtcaccagtgtatcccagacccctagagtagctctcagtaaatatttatgtaatgaaaaatctcaattctcacaaccaccttaggagggataatagcataatccccatttcacagacagaatgaatgctcagagaagttgagccacttactcaatgtcactcagcctgggagtggtaaactaacacttatgcattgtatggaactgcccacgagtcacgtttgttctatgagaaggcagaaaatacctggggaggtcttgcccaggggtgtgtatgtcttaattgataaacctctggaattggaaacgtagagggtagtccagggtagaatttaggctcaagcttactttgagagcatgttgccctaagagtggaatgtcatggagcaaattccagaagctttcgctcacccagccttttcaaagtccatcccaagactgttgggtccacatgttgctcggatgtcatgagatgtccctggttgacacgttgaggacacgctaaaccacacgaagataatgggtgtcattttgcatgactcacagcccttaccatttgaacgtgcaatggatgctccgagaaagaacagaccttgagtcctcgtttgtaagacacagctctcagacgcagcctgtccagagttctgagcctcagttttgggggtcaggtgtcattgtcttaagatgcagttttgtggactggtacagagttcagtctaaggcagatgtctctcttttattcctgttgtctttcaacatttgggctactgggtagatgggcaccagtgactgggcagattggcaccaggactttgtctacaacctgcgtttccctgtttgttctgccatggggcatgaggcagcgcctggctgaccttggacttgcaggcagcctctgtgcatcccctggcccctggccttgttgttagatggtgcatttcgttttctggagagagagagagagctggaccactgtggccgttgtcagaattccactttcgtcatcaaggattcattttctttatgtccgtaatgtgatggggcagcattagcagtcggtcacctgtgtttccaaagggagaagtattttcaggatgtagagactgtggccatgttaataaccaggttctaactttcctaagaaccctgagaccttgtgagcaagaaagggcacagcatttgacatctgagtcaatcctggccaaatgtatactgaattgccactagagaattcaccaccactcctgatgaagccagttgggtagttttccttcacttgtgaaaaattaatcatgatgttagcttgttatatattgcgaagagattttttataagttggtgatagatgatttttaattttttggactctctgtatttctacatcttctttgtgggaaattcttcaaactccatgggggcttggtgacccagcctgatggtatcgtccatccttgcagcagtgggtggcccctctgtgctgggctctgtggaaggcgcagatagacaggaggctgcttggccctggggagtttgccgtgcagggggtggtcaaggaccagagaaggtggtgtgaagaactggcaatagagagtgggtgtcagtgggccgggacaggcagagcttcaggaagtgacaagtagtctctggggaccggcacatctggacatggacagtcaaaggaagactgggggcacatggggaccaggacacctggacatacacagtcagaaggaagactgggggtcggggtgggacagcatgatgcagagctttggcggctggctgatggagtcgttctcatttgtgaagacactgtccagggctaaggcagtacttgccaaggcaaggccaccgtgatccgagactgggaggcccagaaaagatgcagacaaggtaggagtcggctctgtgtgacttccccatgacaccagtgggccaggctacagtcaccgtttgagtgcccgtggaggattggtttacttagtaaattcgttgtattttaaaagtcagatggaatttgtcttcatattttgctcatgtcagtgaggagatagatgtgtgctgtcacttagcagtgtccactgtctttcttcaaatcaaggccagtgaattttctgattgcaggcacttcaaagccgtcagttccattcattgtttttcaaagtattcatttcattaaacatcccatcagaaagcctctgatagagggtgccctctcatcaggtccgtgtgcaccaggaagtttacagttcagaagtgttgcatgctgagcactctttgtgagatactttgggggctcagggggcttggagtttatttgttgggggaagcaatgttggtagggggtgggggttgcaccttgaggtttctaggccagcccaggacggtgtgcggccccaagccactaacacagcactcctagtgttcctcacagcaggtggaaaatgcatttataagatatttcttcctcggaatttttaagtgattttacttctattggatgctgttgatagcctcattcttctcaggtccacctgtcggtaggcccagtagtcaactcctaactaatagagtagttattagctggttagttgtctgcagctaagcaggaatgggactggatggtggggactcctgtgagaatgctgatgggtgccgcctcctcacctgtgtgtcgcaggtgtaggcgatacctgggaagccgttgtacggggctggcatttgctacttttataagatgtcacaagcatgacccaggagcacaccccatgagagtcacagtggtaccagcacctgctggctgctctctgcactgatgacagctgttagggaatcacattcgagactttaactagattggtccagagtgcttcactcttcttctttaaaaaaaaaaaaaaaaaacagtaaacgttcttttttagagcagttttaggtcacggcaaagttgagcagaaggacacccacagcctccgccattgtcccccacagtctgttgcagccgatgagcctgcactgacagcactgtcaccctcagtccatctgtactttagggttcactgttggagtgtgttctgtgaatctggacaaatgtataatgagctgtatccaccactgcggtgtataggatcataagaaacagtttcactgccctaaaaatcctgtggtccacctcttcatttcccccaccgcctgaaatcacagatctttttactgcctctatagtttttcctttgccaggatgccatagagttggaatgatagaggtgtaaccttttcagattggcttatatcactaatatgcatttaagctttctccatgtctttccatggctcagtagctcatttctttccagtgctgagtaatattccattgcctggatgtaccatggtgtgtttatccattcacctattgaaagacatcttgggtgcttccaactttttgcaattatgattaatgctgctaatacacatttgggtgcaggtttttgtgtggacctaagttttcagctcatttgtgtaaataccaaagaacatgattgctagattgtatggtaagaatgttttcagttttgcaggaaactgccaaacagtcttccagagtagctgtaccactttttatttccaccagcaatggatgagagtttctgtttctccacatcctgtcagcacttggtgttgtcagtgttagactttggccattctaatgtgtgtatagtggtatcccctggtcattttcatttgcagttacctaatgacatataatgtggagcatcttttcatgtgtttatttgccatctgtaggtcgtctttggtgaggtttctgttcagatcttctgctcattttttaattgagttgttcactttcttattgttgattttaagggttctttgtatgttttggataatattccttttcagatgtgttttttatagatattttctcccagtctgtagcttgtcttctcgttttcttgatctttcttcttttccctcctaataattgttctccttcaaggttctccagcttattgatatgttgtttaggtaggtcttgggcttcattttgcctgtaacatatcattagcattttccttacagtttgataaaattaatttcaacaatttctacactgtgaaaccttctgagtgagcacatcctcaaaatcatcaactcttccgatgagataattgcttaggagcatatacagttcttaaaagcacttttatacattgtatgaaatgtagaatgggtgacattttataagttatatattgtagacattctagacttcattgcagctaataagcatccaggaatctgtgaagttcttatgaatgataattctccccatcctgtgtcagtgctaataacatctgtaattaacagctagggaagtcgttgcctgttggcagctgtgcttattggctgaagtgaccacgtgcaaaccaagcctggctgagccttgggagtgaagggatgttcaaacccacagactagaaggcaggtgggcagctggcacccagatcccatggatcaataccatgtgtgtgagagagagggtgggagagcctagctgccagaaggaggctggtctctcccctgcttcatgagtgtacaacaggagactggcagccccaaagcagctagtatcctctgccactgccctgaccgaggaccagggcctttggctctgagactgtgtgacatctgatggccagggcatgtacatcatcacaaggaaacaagacctggagggggccggtgagccagggagcatggtagaagagacaagccggagagcagctggctctggaggggcactggcaggacccgagggtgcaggcagcaagcaggctgttgggtgctgcaggcgctctccattggagcagtgctgtggaagcaccgtcggcctgccgccgtgctgagtgatgccagggccacgacagaggctggcgtaggcacgggagcgggaccacacgtggccaaatgagcaggaaggaagggacagggcaggattattttagaaacttagaaaaatcatacctgcttgctgtagcaaaattagaagatgtacatggacaaaaacgtagaagtcaccccttaatgccagtactccaggatgaaagtggttatccccatagtttgcacccctgttcaagttcactctctctgaaacacctaaaccacccacccccactctccaaggccctcatgctcaccttgactctcctcatcaccccgccccctcctcagagtgcttgctaatgtcactctggatcccacctatcctggcttccatgtgggtagaaatcttgacttttcgttacagtgaatgtcataaaaggtgctcaagaaatatatcccgaatgaatgaatggaacaataactggtaaacctttaaagatatttatcaaatgggatcccactacaaatatggttataaaatgggatcacacacttacatgtgtgcatgtttatgaatacatgtgtataactgaaacaaatgttctatgaaatgatcctaagtgcatctcactccaatcctccaatctggtttttttttttttttttttaaagctctggttgcagctcactaaagtaatttcatgacccactaattatctcacatattttgtaaaactcacattttttttgtaaaaaaaaaaaaagccagtagcagcactggctctttgtccagtattgacatgttaactgtcatcctagttgagccagccccctccatgtaggccagtctggcgaaatccagtgctgtgtctctatgcagtccacgggcacactgagttctcatttgcccggttggaacagctgatggttagttctcagcgtgatcaccgtggtcagatgggcgccccatgtggtgccttgtgggagaaaagttccaggttttctttagctacttccacaggtacacagaggtgtgctggccatggggtttgtgtctctgcatgttcttccgcatagtatgaggtgcaggcttttatttcatagggacacaccagtgtcagacagaacatggggacaagatcacactgcagattcagatatgccttctgtcctttcaaagggtgtatcctggttcatcctctgtccctgcctgctggaataactgcttcccccgctgcgtcctgtcctcgtgcacccacccaggccacagagcccggtctgtgagcagcaggagggcagagccctgtcctcctctgcagcataacccataattatggctcttaatttacatattccatgcctgccttgagaaaatattttacctggaatgtcagttttttgggtaccatccactggagttcacattcattttcaccagttgttcacttagcagaccattagaaaggaggtccctgcgaggtccccgtgagaggataggaaaatgccatttaaataaaaggtcagcaagagcgagagtctccgaagttagacaggcatccggagaaaggtggatgtggaaagtgaggttgacttctgggcgcatgtgtggaatatccaggcccttagaggctcgggtctagtggtggaggatgaggcccctctgccatagggagagcctgtcttaatcacgccacgcaggtggaacagactctatgcagaaaacttgcggaagcattttgctaacatcacgagaacatgtgattcgttagttggagtggacaggaatgacttcagaaaccagagcagggagtctcgcttaaagtcttggcatcctcgcccctcggcctcacacctcccccgttcccgattctctacttttgctctccccgattgcacagtagcctcactggatggacaggtgccctcagtgtgttccccgggcatgcgtttcccacgctgagctcagaggtagctttcagtaagtgccagctggattttgtcactccttcagttgcaatcttcagtggctccccatggcctgcaccaaaatgtttataacccttggaaggtgtcagagcctgtacaccccaaccctggtctggtctcagatagtctccccagagctcccagccatcaactttcttggttttcaaatacacagtgtatcttgtgctgccacacctggcagagaggctcctcagcttggagcgtttttcttccttcatctacgtctgtgttttgtaaacttgtcatcttttcagatgttgctcatgtagcccctctcttgtgtaaccattcttattcatctgaggtgtaagttgcccactgccccaccctgtgggcctcttagcactttgtccattactttgttaaagtagctggcacgttgtgtaagcttttccgaggaggacaaggggttcatatctggctctccatggacactgagttcctggagatggctgggactttggtgcttagccctgtgctgggcactttacaacaaaatcgtgtctccattgcaaaaagtttgtatcatgttaagctttgctcgtgtagtttactaataagtgtgtatcaaagattaaggtagaaagtaatgattttgatactgcttcttagacaaagaaggcggctaacaagagccaaccactgactggagaggctccggctgtcaccgtgattattaatacattgtaatgacattttggggattccgccatattttgtatggttgccagcaaaatgttgacagttgtattgtggttaataaattcatttagatttataagcattgtttacagaacctgttcgcctgctgaaactctaacagcatctgttccttcttactaattaactgctaattacaaatgagctttgtgtgtttgtcagtataactggctcatgcattttgtaaggaacattaacaaattgatttacatagtggaaaagcaatcaaaagagtaaactgaacagcacaggtctaaagccctttagccggcttttgaatgaagcaaacttttgatggctataaatattgccataaattttccattaccttaattctttggtaaaggtacagcgatcaaaagcaatattgagtgagtaatactcaaattagagcactgcagcaggtggccgggagtgctggtgatggccctgcagaatcctttgggggccgatagaggagaaacaccaacaagtggtcctgtaggaaatgcatccactcccttgtgggaatgctgctgacttttgaaagctgcactcgtgactggggttgcttcagaacccagtcacttaagtacaggttcacactgtgatatcgaagtcagtgtctcagccagcctgctgcaaggcgcttagccgggaagtggaaatctggtgtctgtcacactttttctcctcttgggttctcagatttcaaaccgtgttgatctgtgtcatgcttcagggggcaggcatttaaagttaaccagtttaagtgggtgattccaaaagtccagggctccttcatccactcttctcaaggagcgggagaagatggagacagccctgaagaatcaagttcctggtatgttttctaaagctccctcctcgagatagagaactatgacccaggccagagccacaggggcacagacagaacaggaggaacgggttacactggtgccatttacattcacagttaactttctaggtgattcacaatgcaggtgtaaaactggagatcacaactcaggcagctggatggagagttcaagggttttttgttgggttgggggggttgtgggagggggttgagacggagttttgctcttgttgcccggtctggagtgcagtggcgcaatctcagcttaccgcaacctccgcctccggggttcaagagattctcctgcctcagcctcccaagtagctgggattacaggcatgcaacaccacgcctggctaattttgtatttttagtagagacaggctttctctatgttggtcaggctggtcttgaactcctgacctcaggtgatccgcccacctcggcctcccaaagtgctgggattataggcatgagccactgcacccagccttcaagggtttttttttgaaaggtttaggctaaatatgattaacagcggttacattaaagtaatactgagtactttcctgagagggaacgtttactctaaaggatccagatacacagttgttggcctgagccctgacactgatgttcagggtcagaacagctgggaaggtggggagggctgctaggtccagggccctaagccatggaaggagaccctacttgccagctgtgagcctcaggcaaacccctagacctcttgaacctcagttaactcaggtgcagaatgaggatgatagaacaaccctcttccccagggttgttggtggattaataagatgatggagtctaccagtaaaggaggtggcatataacaacagctcactaaataagttactattgtcatgatctctgtattcctgtgaaagtaaccacatgtaaacactagacattaaaccttattaggtcatagtaactccatatgggaggagagtctcttttctcatcaataaatttattactgttaattccagataaatgttagaaaaaaattaagcttaaaaatagaatagataagggagtacaggctcccttaataaaggctaagagggaatgtcagagccgggggtggtggctcacacctgtagtcccagcactttgggaggctgaggtgggtagatcacctgaggtcaggagtatgagaccagcctggccaccatggtgaaaccccatctttactaaaaacacaaaaaaacttagctgggcgtcgtggtgtgcacatgtagtcccagctacttgggacactgaagcaagagaatcacgtgaacccaagaggcggaggttgcagcgagcagagattgtgccactgcactccagcctgggtggcagagtgagactgtgtccccccacccccccaaaaaaagaaaagagggaatgccagggttactttacaaagctgtagtttgtttaacacatttaattgacaatcaagccatctcacaaatgtaagtaaatggcactattgataaataacaggcttgccattggtgaatattttgcctccaaagtgattttgctaaaagtatgtgtatatacagtttctgtaacatttcatatggtaggaggaagaagaggcactgtgctttctgaagcatttattcctccttagaatttttcccaggggtaagtgttcagaaaatctgaagaattcaaaataatttgctccaaaatattatgatgtgattaactacgtattgtaccagccagcatttactgaccatatgtatgtattagccaccatcagtagttataaaaaggaaattgatttagtgagatacagtctacacttttaaaaactcacaacctagcaagaaagtcaggcttgtctcagtaactgctgtgcagatctgactgtactaggtatgcactagaatgtgccaggggaaccccgaagggatcatttgcttcgctttccatgtgttacatccatccccaaccttctagtattttctacagatgacatttagtgaacagaaagcctctctctctgaccctaattgattaaagactttttttttttaagaagcataaattagaagtgaacacaactttttggacttacaagtgaaaaatccagtgcctaagactttctggtgaaatgttgccgctcgggaatttcagttggaaacataaagccattcattaagctaacgcgggtgtacgtgaggtttattcaagagataaattgctggtgtgttggtgtttagaacatcaactctgtcggatatttcatgtgaccgaggtctgagcatcagaatccatgcccatgccactgctctccccaggggcctgagtctgcatttactgtgaagcaatcttttatggaaaaaacttgcaaaaaatagaatgagtttgaaatagaaagtctgagaacacaaacctgtgcttttccatttaaatatggcacaaggagatcccaaagctgttggaccagtgattttcaaccctggatatgcccacgggtgtgggcgtgcaggcacacatacacacgcacacactccgtccacggagggtcagagtcacactcattgggcctgggtggggcccgggcatctattctctagtgtttcccatttaaaggtgttcatcagaatcacctggagagcttaaaaaagcaaaaagcaagccgggcacagtagctcatgcctctaatctcagcacttcgggaggccaggagctcaaggctgcagtgagctatgatcgcactgctgcactccagcctgggcgacagagcaagaccccatcttaaaaacaaaacgtgatgttggaggagccagactctaggctttgggaaggggctttcctggggagggcagatttgttgagaatccattttcccagcgagttcgtttccacccccttaagaacaaccactttagaagaacattaggcagaggaaaggggctcctacgtgtacctcctttccaggagatgtgggaacaggaggagtacttgccttttcatacatgaaatggttttttatttgcagattatcatttgaaagacattttggtagcctgatttccactcagaaatagatgtcaccaacacaggatgagagactcttataaagaattacgaacttctgttaaaatgagaaagtcaatgaagggaggcagcatacccagaaaaggggaaaattaaaatctgaaataatttatgaggaaaataattttccatctaagagtgtattagctgtttattcaaaacccttgatgggaatgtttgtaatcaggtcatattgtgatcttcccacagcctgtggtttctgtttttcccctcctggccttacagttaggggagttagggcaggttccctccagaggtgacacctgttgacaaccagtctttcatgacagcaagctgctgtccattctgatggcttcagcctctgtgcattctgatggcttcagccgctgtccattctgatggcttcagccgctgtccattctgatggcttcagtggacattgcagtgaccattaaagtaaagtggcttagagacataacacggcgacatttatgtaggggcagagaagacaaggctgttcctctccttgttctcacctttgcccagaaagtgttagaaacagcctcttccttagcctccttttctatacttctccctttagaagccatgcactgtggtgggtcagatctcaatactcgtgggtccgtgttgtcctagcggtaccatgttgtacttcagaagggccatgctggctgcagaatggaggctgttggagggcaggagcccaggcaggaggtggtcggtagagcagcattcccagagagagcctggtgggctctcagagttgggggctgcaggaatggaaaggagaagacatatctggaggctttcggaaagtagaatagataggaccgatggacaggttgattcgatgtggaggatgaaggagaaagaagagttttttttttttttataaatgagggacacttgtgctgaaggtatgtatttgggaatcatacagaaatagccattgaagacatgagagagtgtgagatccaggaatttggtgcaatgagagctaaggaccactggtggtcttaggagggacaaaggcagaatccccagaaagcaaacaggaccagagaagcgggaaagaaacttgagagactgttctcctaggagaacaaaaaagaacttgccttttgaaagagggagataaagtaggaaaaggactacagcatgtccattggcttgtgggatggaggggtctttgatgacatcagggaaatgatggagcagaagcggcggcagggctatgaacgatgagcaggagggagccacagcacagcaagtgtagacaccgcctaggagaggcccaactgtgatgctaaagggaggaacaggtctagaagttatcgattcgcttggaataataaatgatacagtggcgaactgttccagaaagaagttaccaacagtcgccgctcactaggaaaccctagagtagacgtacatttgatttaagttagtagcttacgggcctgatgcggtggctcacgactaatccccgcactgtaggaggccaaggcgagtggatcccttgaccccaggagttctataccagcctgggcaacatagtgaggccccatctgtacaacaaataaacagattagccaggcatggtggtgtgcacctgtggtcccagctactctggaggctgaggtagaaggatcacctgagcctagggaggttgaggctgcagtgaactgtgatctcgccactgcactccagtgtgagctgtgagagagcaagaccatgtctgaaaaaagaaaaattgtagcttatcatttagcaattcataaataattacctgtatttgtcaaacacttcgtacatgttaggcattgtaatttggctttatgttatgaatgcatttaattttcaccaagggacgattccttccagacagctctgagtttctgttttccttggttgttgctgagagcataagttatattcctgcctataggctcatccaggccgcatttcctcctgatttcctgtttcctcacccgtatcctgctgctctctctcttcccctgaagctctgggaagtcttccctacacgctcattagtgagttaaggaactttgatgtgtctccgtgtttagaagaaatcttgccgtcaccactccatgcagacgctgggatactaaggttttcacctgctgcttcctgcgggatgtcgctcatgtggaggagggcctctcgttggaagcccaggctcactccatggctgcccctctccccagcctgctggcgttgggcttcctccgctcctggtttcttagttctggagcacagactccgtgctctggagcaagagttcttcactgtggttctgtagatagaattcaggggtccgcgaatgtggctggggggaaattcattcgtatttccactgacttcgactgaaagttaacgtttccttcagatatgaatgtaggcaacgatccacagtggtgttttgttagcagaacctgtgactttgccaccctcaaaatcacagacatgttcacagcgcattgccgttgtcccagataattgaataggttgttttctctggtcaccgtttggcaatggaaggtactaggtctgccactgggtctcagtgcattaataaagcagtgtgcttattacccagccacaggcgttgcttatattttggtgactgtattttgatatgattggttcttttgtaatcctatgaatttaaacctaatactttgagaagggatcctttgggacgtgccaaaaaagacccacctgtagcaagcctccatgtggatttgagtttcttaccctatgaattctataaactgaagttttcatcccatgtgtcaggtttgttttttttgttttgttttgtttttttgagatggagtctcactctgtcacccaggcccgagtgcagtggcacggtcttggttcactgcaacctctgcctcccaggttcaagtgattcttctgcctcagcctcccgactagctgggattataggcatgtgccaccatgcccagctaattttgtatttttggtagagatggggtttcaccatgttaggcaggatggtcttgaactcctgacctcaggtgatcggcccgcctcggcctcccaaagtgctggagttacaggcgttagctgccgtgcccggcccgtgtgagatttgatgtgaagttgaggacacgggtcttcataatgaaacagaagtgctcattgtcctgttgccacccttgtcggtttttcaccctgcagccctttgagaccaaatctgcctgtgaagtcgctgttcatccctgcaggctccctgtacccccagctcccagaacccatcaccagccctccttcttagagagtggtcttcgggaggacctgagcttcggctgcggccttccagccccctgggtctcactgcttgctgcctcccctttctcacccacacaattctttccttccctccctctgtcccacgctgtgtccctttctcttcctttctttgagttcatttcagaattcctcctcggtgtctgcttattgcatggcacggtctggttgggccccactttcttcctggaaaggtattttctggggccagggagcaatgttaccatttccagaaaagcagtccagctcctcctgcacagcactctttctgctgtgggatgcctccgcctcccttcgttccccatttgcagcctctaggtgccctgtcttggccagcagcacttgccttctcttccccatcatctgtggtctttctgcacctgggctcccctccgccctgcatctgagatctctgttttaaggccagctctccctagatgtgtagccactgggatctttttcatctcatcagcctagctcccggcaggacctccccactggacttttccaagatgtcagtggacagcatagagctggggtgccagtggccaccatcgggagtcactgccacattttcttttccttttgtgtccacacttggcacagaatcttcttccaggcagcctcctgggccgccagtggtgtggagctggccgagaaaggagcctgcttcccagcatggcctcacattgtcatcagtgtcactcaggaccttgcccgctgccccagctcagagcttgaacctctccctcttggaatctggcaggagtccccaaaggaccacccaggctcagtcttggccccattgagtctgtcctccccactgctaatgaagtctttcctgctgaaagccttctgggccatccattgtctgcctgtgagagtcctcggcttgcccccacaggcctcccctgccggtctggagctcagctagtggctctcatctccactccctgtccatcttgaatgttctaaacaacgaattaaaatgtttaacttgaatgcaggagccaggcaggtacttgtcatgagtgggtttggagggggcaagggtctgggtgaacagggagggcagctcccacccacaggggcagccgtccctcacttgcgccctcctcagcctcagtggcctcgtgttcccggatggtcctggtgttgaaggaaagccaggaatttggatttgcatataaaattttatcatttttaaatgttggcaactgattccaaaaatctattatgcacttttgggggctgatgaaaatgcttctgcagactagaaatagtccccaagtcaccaagatggcatctctgcattaaacccaccccctgaccttcccacgaagctcctgcagcttggcacggcatttaaggctccccctgaccgatgtctgcctccctgtcccagcttctgtctcatccactcccaacacccaagtccctaggcatctgagtggcctcctctccgaacctgggcacacagtgttcttccatccatcactcatccacctggctggtcctgctggtccaagacatagcgttggtgctgtcgccccctcagaagtcttcctggctttcctctccctggcccgagggggtgcctcttttctgtgcctcatcccttcattcccaagatggccttctgtaagacaaacattgtagcacccatcacactgggtaatgataatttattacctttgccgcctcccccactagactctgatttttgtatgagcagcaattatagtttgctgttccttgtccccaggacctagtggggtcccggcccagcagtggggctccacatggctgaattgaacagtcaacaaggcagcctcctaacaagtcctgtgtcatcctgtttagccgttcgctcaaacagagaactgtagatggggctgaagcttagtcccaagagccacacatgtcaaggaaatctgggagcagcagcccagccatcccaggatctcacaaaggcccagcagcaagtacaggggagacagccagacccctgcacaggagtctagaggctgagtctgtaactaatccagctcagaccacatgtatggtgtgctcaggggacccccagagcaaaatccaacaccatgctggcttctgggagtgcagattttgcagacatggaagcagaaaatcatatgataccctgagttcctgagtcagcaaacggaatgggggaatgagcattgttcagccagctgggcgaaccctgggcttcctgaggacaccccattcttagctgtggggtcaccactatccaccgacagcccagccggtcgacagcagacctttccttccagttattcctttccttccagttattcctttcctgaccccccccccgatctgctttttaatttctcagtgtatgttttctggtataatctgcttgtctttgcctctcggtgacatccacggagtcacccaagtcaccagccgggactattcctgatgtcatctattaaccttctccagctgctccgagatggtcaccaagtccttcttccctttcttcctgagcatctgtcccgtcgtgccctccgaaggagtcatgcatgtggtttggggcctggatgtgtgtttgggcctcctcactggtttccaaccttcagtctgtagccctcagatatgccctccttcctgcacccccagagtggcccctccactcacccttcagctgcagccacagggttgaaatctttcccaggccctccagacctcctggatgaggcttaaattttaaaaatactaaattaaaaaaaaattttaatttcactatattctcaaacttctcaccattgcagttaccatattttactgagattgtatatttagatgtctttttctccataagtcattgagtttgaaagagacatccttgtaaatcatttactggactgttggaaatttcgatctaggactcagaagttacagaagattttaaagaaagtcatttgtaaattcttaccctgaggtttatagacccttgtgaaatgcaaaatggaatgtaagagtttgcatgtacatcttctcagaagaggttctatgggttatttatttattatttatttattgacagaatctcactctgtcacccaggctggagtgcagtggtgcgatgatctcagctgactgcgacctccacctccccagttcaagcgattattctgcctcagcctcctgagtagctgggattacaagcaggcaccgtgatgcctggctaatttttggttttttttttagtagagacggggttttaccattttggccaggctggtctcaaactcctgacctcaagtgatcatcccacctcagcctgtaaaagtactagtattacaggcgtgacccactgtgcccaacctatttatttattaaataattttttgttgttgtttttagagacaaagcccaggctggagtgcagtggcataatcacagctcactgcagcctctaactcctgggctcaagtgatcctctaaccccagcctccccagtagctaggactacaagcatactccaccatgcctggctttttttgtagagaacagggtctcactatgtgtcccaggctggtctggaactcctggtctcaagcagtcctcctgccttggcctcccaaagtgctgggatgacaggcatgagccactgcgcctggtctggttccacagttttgaagagggcctgtggcctccccctcttccccatcctaagaggttaagagctgtggattgcttgacatgtcccaggttcgacatgttgagcaaaatgctaggagggtggtgcagaggccaccgtggcagtcacacaggtagaccagcaagcactccaagactcagcgactttttgaatatagaggcttaaaggtagaacatctcatgagactttaggtttcgagaatgggtgcctgtaagaatggtggtttcattaacagaatagcaaactaaggaagaaaagatggtttggttcagaaaaaatactgctttagaaaggaaactgggactgaaaaacggccatctttttcatgtatggccattctggcttttgactctatcccaaaatacagaatgctctttctactcactgactcttgctttcaattttgtctaaaagaaaaatgattcacaatgaaaatgatgttgttacacagtgtacatactcaatattaaattcataagtaatgtgaaccacttcataaattatttaggttgaagttcattttgtatagaaaattacatctttgaaaagatatgacagggttaaaatgaatcaagtttatcgtaaaactgttctagccatagtaaattaatctgagtcattttatcaaataagaaacatttttaatattttgactattcatcactcaagcagtacagctggtgttactgaagagatcatttctatttcagtaccgtctgtagatcctgaaacgggcgcctttctgtgcttgtttgccacgacagtggctctcgtacacgacgcctaacgtgtatctcatgtgaaggtgcagcccaagccaagctccctggggctccgttttccgtttcttgaccaaggatggcagaatccccaggaagtgctcctgttcctggcttgtgttttacatgatggatcttaccaggcggccttggaagccacttctcacaccagggttataaagtcctatgttttcacagtctggttaatacaatgaggaagaattaaaacctttggcataacaaagcttttggtcagttctataagcaaatgccattcacagcctcctgagtgatacctttttctaggcactgcttggtttctgggtgccctagacagggagtatcccaccggttacactctctgtcactcgccatcatcctgaggatgctgtttccataagccatggctcatacagccgtccccactccaggttaaggtcccttgcctggctcctcacagtgccctgggcatggtcctatcttggcctagctttcactaaactgcatctgtccgtccacctattagagccacctgccagtgttgagcctctttagggattggcctgtgccctcatcactccacccacacccagcacagtacctgggatagagtccatgcaaggtaaatgaataaggaacaaggtcctactcagaggcaaatctcttctttctaacactgggagctattcagctgcctgtaccatatcagaacatgcttaagaaaaagagggaaataattattgtctcaacaaagatttgggtttagcaaaaactggaaataattcacagtgaaactaataatccattgattgtgatgtccatggtgagatcattactctcgagaataatactggtaatttagtttgctcggaaggtactattttcagagtacttttacattttccaaaccctgctgtgtgtgttgaaatgtaaatcacacagcacccagataaccagatgattttcctcgtccttttaacagaaagatcaggtgagaacacacagttgcaccttgatcatttagtgctttaacttttccccccagctagtaagtatttgaggagtttctctcatttgggctctgaatgcttttctgatagtggggaaggttttaggaattgtattcggggctgctttgttgttgctccttcctgcccatctcagtgttaagggttgtcagtatcccaagactgatttccctgtccgtccgtgtgctttggaggtatcctggccatgttgttccttaaagctctaagtagaaatgactttgttccttggcactatgttaaattggctggttaattctggtgttatttaccctgtaattcattagtttcaccccaccattggcagctgacaggctgtaatttcacgccttgcaataaaagatgtctcataatctgcttcatttagcagcaagagaatttaatgaaattaactgcagtcctaattatgccagtgaatactaaagaccgccatcaagttttctcagaaaaggacgaggtccaactcgtgaaggatttagaatataatttcctgggaaaagttgcaagtgtcttccttctattggccaacgagggccaattatgagtacacatattactataattaactggtttttttgtgaatgtctctccaagtattcattgttcgaaatcaaatgtaaaagtgatttctctatcggagtggtgtagatgatagaaacaagctaatgttaagttttcaggcagtgacctctcctgcagtggaggacaggtttgcaaaacatcacagtttgagagcaggttttcatgtgtgactctggagggtttctggagtgagcagaagcccgggcccccttatgcctgtacgctcagagctcagcctctgcagccacgacttctccatgctgcggggatgctaggcctggataagggttgccacctgctgggcatggagtgtccagcctcacccagcccctcgcctggcccttctcccttcctcatggccgctagggcaagccctcacttctccaggacagatggcctttccctgctccaccgtccactctgcttcccgcccctggaggggaggaagacgagcatggtctgggcgcccagtgctcctgtccccatctcacacatgtgtggaacaagccactcacaccctgacatgctcccctctccctctcaccacgactctttcttggtcctgcctttctcacttttccctctcagccttcttcatagcctcttcctcttccatggaggacagggcagaggaaaggtagggaggagcattgatgcctcctgagcaggtctggcctggcacctgcctttcccacccaccccacggtgtcctggccccagggctctgcagcccacagcacctcttaacagtgctgtggacaaattccggcaaaccgtgggttagtaaccggacgacgttagcaaacacagaggctgcagttgagccaaaggaatggagattctggaaggaagatgtgcgtgttccaactctgcagaaaagcagctgaagcagtgggaggtggtctgttatatctaaatgcaatggaaatctccatagccacaagtgactggcctctacctctcttccaatcttgctctactaatgcgtggcctttctgtagttctgaaaggagccatctcccctggggcagtgcctgatgtggtctccttggtccccttggtcctagcacctctgcattatgcaccctggcaggacatcagccggctggctctgccaccccgcattagtgtccatgcaccttggtggagaagtcgctctgagcagctctgatttcagaggcctcacttgggaaatgagggtgcggtgttgcttcttggtttcctaaggctgctggcaggtagggctttacaaagaagtactttaggacattttggaatgagctgttgtgtattctcacaaaaatagctgcttttgcaaaaagttttcctgtttctagtcacccttcgtctttatgccatcccatcattgggggtggtgacttcacacacatttgagatttgaaagcatgatgactgtacttcaaagttggggaattccatggcccaccccacaacccactcatgtcaagtgcattccagggagcaatgggtttccaggtccaagtccatctgggggattgtggtctgtggtgggcaggggctgactaacctgcccaaggggtttagcaagggaatggctgttccgggacctggcccagcatcctcccactgtacacagcctccctgcacaacctacagagggggctcccaggcaggctgttcatggggttggtgttcacaggactctcccacaggaagggcgctgagctgcaaaggatccaggagacctggtttctaggcacagcccagtgttagccttggacacagcagccagtgttaccaggacctctgagctcacagcctggcctagagtgcaaggagccagtggacctgagagggccctgtccaggctgtcagtgctgaatatagaccatcggtgcccacctggcgctcctgctgctcggtcggagctgggagggaaacgtggctccactacagacatggggtttgggctgggaggccatggaatggtgaagatgctaagcaaggccatctcctgggaagggcagaagcagcttggccccaggtgtccgcatgtcaccccctttccctaaacttcacccgtccaccaacgcaccatgtgccgcaggcgagtgatgggaaaatggccctcgtttcagagaattttttttttaaagcaaagtgtattgtgtgttcttgcagttacttgctaccaatgtcccttgggtatctccccccttggagtgtttgcagccggcgagcgccaggatgcccgcggcagcatactctaggcttatctccgtgtgtgtggccctgaacccagaacacccggaaatacaagtgcaagtgcaaggagcccatgaacagaaagaagaagaaggggacggggaagcgcctcttgactgctcgccataaaaataattgagctgaaattaaatctgggggctttggtagcctcctgttaggaaaagaaataaaacccagtgttttgatgcacacctcgcacgtctcatctgcagtacgccagaggtaattttggcgacaagcagtaaggaaacctgaagtatttctctcccagaccctcccagcttattaaaagaacttatagacatgaaaatacattaaagtgggcaaagcggagagagggtgaaagagattaacaacctccgctgaatagagcccattgatgaaacaggcctgtgagctgctgccgactctgaaacaaggtgccaggaactgaaaagaaggtcaggcctgtccagaatttaggggggaaatggaaatgtatatttaaaactaatatatgcctgagtgctcatttttcccccgtttctgattgggaagatttactcgggaagaggaaaaacggttctgtagccgattacccaatttgagcacccaaattaaaagattcacttaaaatgcagcagagacaagcgaggcagcggagaagggcccgggcgtgcataatgcctattgtctgcgtctgcgtttgctttttaatgccagcgcccagcgagggagcagggccctcctagcgtgcgcggagggggcttggggtggaaaggggggggaaccccgaaacaggccgccttttgacaggcgcctgacaggtatgggtgcctttggagatctttttaggaaattgggtgtttgcgagtacaaattgaagcaagcatgctgtgtgtgtatgtgtgcgagagaaagttagccgtcagtcaagttttatctcttaatgaatagagactgctgaagtaagggttaggtaattgagtttataattaattagccataaccctcatcagataaagcagttgtgaagaattttttttatctcctttctctccccagggcctgcccttctttgtccttgcactgacagccagcacttatctcaggcctgctggagcccgtgcccgtcagtcctccccctggccagggccgaggggtggtcagaccagcccgcattgtgctgaaggcccacaatcagcccagctgtccggggccatgatgaattagcggtgggagttaacatagaggtgaactccagatcggccgatagcttgcaggccgctgctgtttgtcctgacttcagcgcatctctgatagacctttgacaccttccaacaaagaggttacaggagggagagctggagaaatggagcgctcctccagaaagttcggcaactcacaaaagaccccttaatttctatagcgggcaattcagtccacaaaggaaggaaatcaatgagcgtttacgctctttctttgaggaacctttttttaaagaaaaaaacatttactggcgctttgcatgttttgggtacaagcagtggtagaaacataaaacattaaaatccaagattgagcggatctgtcttgactgcgttttatagactggatgagagaaaaacggggtaaaatggctccccctactctgcttcaagatttgaaatatctgactcaggcaggttgagtgaggaattgttttaggaacagggaatgttgtgactttcttagtactgagttggaaataatgtcaacttccttgtgattttagttgttcctttctaattaacccccaggcaggtacagataaatctctcaataccctagggatgcggcagataggaagatgtgagcctttcttttcctcttctacagtcagtgttttataatagatagattaaatggaagttttgtttcttctttgttagcaagactagataccacttttccagaccaccctatggtaattatttggggacttaaggccagaatgttttatcagacaatatgactgaacagtgattttggatgttaatgaaaatttaatcagatgaatatattattcagcctcatttagggagtaaagtatgataagtgcatctacaagtgctgaaatttgtagaacaaatgaggtcatttttgtgaagtaggctgagaacagactggtgtgtgtggatgggggaaaggatggtcgctagcttgttttggttttaagtgtaggctataccttgaattaacttgggaagtactgttactagcgacagtccctagtcattcattgcagacttgttgtcagcctcccatgtggagatactagatgccataattgagccatacctaacaattccaagtttttaatgaagcaaatatggtaaatatgtccgttccaggctttctttgagtgtagaaaaaggaagttgatgcgtaggctcatgggatgaccccgccttatatgactggataaaatccaaatactcagctagagagagtggagccgctgtgttgagacaggcactccccctcagcctccccttgtcttcccgggctcgtggggtcacctccagcaaacccaatttgaaaaccggtgatcaagtgttgacaactcctgtcacagctgagaaacttaggccttgttcaaggtcacatggagaaagaatattgcatggagtagaccccgctcctcccccgcatccaactgaacgtgggctgtggtcctgttggctccctatgggcctgctctccttccctctttttctccccgatagatgggacctgtgaggcctgtctctagctcagcttggcatgagatgggccactcctgccagctcacctccctgctggctatttgcccttcatcacagaggtgggggaggatggctgcctcattccagcctcagctgctattgtggctacaaaggcaaagccagctctacagcaggcccatttcagcgcattataggaaaccagaggctttaaacccagaccagcttggagcctggggctgccgcgtccgcttaccagtggtggacttggggatgtttcttactctccgagcttgacttgctttatctgttaagtggcagttgctgatggcagtgaattgtggagtgataggtactgtcatggcacgagctcaaaagtggctgtttcccctggtttcgcttgtttattattagtattattttcatagaggagttaatggagcaaatgagaaacaattctttattcattcttagttttggagtctgcatcctgtacagtgtcctcagaagtgtagatcgtttctgctgcaggagcccaggacgtttggtcagctctgacttcgtcacgtagactttgtgagagggagggtgcttcagaggagggcccgccatgaggtctgcctccttgtatttgttacttctgaaatcttaatgccagttattttaaactagggtgactaatggacccttatttcgtgaaggaacagaaaagtagaaaaggtttaaaggcaaaaaaagctgaaggtatttgtctgtgatgttcaacaaaccagcctcatcaggccccaggtggaaaatcggcgtggtgacgcatgtgctgccatcccttggggtggcgcacggaaatggaagcgtgaggtcatccctgtgatcagtaacaaaagtctacctggaaaatggttactttgattttccagggagtgagtagtgtgacaggcatgtcaaaattaatcatcagtagatttattcaaagctaaaagtcaactgaaattctaagctctctttgctatactacatttaaagataattgctaaagtttctttagatgtccttattcattcagttacagatttatcatttttcaaaccaaattctaaactgtgttacgttcagtatgtttttgaagtcataaaagttgagttatagtaaatttaaaatcgagcaatttctgctttaaatatagggtatcattctttcctttagattcgttgccctgaacttttgattttgatattataaatacacagctactcatctcattctcttatctccactgtgctgggaagaccgagaggctgagcagcagctccactgaattcaagtcagaggatatttgtttgaattggagactgggtgttggtaaatgggtgacagtgacaagtgggtgattggggacacgtccttgaggctcatgccttagaggaaatgccttgtttaccctatgaggtctctagatgcacggaggctactgcattcccagggggtcagccttgtctcagaagtactgagaatattattattatcattattattattattttcttttgagatggagtctcgctctgtcacccaggctggagtgcaatggcatgatctcggctcactgcaacttctgcctcctgggttcaagtgattctcctacctcggcctctcgagtagctggaactgcaagcatctaccaccacacctggctaatttttgtatttttagtagaggcggggtttcatcatattggccaggctggtcctgaactcctgaccttgtgagccactcgcctcggcctcccaaattgctgggattacaggcgtgagccaccgcacccggccgagaatatttttaaatgttcatctcaagttagcatcactgaagctatagcttcctctctttagtttgttcttgtacccagtgattcacccagaattgtttgggttttccatataagaaaatgtgattcgcttggtgtcagtaaggaagggattctctgactcatagaagcaggggtgtcaccccaaacagcaccatgaggaggatagcctgagtccgatccctctgggttggggctgccatcaggatctgtacattctcatgacctgtgtgcttaaacttgggcccttgaggttcctgtcctttccacatctaagccagcagtagactcaaaccgaaggtccgttaatgtcctcatcagtcgtgagcagctctgtgtggaccatctgcctgtccagtactgaaccagttcctgtgactggggctcattgccttggcctaggccacatgttgacccagagtacacaggccaggatgggaaagggtcacctgcccatgcagagtcacaggtcctggccatgagcacaggagttggatgtaggacaaccaccataaatgtcccttgcccaagttgtcatgaaatttcaaaacttcagccagtgttccctgcttgacactcagacctgaaggcctcctgcaagtgccagccactgtcgtgagctcaggtgtctgagagcacgcttggttcccacgctgcggtccggttggacgtggtagatgtgagaccagtgcctgaaagaatgccgctgtagggaaacatgaagacacacacactcagccacactgtatttaatgggccgggatttgtgtaagtgatctccatggagacgcaggtggtgagcctgagatgctacactttagagcaggagtcatccactcccagatggcagcctggtaccagtctgtggcctgttaggaaccgggccacacagcaagaggtgagcggcgagtgagtgagcattactgcctgagcgctgcctcccgtcagatcagcggaggcattagattctcacagaagtgcgaaccctattgagaacggcacatgcaagggatctaggacgcacactccttatgagaatctagtgcccgatgatctaaggtggaacagtttcaccctgaaaaccatccctcctccctatccgtggaaaaattgtcttccaggaaactggtccctggtgccaaaaaggttgggggccgctgtcgtagatcctttgacgagcgtccccaaggagacctcagacacaggttcctgccttgcagggtcctgaccccgaccctcccgttgctcacagtgtgtgtgcatgtccgttgagcagcttcccaccctgattgcagctgttcctttttaaacagaacctgcagaagtggatacaccaagaacatggatgcattgcatgtcacatgtatacattgtctgtttctccacatatacaccataacagaaatgacacagaagagcacctcctcggtttgccaactagcttttgtatagcagcaaattcaaagtcaactagtgatgaggaaagactggaagcagctaataataagcattcttatgtaactgatttgcaagaatgtagtacagtcgtcatttgggaattgactgggtataaagagttttccagtaaaagcgctggaagaaccagagcctgcagaagcaggcctatcgccctgtgccatgttttttgccacactgtctgcccatgttgggagtgtgaggcttatacccagggctgcttcctgggtgatcttgggggattttcatttttctggtacaggactggagagtttatgagatacaccatgacggtacagcatttaatttagtatcaccacttcgggagaatgtgtatcttaattgctaaaatctctaactttgtataaattcaaattgaacataatccagactatatagcaatctttaatgaattccatcatcaacattaccacataaaggaagttaagttgggcgtataaaatcgtaattcagtaaatttttctttagttagtaagcagattagtattcattgctaagatgcattttatcaacggttttggtagcgttagttaaaaaatgtaagaataatgctatagaacatgaacataacatttttagagaagtatatttatcaaactttttagttgcacagtttctaagggctgcttactgattaaaaacatttttacttataaaaatgtcagcctgttttatttaagataagacattgagctttcaagttggcaaattgatgggcagaacgtatatatcctgtttgtacatgtttgagtttaagatgcagtaggttagggggaaaatgttttaaaaccatacagaatttaggaaacagaccttttaactaataactgttactgagagatgataaaaaaaaatatgaactagttcacaatgaattatattttgtatgcatgattgtctgtgattattaattgatgtgtacttcctctttgtcaaaagttataatgtatccgtctaccatgaaaggtccctagaacatgaaaggtggtttctctacatgcctgtgaaattgatgagcagggagaggcttactcatattttaatgccagcagtaacagtgctcacacccagagatcaggggcatcaaagttggtggtagcaaggagtatttgccactgtaattgacaaataatacccctcataaatactgccagtcttttcaattagttttcatctaaaattctggctacaaaatgatggcctgtcaactgacaatgaatggcaaaaattaataaattgtcttctaaatagaatggacacttaagaaaaattgggcagccaatttagcacagcatgaagcaaggggaaccctttgtactggtgccgggcactaatgttgtctcgatctttattaatggtgctcggcggctgctgacagttttgttgctactggcaactttcttcattaaaattaaagccagcatcaaattccattagccgtactctgggcaccttgcattttttttttaatacatattgtttcttttgttaactccctctccacccataagaagttgtcagagaagttaaatggaaggaattgtttgctaaggccagagaaccattcactgttgttgtggggaaatggccattactggcccggtgagaacccccatcctgaaatctgcaactctccccccacaacctccccccccccccccgccttttgttccatcccctttcaaaatgggagcatattacctctaaaaacgacacactattttggatctgcagctttcagataggaacgactaattggtatgaggccttctagtttcttattttttctgagcagttttttttttttttaaagttcctgcttcccttttctaactgtatttccatagctgactataccttaacacaatagtaactcaatgctcagagagactcgcatttgtccggaaggccttagagttattttcccgaaggcattacttttatctgtagaacaaatttcaacctttgaaggaaaaaatcgagctttgctgaataagttctgaactattgtctgaaaagccgttgcctgcccttcacagcactgtgtacagttcaaaaggctctgaaatgcctccgccctggagctgctcctctttcgccagcaagaggcaacaaacagctctgattctaggacaactcagttcttggctgtgcgcagcgccttccaccagcaagcagaggttgtatggccactgcgaatgtctcttgtaaaggaactaggctgggatcaccatccccatgggttaccttcccctcccagcccagtctcataattgctttcttctgtcctcagtaatgctaagtttaggggctaaaccttcatctcagtttgttttcttcttctcctcctcctcctccttttaacttgtatcttacactgaaagaaacacaaatactcattaaaacagtgaaaagatagttgtcaagcaacaaaggaaagggcataccagaaaacatacactgagaaataaaaaatataactttatctctgagcatcctagcactcaaggcaaaaaggaagataataatgctgagctctgctggaagtcattacgtaagtgcgttcggtatttcctttaactgttctaacttgaaaccataattataattaccttttttttttgcctcaaggagatggcttatggattgaatatgaggattacctttttctaactgcgcagctttctagtcaccactgtctccccataccttccagtctcacatcacagatacgtattttattaatggtatctaggatagtgttaacaggagtctaacaaatccagtattgtccttgtgaatcttattctcatttgtggaatttctcaaaaatacagcaactgactgagattccaaacagctcacaattaaagacagtacaatgttttgctttacagagaagtggcagtagtacagattctgtttttttgtaataaatgtttctgacattttaatagtgaagtaaattaatcaaataattgcaggaagattctgctattcagccgttcttttttgagtaatcttaaataattaaaggaagaacaacatgccaaatgatggttcaattagcatgtataaaaataaatatttaccaagactgcattatttgccaaaacggagatgtgcaattatttaatattgttgatggggcccataaaacaaatagtaccaaatctctccctgtgtacggccgtcagcctccaagggctgttctcccactgcagacacccctcctcttaccaccacaatatctgaaccaggcaaggagacaattgttacttgatgactgagcccactaatatgttacaggaaatggggcatgaaatgcaatactttatatatagtatgtactgtgtgagtcttccattgaaacaaggccatttttagcttgctgatacaatatttgcagtggttcatcattcgattgtcctgattaacaatcaacttctataggggaccatttgagtagtttttttaaatgtgatgaatcagaggatttgttcaacatcacttcatcctcttctttaaatggtaattggcacttgggaacttgggagtgaaataaggtgtggtctgttctatgtggtcatttccagaagtgccgttttgaccactgctgtgcctttcatccagatttttgcaactggtaaaggtgtcacaggcaccattgaaatctactccctcatcagggaacacactcttgttgatagcaacagcatgcaatctctgttacagcctctaagttggaacagagaaggctttcgtagaggacatttggtggaaatgaaacacatccaagctgtcccacgttaactgtcacctctgtcacccacatgcactacctatgtttagcagggcagcctctgcctgtgatttgcagggagcgcatgctgacagctctcttccctctccttagttccaggaaggtccaggcagttgaactgactgcttgtctgtagaaagacccactgtgtccctgggggactggtaggtaccctgattcctgcttatcaggggattgattctgggcatgacccttcaccttctctgtgcatatctgtatcttacctccatctggtcactagttccagtaacttggcatttccttaaatgaaacattaacatctgtagaaaagatctctctgacatgttagatgtaacatgagttaaaaagtcccatttgggaggaagagaaccattggggaccctgccccgtggggttcctgagtgtcctgggcacctttgcttgagctcattcttttcgtcagagatcaaaaccaggagtgcctccttcagcttgtactaccggatggcttagcacctggcgagtgagtgtctcagaaaggaaactgcaggagtgcattagaccactcaggggccctgctgtcctgggtgttcatccatggctccattcatccatggctccgtgcacgtgcagcccgggaccatgactctgattcgatgcactttgttttccagaagcacagtttgtcttctaacttctaatcagttcgggatggtattcaaatttccaagaaattaaattatttgtagtaaggagttattgccagtagcagtggtagcggtccttgtcatcgtcatcaaagtggcggtggtagtaatagcagtataaggaaatatttgtgctgctcgtaatgaaacgtgcacatggaatgtttctggagatcagggccagatgtagggtgcattttccatgcccgttctcatccgtagcagagactgcgtggagtgctgtgttgagaaggcttcggaggctcaggtgttgcagatgccatctgccatcaccatggggtagggcagtgcaaactgcaaactgtcccaggtaccttttagccattcttggtttaagtctttaagactaaaattgacacatggctgtttgtctgcataaacctttttctttctttaatcaggaggaaagtgagtaatccttttcatttctccagtagaacctctagtccatgtctgaattgccttcacagaccatatgcacctttgaacttccgtaatagatgtcaggatcctgagggcagccctgggttgttctttatgcctcttcacatccagggtggtgctgtccactcaccgtgcgtgcattgagactgtttgggttgctttgctctctggtgagatctctgtgtgcatgctttttctaatctcctctgctctgtgtagggcagggcatatgtatgtagttatcataatgggatttggagcccacagacaatgtggcttcccctttactgctcactggttatattaccttgcccaattacttaacctccatgaaactttttaccattcatgagatttgttagaatcattcagtaattcattcatcaaatactttttgaacatttgatatttgccaggttatgggcaagacgggagtggtccctactgtccataagctcatgatgtagcaactaaggagccagatggcaggggcatcccacgtggtctgggaagccctgtcaaatggaaacacagtgccaaccacaatgtgatttccattttgcaggggcaggtacatgagaaaaagtaagaagaaataagtgaatctgaagtttattttaatatgctttatttaacctagtatatccagtgtttgatcattttagcatataatcaatacaagaagttaccttgcgccctacagaaccttcaaaatctggtgtgtagttcacctatatagcacctctcggctgggactggcctcccgtcgagtcctcagttggcacatgtggctgagggtggccctgtgggatggtacaggtacagcctcctctttgagctagggatgatttcagctgaccaggggacagacgctggctggggttagggaggcagtgtgaggtgggcctcctgggcccgaggtcatcgaaggccccggtggggagagcacatggctaactacgggtcgctggccaatgcaaggcagcagcatgggagaaagccctggtgtgaggcgggacacctggtttgcaggctgaggatgtgccacctgtgggacaccaggtagtgatgtctgcagctgtggatgagaccttctaggggaagagttaactcggaaagaaaggaactctgagcattgaagagtcaggtggatgaaaagttgccaggaatggaaaagagaaactagagggaacaagggaagtgtgtcattcaggaactttctgtatttaaaagtgtgtgttggagagaaaggacaaatcttttatgcggaggacttgtaaatattttccatagatataaaagtcgacttcatagcttgcctggtgtgctcggttttgactctatagatctgacttgaatgcgcaagcgggccgttcccacgtgatttaataaacagttgctgtagcatgtgtaatctttgcagtgacaacaatttagggatcattcgctagaataaagcaggagcagcaggttctgattgttcctttttcaggaattcctccctgccatatccatgtgccactgtgtagtcccgtgaactctgcattttcgcagaatgcccccatcatgtgaaggggttcggctcactctgtggccggcctggaggcctgggtgtgcttcctaggcaggcagttggattctgtttaattttctttagctatgggagaaatggagtccatttccagaccatggtaagtgcccgttggttttgtttgcggttctggcctccagggcggtctgggtgggaggaggaggtgggcggccggaaggtggttgagcgtttccgctccactgcgcggccccggagcccccaaacgcaggtcagcatggaggggcagcctgcagaggtgtcaccagcagccattaagtgcagatactgtcgtccctggtgtcgtccctgaaaatcttgtgacagggagagacagagtgaaaggaaagaaaaacgaggcgatcaagagataatattaactagaaaaatcaagaggggatctgtcagtcctggtgggaaaaaaaaacattttgtttttcttagtttccttttccttttcttttctttcctttggatggaggaggtttggtttggtcttagtaccccagcatacagtagcttcattggctttttttctgcccatattcaaaattcctttgattagcatttggttctggttgggacttaataatgctagccagacctaatgtgaaccatacatctcgtcggcattactcatcgtcaacatgggtttttaaaagggaaggagagaaacacaacaaactttttatttctttccctgtcattgttcttggtcttgttattcagtggacgctgtattaaattggattctgtgtccatcattattaaaatgtgaagtgtgtcggtcacaaagcatacatttcggggcagttagctgaataattcttttctttattatcccaaattactgctgagctctggagaggggagcagtttagccaattattgccatttgagctggatttgtgggtgattagctcctggccgaatccagtcccggccggcgctttgaagcctgtgctgtgcgattttctcagcagtgaggtaggaatagacgcggctaatgacaggaaggtcgcgcgggtgagctgacctgtgtgtggcgcagccttgggttccgcaaatagggcacccacagtaacacgtgtggcgccgaccccgccgtgcgcaatcggggctttatacgattgctggagatgctgacagctcaattaaagtgtaaccctttgtgccctgcaacctggcacaacgacagaaatattactcgccggaaaggggagggggtctttggggagctggttaaagatccagaatcggcccctcgcccctttgcccctcccccaactccctccactgtacagaaggagctgcagaaaagcctccatttgtaaaataataggtgctctggaggaggggcagggcgggaaatattactattttaaaaagctcagttaaggggggattcctgctgttcctatggaaacactttaaactagagagaaagttaaaaagatttagtagcggcagagcttgtgtctgctggtcacattttctagtcatctccttttaccaaaatttacctcccagcatcgtggatgtgaatttgccagaagttttccgtttgtggaggactggggaaagccagttaattgggatgtgtttttgcacacaacgaatgatttctatgttatcgatttacttctttcacttaacggcattttctgcagcttgaatgaaagctgtctcgatccatgtatgtctgtgtatctgcggtctggtcatttttgccacacttgatttttttctgctaaaccctacgtcttgcagtatatgggtcactcatccagatttacttgatgctgttttagttaggcagcagcatgcgatgccctgtgcgcatctttatttttggttttagatttttggtggactgctttgatgttttattttctgagactaggagtatctataacttggtgtggttattcttgcaggttgagccgggtgctagctactgatgtgggaatctgggagcccgagccgactcagacagtcctgactccccagaattcccaccgagggagacaatccgtgtgtgtgatcggggtgttctggacttgaggtacctggtagatactcgggggagtgtgtccagtacggaatgggaattgagactccagcaagtggggaagagacagcggaagtccccagtgtgacaccagggcctgtggggcgtatttggtgagactggtgaggtcagcattggaccacctcccatgctgggtgccatcagtgtgctggagggggaagggggagacagcatttctctgtcctagagcagtgcacagcctgttcatgcacctgtgtgtgtgagtcagctcaaactgccataacagaagaccacagactttgtcttaaacagcaaacatttattgtctcccaattctggaggctggaagtcttggatcaaggcctcagtgggattggcttctcctgaagcctctctccttggcttgcagacagccatcttctccctgtgtcttcacgtggtctttctccgtgagtgtctgtgtcctgatcttttctaataaggacaacagtcatattggattagggcccatcctaacagccttattttaacataatttgctctgtaaaggccctgactccaaatagagtcacatcgtgagtgctgggcgttaggatctcaatatctgaattagggagtggagcacaatgcagcccataatagtcatcgtctaagggatgggcgtcggggggtgcttgcttatgcggagcctgtgaccctgcagctcagcatgggaggctaaaggggcgctcaccaggatggccagaggaaggggcaggatgcaagaaggacatttcaggggaaaagaattgaatttgccaatttacattaaagtttctggcctctgattgggtctgcatggtttcctgtcctgtagcagtcttctataaaaggctggagaggaggtatgttaggcttcatgggtcgtgtggtttctcctgaactacctacctctcccagttcagggcaaatgcagccattccaaccaatgaacttgactgtgttccgataaaactttatttacagaaagaggcagaggatcagatttggccgacatgtgggagcttgccggccccagtcccgtaggatccccaacgctaatagtctggatgagggtgcacaggctgtgagagttcctgttaggcgggaaggctctggcccctcgggatcatacaccttatgctggtgctgcagtgtgtgtgtgtgtgtgtgtgtgtgtgtgtgtgtgtgtgcaagtgagggagggtgacccccacaccaagcacacagggccatggattttcactgtcttgggtccaggcctatttctagctaagtgttatctgcagggtatagcttagcataatgagagggcaaaagcaagatgactaagtgttcgttacggaaaagtgggatgtcaggggagcctcagcaggggcatcacctggatgtaccattttccgcatggagctggtgccgtgggggaagaataggtcacagcttgtatgacccgtgtgcttctccagtttccaatgatgacattccatccacccaccacccacccagatgcgcttctctagttttattgaggtcagtttggttcctgtcagccacagttttaatacatgtttatagggggaaaaatcttaattagaataattagaataaaattattaaatgcaaatgtgtgattggtactcacactctttggatctcagttaaaggtgccagcttttctttgacctattttagaacttcatagaaacctttaacaagaacctgttccaaagtgtaatgaatgcaaatcataagacactaaatgagctattaacaatattcactgtaaaaccaccgaagtactcaaacatcactttttttttttttagaagtagaaacatttttgaacttgcatggatgtttttaagccagaaaaaactttttttaaaaaacttggtaattaggaaactattagtgctcctgcagcagcaagaggattcatttgatctcattgcgaaatcacacgtgcaccgtcctttacattcagtcagatgcatgcacggcccccggtgtctgttaaagccgatgaggaatgctgcccgcagagcaaaggcgagtggttgtggacgtgcctgttgataatctgatcttgacatggcgccgcctgcgttgagactgttgctccatcaccccgtaggagcttagccatgaaatgttccctctgtgtaacgatgatccctgtgcgagcagaggccggcaccatttggtccctgagactcaaaacaaagactgatttgcctggttaagacccccagtctctaatgcagtcaataaatctttgttggtaaataattgctatcgagcagagttttaatataaatttatgagtggtgttttatcacagcttggggctgcagcaaacactgagtgatgggtttcagatagcacttacattcatgacattaactttgtaagttatttaaagcttgtacacttaacattgcttttggctttcaatgacctcttgggactagacaaagaatacacatgacgaataaagggattgcagccaaaagacaattctactctttgctccactgtagaaaaggttccttgggcttaaagcaagatgtgcctgcctggaatcctgatattttggttataggtcattaaaatcagtctttctgatatgtcagtaaattaggtggtaggaattagatcaacatttgccatttccaagtaacataagaagaataatttgaggtgtcacaaaacatttgaaatttcttgctttacaaacaagttaaaatttgtctggtgggtgaaatggtttgcagggaggcagcatagcagcggggtaacaagtataaacccttggtttgtacctcgaatcttgcgcctgtttcttccccttactgccgtttgggttatctattgctgggtaatgagcccaaattatagtggcttaaaacagtaccattttggccaggtatggtggctcacgcctgtaatcccagcactttggaaggccgaggcaggtggatcacaaggtcaggagattgagaccatcctgaccaacatggtgaaactccatctctactaaaaaaaaaaaaaaaaaaaaaaaaaaaaaaattagccgggcgtgacggcaggtgcctgtaatcccagctactcaggaggctgaggcaggagaatcacttgaacccaggaggtggaggttgcagtgagccaagatcgcgccactgcactccagcctgagcgacagagcgagactccgtctcaaaaataaaaaataaaagtgccaccttattgtttatcatgattctgtgggtcaggagtttgggcagggcatattggggacagtttgtccatgctccacaagatactttcttagggctacagcgtccaagatcatttctttactgatgtatctgatgcctcagcaaaagtggcacagctggctggaggctgacgtgaaaaggtcactggcagtcatctatctgagacctcagttcttcctcaaatagtctcagggtgtctcctctttacttggtctccccagtaggatagtctgacctcttaacaaggctgcgcaggcttcccaggggtgtaaagcaggagtttccaggcctccttcaggctttggccaggagtggcacagcataatttccaccacattctgttggttcaattgagtcagaggacagagtgatcacacaggatatgagcaccacgggggatgagggggctggtttttgtgtgccatcttcggacactagctacttcactctaccctccttcctgcaaagtacccacagcctgtccccagctacccaaagtctcaagccattatggcatccagcccaggcttgaagttcatggccttgtcgtctacaccaggtacacgtggatgaggttccttgcatgtggtcctccccatcggaagaccacgatacgcaggggacaagttatctcacacaccatgcagtggtgactcaggaacaggagaactgcagcagatacccttattctaaaaaggtggagaggctgtaatcccagcactttgggaggctgaggcaggtggatcacctcaggtcaggagttcaagaccagcctagccaacatggcgaaaccctgtctctactaaaaatacaaaattagccaggcatggtggcacatgtgtgtaatcccatctacttcggaggctgaggcaggagaatcacttgaacctgagaggtggaggttgtggtgagctgaggttgcaccattgcactccagcctgggcaacaagagtgaaactccatctggaaaaaaaaaaaaatgatggagagggacaagagacatggaatagtcactgggccataacaattctgaaatccagccagcacatgatgctgattcaccctgctctgggcataagaactgtatattctccccaggaggcatcctccttggcccttggctctgccctctgcctttcccataagaactgacccatgtttgctactatgcagctttctcagcctgcttcctgctgtacttaaagttgagggcccagagaccacttttctttctgaactttctctgtgcattttaatccaagatggtataattcctttaaaaatcttgtgggtatcctttgtgtcaaatcataatctgttccattaaacaaaagctaatgcacagatttctctctctaatccatggatctctaatcagaagggtctgtgaggcattgccttaaaatatttgagttctcaaggaaagggtctgactgccacaccattgaaggggtcctcattctgagatcacagctactggcatccccaggatttgatcttagttctgatgccagttcttactcaagggttttctgctgtcaggagaagctgggaatgagaaactgttttgtgatcagtccagcaaggtttacagttgaaatattttttctaattgtgctggaaaattccctggacctcctctctctcctcccgtatttaacagagccaggagcacttccagcatctggcatggcaatctggtagctaggtgtgcaggctcacgaggcactcttgctatgctacccatccccctgcgtggggtggccgggagggggcaggttgctaattgccctgctggtacctgttctgccggccccatttccatcctaaggtagcattttcctcactgtcctcacaacttccactcatgcttcttacatctctgccagcctcagccaactgcctagttccaaagccactgccatgtgtttttgatttttgttacagcagtacaggatgctaattctgtttttcttacctgttgctgcataaggatccaccctgaaacttcagggtttaagaaaatgatcatttgactgtttcttataacactgtggctgagacctgtggacagagcccagcagggctgacttatctgtcagagcttcccaaggcaccaggtgctgctaggctttctcgagaattaaacccaatggagatagtgttattcccactgatgctgttagctaaagtgagtctcgggcagcccagggtcagtgtgggaggatttatttatacagggacaccagtgccacgaagtgtggttcaatgggagccgtctttggagaacagataccacgctggctgtgcatgttgggcaagttacataagcagtctgtttcagtgtccttatccatgaaatgagaatcgtcgtggatatcagttgtgattgcagttgatgaaatatgcagttgtgaatactgagagattggtattcatactctttggaacccagttaaaggtgtcatatcaattcctgtccatgaaatgaggataatcaatgaccatctggttgtcatgcactttcagtgggttaacagttgcaaggcacttagagcagcagcatctggttcagagtgagcccaatattgcatagaaataaaaaaaaaaagttctaaataaatgccgaagccacataggagtcaaagaaagcgttaactgtaattgatgtcttcactgtgacagctggacagcaagaaagaatcttaagcagagatggttttcacatgtacaaaagtggcatctgaaagatggacaaagtatgcatggtgacatgccaccatgccgctggccctgggttatgcagaatcaaaaagacttaggatcacaggggccattggcactcactgacaggaactctcttcctgagcatctcaggcagagccttccggcctctgtcatcttctggccagtaggatcacggcttcatgtcctctaaaagtttcaaatgaactatttttagggttttccattttcttggtccttagagtaggaagtgtgaaagttcggactgattgaacatagaggaggctgtctgcgcgctcagcccagaccagtgggggccaccttagtaccacttcctccctaaggaaagcgacgggccccctgtcttccccgattggtttccatttagctgctgcacatgggggatgctgagtgtgttcagaggggcgtcccatggtcgaactggaacttgctttgggaagagtgtggactaagaaggggcttggcttgtgttgccacatgtgagaagacctctcaatggggcttttgtggtggctccacggtccctgaaagtccccactggctcagtgcagctctggaattaggaaccagccgtgccccaggagggcagaggaccctggctctttccaagggagatcatccaggcagctctcactgctgagacctatggacccctgtccccagggtgcttatgcagagactgcgggaccccaggtggggatcatgcaaaacatttttgtagcagattcagggctgaatggtttaacttctggggtcgctctagactgaaattctctgattcccacttggtacaaacactcttcaaaaatcagtgttcagaattaatttaagccaagaaagaaaaagcatgtttttaatccacaaaagctatttcccgagtctgctcatttgtagtccaattgaacctctgattatgactgctcctctggcctcctgcttctgaagccccagccaacgtcttcactcatcagagagcttctgtctcatcgtacttttgaggaacagccttttaaaattatttaaggagagacaatagagagttttgtagtttttcctattgttttggcaaacttttttttttttaaaggtttacatgtataaatgcagacatggactctctgacgtcaaagatctgtgggcattaaatccacagctggggagtccgggctttcccaggattggggcccttcaaggaagagcaagcctgtgtaataatttggaggcctaagttacccgactgtgggaaggccagtgccgctgtccagtccatgtggaaggaccttgatgtcagtccagaaccacattttcgttttgtttttgagacgaggtcttactttgtcacccagactggagtgcagtggcacaatcacgactcactgcagcctcgacctcctgagctcaggcagttctctcacctcagcttcccgggtagctgggactacaggtgcacacccccacacccggctaatttgtgtatttttttgtagagacggggtttcaacttgttgcccaggctggtctcaaactcctggactcacacagtcccctcgcctccatctcccaaagtgctggggtcacaggcgtgagccatcacgcccagcccagaaccgcattctgttttttgttttgttttgtttttgtttttgttttgagacagggtcttgctctgtcgccaggctggagtgcagtggcgtgatctcagctcactgcaacctctccctccaaccaattgccctacctcagcctcccaagtagctaggtctacaggcgcacaccaccatgcccagctaattttttgcattttactagagacggggtttcaccatgtttaccgggatggtctcgatctcctgaccttgtgatctgccggcctcggcctcccaaagtgctggggttacagatgtaagccactgtgcccggcccagaaccacattcttgagctgagctcccgagggtacctggtgatgtagaaggaagttggcttaactgggggcgctgcagcagcttctcagacatggctgccctcatgcctccttggggccagggctgtggttatagttgctgtccatcactctaggtgctttcacctaggcagagcaaccgaagtgcactttgcagggagctaagaggctcggctgctaacagcagacgggtttgggtgggactggagtgagctcaagattctgtgcaggcctcacttggatcagctgctcctgtccttaggggtcaggacaggacttcgtcatgtttctggctttgccttcatctattctggaaatttcaagagaacctggacatgtgaatgtgaaagagaaggcactcatgtatagaactcattacaaagatagcattactcctagaaccaagataccatgagtgtgtgtgtgcatgtgtgtgtgcgtgtgctcttgcacacgctcatggatcaaggcagaggatgagtttaaaaactggtactaaaataccctcttatcagagaaattgtcaatatcatggccccacatttccattagataggcagtaacctcttgtgaagcggaagcaaactagaaacagctctcccaaacgtgggcaaaaaaagaaactagaactggttgaagactgagttttgggagaagaaccctggaggccaaaggcagtattcctggggtcctgggatggagagagccctgtcaccccctctcccccatctgcccttgctgcaaggaggaggtcagccttgttttataaatgaggtcacttttcaaccttactggtccatggccctgtcctgtttctgtatctgccaaccagagagcaactcccgttgtttgttttcaccttttagaattcctgggactaacaacaattgtaataaaatcgatggtattttaaattgttgggatgaacaagcactttgggttcctgagatcttaggataaaagcccaccgaggtgcgagtctcaccatcgtgctgtctgctgagagatctgattcccagcggaccggccttcctcactcgatgattgtcagggctgagaacccagcacaggtctgtgatgcccacgaggctgtgcggctcagggccaggtcggttttgagtcacgtgcttactgtgtgtcggaacacttgtgctttgaaggctgcgattggacacgtgattcccagcacgtttcctgaggttccgcctgcagcccgggcctgtggtggagtagagcttctctccccagctttcccgggagtgtgtggtctcctgtttcccatctgcatttgcttatggggcgccatgacaccaacacatggagccacttggagacttgtgtgttagttgtgcacagatacctacacttcccactgcccgacagtacgtgcagtgattttgatggctgtttatccggactaatcagacaaaaacatcttccaaaatacattataattgcactagggacttctaaatttttattcaatgggtaaatgtctttttatttcattttaaaaactcaatgcattgtttgtttatatttaacatggattcatttaatgagagttaagtttgaccatataatggaacaaatgttaatttcctcaaaaagtagttgttctatgtcagacccatgaccaagatctccttgctataattagatgacttgtttccagggtaaggggctcacctgcagataattttctcatctccaatagaggtgtgcattgccttctgtatctttacttcattgttctctagcttcctcatttgaaattgcaaatacttgtatctgttgttttcctaaggtgaacatgatgctttttactatcaatttatgtacttttagaaatatttaaaataatttatttttaaaggagaatgaactagtcaacctattaaatgattacgtcatgattttaatgattctcaggaaaaattgtgctgacccttagatgataattcttcaaaatgggattctgattctgtgttggccaagcagattataacccggcccttgcgtgctaaaccttaagtgtcaccatattcacccctaggcttcttcctctctcatggctcctccccagccaccctccgtctcccggacttcctccttgaacgtggaacctcaacggctggcctggccgccttgcctgcctggggcaccagccccccagtgctgtgtggctgataccaaagtcttcttttccctcctggtcaccagctcctgtactctctggctcagtgaatgaccccactgggccacgacaactaaagcctgactttgtgctggccccgccccacctcacccagcaccttgtcccgattttacctccagcgtgtttcttgcatctgcgttctccttgcctgccttccttctcctctcttgcccccaggcgcatccctgatcgttgctgccattctagaccagtctttcccacatttgagtggtgtggaaccttttttttttttttttttgagacagagtttcactcttgttgcccagtctggagtgcaatggcgcaatcttggctcactgcaacctctgcctcccgggttcaagcaattcttctgcctcagcctcccaagtagctgggattacaggcatgcaccaccatgctcggctaatttttgtatttttagtagagttggggcttcaccatttggtcaggctggtctcaaactcctgacctcatgatccacccgcctcggcctcccaaagtgctggaattacaggcatgagccaccacgccctgccagagccatttaaaagaacaaaaatctcatgaatccttcaacattgatttaactgttttgataataattatgcagttaggtacaagcagaaaactaagattcagctccttgtctttatagcttttaaatagatataaaagttatatttattaaacatttaaattaataccattaatttactgtgcatttaatgttaaggatgatgatgttttgctgaaacaaaatgacggccatccgtgccaggggttagggatgacggttgcagggcaggctcctttggtgtcagctgcctcgtgaccgtatcacgtggtgaccccagtctcttcctttcctgctttcatactgagaaatcgtttcgtgtacagcatgcggtgccttccccgggggttaacttgttctcagagtgagtgatttacatgttgcgtctccctcagcgctgtcccccttagcaccactcatgacctaggaagtcggagatgccaactcgggcagtggaatccagtggtggttttggatcactttttagatagtgattaaaatacactcaaaaatttaaaaattctcttggagaaattatggttccagagaaaatgacaggtttcccttgcatctcaaatttgctcagaccgtctggggatcttgttacatttggattgatccctccccctcttgggtacacccaaccactggtctaaagtgggccacactttgagctggaaagtgcttccgtcttttgccaacttaaaatttgtcctcgccaggggaatctttcctaatgcaaatcagataaccccttcctccctccaccctgcacacctatggcagggcccagacattcaggcacctccagggccaggcaggaagtggggctgagggcagcccgctgatttgagagaagggcccacggtgcccgtggaaacccgagagtgtggcctctgcacactgctgcccctcagggccatattcccatgtcagatggagagtatgggtgctgcggctgctggatcctaagatccataggagggcagggggactccatccaaccccagtgactcttggccagaagtcacaaacaccgcgtgcacgtgcagctggcctgcagcaggttcagtgtaaccagcgttcaatgcaaaaatgtatacctgtggccagtattttaacataagaagccatcacacacaagtccagtgtttctccttctctttgataatcaggaaatctggccacgtgggaccctccagccctgcagggtcgctgtgttgcacaaccccaggggcttgttggtggcagcatgttggcccagtcacgttctgggctaaagtactcctccctgccaagcaggtctgatctctagtttccagcagccctgggcaccccgttcctggaatttgctagtcgggttgagatttcttgtcctgttctcctttccttgaagacactcagggttgaggccttctcaggctgctcctggatttagcaaacagaaaccgcttcctctggagccatgtgcactctcagttaagggaaatatttgctcatctgctctcactccaagctcacattatatttcagtgggaatttgggagtgaagcggagcccctgtccgctcatgttccttgactgaatcagaatgtcttgggaattggggataccctctgtaaactgtggggtgcagcgggaagataaaatgcgagttgtcatgaagtctcacttctctccctgcaagggactcaggtgacagaggtgcctgccagagggatcctgagcagccgccccttggtggttgtgctttggaagggggagctgaagttcaagaccaaaagtgttgggctgggcagtggctgggacacccagaggttctgcgtggggagcaggtcaccgcccatcagtaggaacaggagactttggcagcccagcagcccagtgtcctggcaggagtgaagacggcaggagagctggccctgccacattccgttagctaacaagacacttcccctgtgtaactcagtcctggctttcagggagccatggcttccataacttcgctgcccctgacttgttcctttggggagcaggggacatgactgcacagccgggctgagcatggggtagtgctccagccactgaaagaaaagtgcacctgccccagcccagctagaccacagccatgacatggcaagcggggcagccaagtggctcttggtcgccacagcaattcttgggggggtcagataataaacccaactggggccaaggctggaaggcagaaatatgactcctaagaggccagggtattctgtagtcctgccacttacgcagcatttgaatagtgcctataatccaagattatcccccctggcaagacgtagagtttaagttaagtttacttatttaataagatcttaagtttattgagagttttcctaggatcaaaagaaaatcagcgtaggcctggcacagtggctcactccctgtcatccagcactttctaaagacctaagcgaggcatggtggctcactcccctgttaccccagcacttctgggaagccatggtgggaggattgcttgagcccaggagttcgagaccagcctgggcaagatgatgagaccctgtctctacaaaaaataaaataaaaaattagacagacatggtggcatgtgtgtgtagtcctagctactcggaggaggctggcgcaggagaattgcttgagctggaaagttcaaggttgcagtgagctgtaattgcatcagtacactgcactccaacctgggcaacagagcgagaccttatctctacaaaaaacagaaataaaaaaattagccgaacaggatggcacacgcctgtagtcccaagctactcaggaggaaggagggaggatcacttgagcccaagagttcaaggccacaaggagctatgatagcatcactgcactctggcctttttttttttttttttttaaagttttaattcagcctaatttagttcctcagaaagctataaaatgatgtcttcacatgcctcccgattagactgtttccccctttttccttaacaaataagtcctcgtagccttcactgggggcaggacaattttgaggatgtgatttcctcacgaaagtacctcccacacgccagccagaagagtggtgcaaatccatccgcgtggagccccgagggtgtgcgccgtggccagcatttgtctgagtgggaagggatgaagctttctgaatgaagcctggagcatctgtaatctcctggtgacaccagagaccgtggccctggcattgttgaaattccatctgaaatgaatgacggaaaaatgggagcccactggagaacttgagtgagggcgaggcgggtggatcacctgaggtcagcagttcaagaccagcctggctaacatggtgaaaccccatttctactaaaaatacaaaaaaaaaaaaaattagccaggcatggtggcatttgcctgtaatcccagctactctggaggctgaggcaggagaatcacttgaacctgggaggcggagcttgcagtgagctgagatcgcgccactgcactgcagcctgggcgacagagcgagactccgtctcaaaaaaaaaaaaaacaaaaaaagaacttgagtgaggctttgttatgctaagttttaaaatccacgggaatcccactgaagaggggtctctcatgagttgaagcaattgcttgtttattaccgcatcgctgatggtgactgcccttctctaattcctgccatgcaaggaagcccttattgtcttggtttgcaacttagtagcattttcctgtgggcttcattgggttgattggtctcagttccatatttggtgtatagcgatttagattccaagaaatcaaggtatgccacattttgccacgtttccgttaataagaacttgcaaagaaatcatcttctaaagtcgtttcaaactcaaatattttcccttaagcaacaatgtctaatggtgattgcagccccaagctggctcatactttattaagtttgtgaaacttggttacgatctagtaaataaaaaacagtattgtcacagtattggtaattaattggacttgaactcaattatatcccataataattattcattcttatgttgtaattcttgaaagatagcagaatttaggaggtcgatggaggctgggaaaagttctgaaggtgactcgtggggcatctcggctttctcaaagcgtcttcttgtatttcaaaactcataactttccttctgcctcagtccaggtgaattaactagcctgagtcttacgctctctcagtcatattaaggttacataagtttataaaagggtaggagaagaggaagtaaagagattgttccatttttcttggttaacatgggccagagttagatgagaagggaggaagacagagacagagactcccgatgtgaacgctgccattgaaagggactgagctggacaggcatggagcccaggctgagcaggagagaatcccagctcaaggtgtggggcctgcccaagctcagtgttggccgtcagcttccttaacaaagggaaacctgtcaaggtagagcaaggtttgctgggaattggtgttaaaacaagaagaaattctcaaccaccatttaagaagactggattaaacatgacttcaaaaatgtgttggtttcaaattctgagtggttttcaaggaggcttaatatgatttcattaaaaatgaattagagtaaattacatgggattcatctattaaatactgttactgaaatttgccagtggaattttggttttaataaaaaatctgaaatgaaggaaactgtaaaaaaattctgctttacaaatataaggtgagaatacagttaatgcagtttgggtttttctggggtttttttgtggtttttgttttgttttgttttggtgggtttttttgtgtttggttgtttttgtttttgttctttttggctacaaggtgtgttttattttcattattcatagaaataattttctataatgtcctggggcaaaccagagaatttggcaatctgattgggggtggtccttcagagacccacaggccagtggcatcggtgcagagtgcccaggttcacaatgcagcttgtggctcgtgtccatcttgcaggtcgctcttcctccacatcacaactggggtcttaaggatgacgagggcaggaaatcctccgggctcttaggaaatttcactccgcttctgcccagtggtctctttggtcggcagggtgttcttctcctgcgtctccgttttcttcagcttggccctattgaagctggcgattccccccacgtctggtttgtctgccattttcttaaaacaatcggtaccatccgtggcgggctcttagctcactgcaacactctgcctcctgggttcaagcaattcccctgctcagcctccccgagtagctgggattataggtgcccaccactgcgtccagctaatttttgtatttttagtagagacagggtttcaccaatattggccatggttggccaggctggcctcaaactcctgacctcaggtgatctgcccacctcggcctcccaaagttctgggattacaggcgtgagccaccgtgcccggcctggttaatgcagtttttttagtttgttctttctttttctctttgtctctcctctctctttctttcactcgctttgtcacccaggctggagtacggtggtacaatcatagctcactgccacctcaacctcctgggctcaagagatcctcccacctcaaccccccacgtaactgggattacagaagcacaccaccgtgcccagctaattttatttatttatttatttttttagagatgggggtgtcagcatcttacccaggctggtctcgaactcttgggctcaaacgatccttacaccgtgcccagcctggggtttctttctttaaaacattatacctttaggtgtttcctgtgtgtttagcagttaattatccaaaagatctagtgtagcacgtctcaatgtgtttgtgtcgtatttgttgaactaatggcatatcttttagcattcgccagtatcacagagtgaagttctgcacacacacagaacttgaatgtatatgttgcctgtgtacctgccttttcttttttttatttacattagaatttctatttggctctttttcccttgtagggcatgctgttgaagcgaagtggcaaatcgttgaataaagagtggaaaaagaaatatgtcaccctgtgtgacaatggcgtgctgacctatcatcccagtttacatgtgagtatagccccctcggagcaattaacagctgcagacctcaactaaacactgtggggaaggggaacctaccagcagcccagcctcttgtctctgtttgaagtgaaagtcgtatttggtctcctgctcaactgtgagataaataaccctgttcctcacactccactagaccatatgtctttctctctcttcccctccctaccagtcaatctgtggctttccaattctacaaagaattacaataaaaggcacagatgaagtaaaattttagatgagagtaaaaagacaggggcaaggagaaaagagaaaggagagaagagtggtctatctgaaaatcgagaatgaaggaaacaattacatttgaacccaggatttagctttgaaaagctgtgaacaataatcagaagtcaaatgcaattcatgactcagcttttattgtcagataacacattccagtgcattaggcaaaagaaactctcctctttgtgttatatgtaagtttatgttacatataagtttgttatatccgtggtgtataagatagatgtataaacaaaattaactttattcttggggaagaaatgcagacgttctacccattgataaaatataaaaaaatgcagacattctacccttgataaaatttaaagttggggtgttctagtttcatagcaaaccattccataactcttacttgatgcagagaaatgtgtagattagaatatatggtggaagtcagtcatttgattccattgtccctcagtatctatgggggatggattctgggatctgccttgtataccaaaatccatggtggtcgagtcccttatattaaatggcatagtatctgcatataacctgagagtatcatcctctatacttttaagtcatctctagattacttataatatgtaatagaatgtaaattctctgtaaatagttgctatactattgttttttatttgtataatttttcactgttgtattaggttatttttcactgtttttttttttttttttgagaggagtctcactctgtctcccaggctggagtgcagtggcgcgatcctggctcactgcaacctctgcctcctgggttcaggcaattctcctgccttggcctcccaaatagctggaattacaggtgcctgccaccatgcccagctaaatttttttgtgtttttagtagagacgtggtttcaccatgttggccaggctggtcttgaactcctgacctcaagaaatccgcctgcctcggcctcccaaaatgctgggattacaggtttgagccaccgcgcctggccttcttttgaatatttttaatccatagttgattgaatctgcacattcagaatccacagataacaaaaggcaactttatatcactgtgtcaggctagtagtaatagtcacagcagcagcagcagcagcagcagtattttttggtagagactgggtctccctctgttgcccaggctagttttgaattcctggcctcaagcaatctgcctaacctcgccttcccaatgtgctaggattacagtcatgagccatgacacccagccaagctattaatttttaaaattttgaaatgctttgtaaaatggcacagttattgatgagaagttagaaatagcatattgaagaaaattaatatcattcctaaaataccacctagggaacctgacttcacattttagggtgcatactcccggctatttctatgtatatttctcttttccttccacaagcacatggtcactgtgtatacactgcccacagcctgccttcctcactcatagtagatattttcatgtcaagaaatatacttgtacaccaccatttttaatgattatataatattccactgtgtggatgtgccttcattgatcccacggtatctgaaaaatgaaccttggcagataaatttactttcagttttttcactgtcataaagaactctaatcaacgttcctctgtttatctctctgtccccttgtccaatttgcctaggatacattcctagcaattggcttcctgcgttgaagagtcgcatgtgctttcatggtttttgctgtattttgtcaaattcccagaaaggttgtatcagtttatctcatctggcagtgtataagagagccttttctctgccctctcaagaacatttaccttcagaaagaagagcttttcctaatatgataggtagcacatgggaaccttgatgctgagttcgcttgctggcgtcttgagttgcccttgtctccttgtcttttagcgtagctatacctttcagaaccacgcagcaaagcaggtcttccgtcggcatctctcactggtttctgttgttactgaaagcacctcccatgcgttactattcagtgggattcgagatgcagatatggatagattcttacatagatattctttattgcagtaaggaaattcctttgtgctcagtgtcctgctagtttagttttggaatatagtcagactggttctccagggggccttcagatcgaagagatgtaatacccattccatgacgcccacctgggaccaggttggcatctctccaggactgccccatgtaggtctccagttctgcagccctctccacacccagcttccatccatcagaacaacagcgaggcaccaggtcttccctggattctctctgcaaagttgctccatcagcagtggccgggctgccctgttactggcttagctcctcctatggaccctgtcagagagcagaggtctaactattgaaccagtcgctttatgtaagttagagaagtgcaatcaaaatatcattcttggtaagactcactgaccagtaaaaagtgagagctgatggatgatacatttccagtcaacatatgctcactgctgagctcaggctcagtcgaagggatgtttgctgcttcttgccaaggggcagatatggtaacaacgatatgtatcagaagattcccttaggaggcctaaagcctgtttgcttttcatccaatcccttgagtatataatcacaaccagttcttcaaaaattctcctatccacaggcttttttttgtgatgtccctcagtgtttgccaattccatcctttctccttcattcataagtatgcatgaatcttactggagtacggaagaggggcgcaatggggctttgttgtataattgtatagcaagcaagagccaatgtcattttcaaatgcaatccttttaatgccagtctccttggaactgaaatttttgatgcaggtacgtagttccctatggaaggggcttaatccaggaatggatttgaatcactagagcctgaagagatggcatgaccttccacgtaatccttcatgggtttcattttcacagccaagcattggataaaagtgtggagaggcagtgacttccaggtgtattctctgacaggtgcatacgagtccgttctgttgtgacttgttaggggaagtgctgacccacaccagctgagttagtctggtggtcttggttcaaaatgggaagaggcattcaatgggacacccacgagccgaatccagattttccttcataagaaacttgagaatgtgcaaatgtgttgctagttcaggtcccaaaattttacaccgtgagagtgacccagttatctcagtctggaaaatttcaaaagatcgtagaaccagatgatctcagttaaacacggaccatgctgtgacacccacatccttggctatctccaggatgtattacggcagaaggaccactgagagtcattggccacatgcagtggtggcataagtggtcaagtgttgggaaagctgccaggattgctggtgtttgggtttcagagtcattattgttgctcctaactctattactgaccacagcgtgaagtggggcctctccctggtaacaccctattgtctgaacatgggaacctgcctccttttctctcctctgggattcaggcccatgtccagcctctgtagacctatatcaagtcattaaaagtagatgttaacctgtcagtggaccagaataactccctgttttacactagaggaaaatgttatctggtttctgagaacactattctcatccaccttttctctcaaaggcagatggggcccaggttccaacacaagagcccccggagcaggggcctgcattgatctcatatagcatagcctacagcccgttcttttccacagagcccaggaaaaaaaatcccggccaaaccatcagatatttttagttttctacaaagatgtaaacgggtatcaatagtgaggttgctgcaccgattcctggtgtataccactaatttaagaagcccaggtaattagtggactaaaaaggaaactagcatgcttttggggagacgggattctaatcagctaatacttctattatggggtgctgacttgagagcgccaggcttgcagttgtattaaacgtggaagattcagacagagatgagatagggccgtgcggcagcccatcaccggcagcgcttgctcgtggtggtgaggcctctcccttccggcacagacatttatcttctgtccacgtgtgtgccgctcacagtccacgtaaggctgcgccctggtgccaccaccagcctccttccatttgcttatcatgttaaattcagggagctggggagagggtcttgcacacaaggaacattggagcaagagtaaacaactgagtcaagtttaaacggaataggccaatgtggttatgggcagggggcgggggagcgggtagttcaggaggatctcaggattatttgttctttaggatcaaaccgagaaggtggaatcgagggtctttaccacccttgtctttctccctctgtgacacagggatgttcaggcatagtagctgatgtcagaggattgcctgtgtgggataggagggtctagaaggctcgactcccctcctagggctgctccacacagctcctgcattagtcaaccaaattaaattcccaggcgagctccccaaccagtcctccctagacaagacaggcaagcaagggccgagttgatagacctgcctgggcaacatggagagaccccatctctacaacaaataaaaaagtgagccaggtgtggtggagcacacctgtagtcccagctactcaggaggctgaggcaggaggatcacttgagccaggaggtcagggcttcacagtgagctatgatcgtgccactgcactccagcttgggcgaccatgcaagaccctgtctttaaaaaaaaaaaaaaagttgatagaggcaggtacagcatttgttgctgtcgggtagagcggccacccactgccccagccttccctgtggccacttcagctcctgcgtgctcccagcagtgccagcatcctcatacctttgtttgggaaagacaccccagcagtggggagctctggctttcagttcctttgcacactgtggaagcaggagactgaccatttcctaaccttgccaaaaactctgggtgagggtttttcaatgtcttcattagatgcccttaggaaaagatctccctgaagaggtcatttctgttcctgaggtatctgaacacagtttgcttattgcacaagtgtccacggaagtgtttgtgtgaaagatcgatcacctttggacacgaacttcaagtatcagtcccagacagatgttttccacacatcggtgtgttcgaaaataaacccagctcttggccaaacaaacagtcggtatgtggccgtgctgtgcaccgagctcgtggaatcccagcaggatgacctgctctttgaaactgtggcttcagaacaaagcagccagtcatgaaactggggaaacctgacattgcaggacaccgtggggctggtgtgaggctgaaaatgtacctagaatgggtcggctgcctgggaacctcacgaatactgatccccagggactgcgtgtctccctcagaactggggcagctttctacttgcagaagatcatgacaagggacttcagctgggtggtggccctgggatgtcactttccttcccacttaattgctttggatttctctttcctttctcgtcatcccccaaaagtgtctttgccttttttttttttttttagccctgagccccaagctcagtccttacatagattgtttaggagaccagtaatccctagttcctttgacttgcagctcagcctcactctgtcctttacttaggacataagctaaatctacatacccttcctacaccacagatagaagatatggagggaaacctttttctccaggtctgtttcatgttgttgaaaacctcaaacctttttcttaggagagaacctctgtttctaagcagtggaatagaattgcttatggaatagccaggtcataggatgtgataatttccctggaaatcagaggggaaaagaagcaaaacatggagccaactcagactaagaaagctccatgaaagtttatgccagtgataacctccaggccccagatctgctcagcttgggttctgtgaagtcttgaccccagccatcacccacagccacatctcccagcctccttcagctcttccccaaaggcttaggaggtgttagcactggctgcctcaggatgatggggtccctgcacttccatgctgtgtaggttgagagaaggaggtatgggcacaggaggaagtgatggtagatttccactgtagttattcccttttttttttttttttttaagacagtcttactctgtcccccaggctagagtgcagtggcacgatctcagctcactgcaacctctgggttcaagtgattctcctgcctcagcctcctaagtagctgggattacaggcatgcaccaccacgcctggctaattttttgttttagtagagatgggatttcaccatgttgcccaagctggtctcaaactcctgacctcaagtgatccacccgcctcagcctcccaaagtgctgggattataggcatgagccactctgcccagctgtggttattcctaaaggccagtggtggggcaggataacaaggacagcaccagagtggggaggggtgaatgaacctacagcgtccacatcattgcttccctcacagagtatgttcagccaccagttgacagtgggcgggggctgcccagcctgtccaggagctggagcacacctgcatagctttcagatcacacagaggtgccctgctgcagacgctcaggctacatccgttctagtgggtgtgtttgaaggtagacattgggaaactggctggaaggtgtccgttttagaaacatggagaacgaattctttcactgggtaggaagtttgatgacattgtcttctaggtcacttcagactctgaagaatgtgagctctaaaactttcaccaaaaactctcagcaaactcaagctaatggagttagttggatttctaaggaaaacgctgtcctgaagttgaagctactgggtgtaagactaaaactgaggctcaaaaaaaaaaacacctcagttaattcatctttctttctcaagatgctattattaaatgaaaccaaaacccagttgagataacagatagaaaactcaaccaaataatgaatgaaactgccttaatggagtggccaactgccctggttttctgcaggactgaggggttcccagggtgcaggactttcatagctaacatcagggaagtcccaggcaatctgggacctggccgcacttgctgcagtactgaccgccctaacagctcctttatctccacttcgcattttgcaatgataaccctaaacatttaaataagactgacacggtcaaagcaagcacgctggctgatgctgctgctctgcggtctacatttttgtgtctttgaaaaattgtatgtctccaagacctttaaaaagccctaactgcttaactttcttgggggaaatatatatgagtgtctcatggttttcagacactttgctggatcacagttcaggtggatcgagggcagcctgttctaagaccctgagagtccctttctgtggacttaaatgtgagccttagggagcaccttgatagaaaaatggaggcataatgagaaagaacttggacctcagggcttcacagttcagcgtggccacctattcatcttccatgtcgcaagcacggccgtcgagtgcaaggctgcaattccctgctgacaaagatgtgtgcagtgagattcctaagtggacctggaaggatgagctgagtggcctcacggtcaagccaaggacttcaaggtgcccctgtctaggaaagctcaccagtgttccggtcctggctctctgggcttcctcaggaggtcgtttggcagctgtgaaactcctcccctccgggccatacctggcagacgtgcatgaactggtcagacttttaaaaaacctccttctggccaggtgtggtggctcacacctgtaatcccagcactttgggaggctgaggtggatggatcacctgaggtcaggagttcaagactagcctggccaatatggtgaaaccccatctctactaaaaatataaaaactaaccaggtgtgctggtgggtgcctgtaatcccagctacttgggaggctgaggcaggagaattgcttgaacccaggagacggaggttgcagtgagccgacgtggtgccactgcactccagcctcggcaacagtgagactcccatctcaaaaaaaaaaaaaagtccttcttagattcctttccattctgcatgtgcccacattaaaacagctgtggctctgtcatttctccctgacctgcaatactggaattttccttcttaaattttcctcctttaaaattgttaaagagcttttcttcttttcattactaggcaggttaatttctatctgagtggcttggactctcctgcaacacataaaccctttgattctgtgtgtcgtcaaagtttggttttgttctttcaaagccagggcagccaaacttggactctctaaaattatcatcagaatgcagatttcagaaagtttctagtttcaaaatcagacagaagacccacttctttactgatgtaaagacaacaaaaagatctgtgatgattcctaagtaggtattttcctcaaaagaaatcattcaagaaaaaaaaaaaaaagattgctatgagaatagcagctcgtggctgtgctcagtgcctgtaactgcctttgtaaatacacgaattcctcacataggactgcaacattttacttgaggattgaagattcacgaagaatctgtgatccatctcttcacccaccttcactgtctgctaggatggacctcagacttcttgaggtcgtgaacattcatttacactcagagaaacttttcactggtttccccagaacattgaaacagtcagaataactcctgtgcaggctactggactgacaaatgtgaaggccagattttcagatgtgaagctgggaagaccaaaaagacagacctccctttcttactgagaagagcgtagtcagacatgtcaagtctggcacgctgctgcagaaggcgtgattcatcttaagatcaaaaattatttcatcttgctttcttggtcataagctaaggtgcttggagctgtcctttggcctttcatgtgctgtgtctgtggtgcgggtgtgctgtgtcctcataagggtgcgccatgtctgtggcgtagtgtgcaccgtgtccatcataagggagcgctgtgtctttggcgcgggtgtggcgtgggtgtgccatgtccatcataatgaagcaccatgtctgtagcgcgggtgtgccatgtccatcataaggaagcgccgtgtctgtagcgtgggtgtagcgtgtctgtggcgcaggtgtgccgtgtctgtggcatgggtgtggcttgtctgtggtgtgggtgtgccgtgtccatcataggggtgtgctgtgtctgtggcgtgggtgtagcgtgtctttggtgtgggtgtgccgtgtccatcataaggaagagctgtgtctgtggtgcgggtgcaccatgtccatcataagggtgagccatgtttgtggcgtgggtgtggcatgtccacgagggtgcaccatgtctgtggtgcgggtgtgccgtgtccatcatgagggtgcgccgtgtccgtcatgcagatgtgccttcatggccctccctgattcccaggccccatctagtgtacatcattgcctcgggtgagaatgtccctttctgccccatctagtgtatgtcattgaggaggagggctgtgttccccacagtctgcccaggggctgtcatgtgagtggcacataggtattgcttagtacacaccggtcacagtgacttgagtgccaccacaatgaagtttccaatcgtgtgactccttcagcatctttgctcctgaacttcctggactccagccctcaacattgacaatcctggctgtgctctacagattgtggtatgattgagactaacagtactcaccatgtcttacaacatgacctccctaaactgacatagggttgggtgaacacacacacacacacgtaatcactgcctcacgtggcattattacaaatgctgcaaaatctaaacacatcactggaatccaaaaagcaatccatttagaggcatatgaggagattgtacggatattaaagaacaaagatctggaactatggcaacaaaccaacgttgctgttctagcctgagctgcctgttttaggcaaatgggaatgcttttggaaacaatatgaaccgcaacgggtatttctgcaagtttctaagactggcaggagtcagctcgggggaagcaggaagaatccccagttggttggctattcttgggaccgaagagataatccccattgaacagagcctacactcacatccttgagtccgtgatgttcttcgcttccctgggaacagccagagtccagctttccgtgtggattgctttcacagggatatctggcccttcaagccagtggtgtgaatgtcaccccaagaaccttgacgtgtagatactgcctacttcaagtcatactgcagctctgcctcttcccaagataggatttgaagcagcttccaacagaaaatggatgtgaaaatgtattgtgaacacatgcataggaccatacatacatcatacacacacacatacacacacacttaaacatacacatgcacatgtacacacacacacacagctatgggcacaacttcatttcaacttgtagattgtgaagtaaaggcattggaactttgtggcttgcaaatctaaattacctccttccatcttaagatctcttccctcctttattctaaagtgtgattcggctcctctcttagctgatccttctggtgtgcaggtcaaagaacactgagctgggaatcagttgtggtttccgattctgccgttgccccacccgcttccatgttggttccaacgtggctttgtggagtcctgggactcaggcacagtgtgagaatcactgagcctctcaaggtcaattatgcagtgattgcttggtagctcttcttcctccacccacagcctcggcctcggcctccgttttctcttcctcctgggaattcatccagaatgacgccagaagtcacacagaggtgatcttgcagaccatactcccctgagtgtgcaggcctgcatttttgctcagttcagctagcgcagtggcctgctcataaagttttccaaaacctgtaggctgtatgaagaatagcggttactcctaagctgcttttaactttcaccttgtgattctcatcatatttttgttgatttccctcctttgagttcttttatgtatttccatgatggagaagatcccctctcccgcttggttgatgtccgtgcccctgctcttgccccagcttgcctcctcagactggcctctcacctgcttcctgctctatcgctgtctttgttttcttttagtttctcatacttgccatgttatctggcctccgggtcttcacaaatgcagttgcctctgttgagaatgttcttttctgccccatctctttgcctcactaactcctctttccaatcctggcttaaatgctacttcctcttgggagtttccccacactcggcctatttgggcacccatgctgtgtgtgctctcacgttactctattgggccatctctctgattctcccacaagactggaagctccttgaggcaaggatgtatatgtcaccaatgtatctctaacatctggaacactggcttgttggatggatggatggatggatggatggatggatggatggatggatggatgaatggaggcacaattagcccatatgcttaacctttccttaaatgtgtcggactagagttcctaaaacctcgtggaaggaatccaccatgcaacacttttaggaagcagaaatatgtctcagccatattctggctccatttgctgcaacttaaagaaggatcttgatgggagaaaagcttcaggattttgtttgttgcttttttcattttaattgtaaaatacatacaacatttgccaccttaatcattttaagtatactgttcagtagtatcatatacgttcacgttgttgggcagtcaacctccagaactttttcatcttacaaaacaaactctacgcataaacacaaattcctatcccccctccactcagcccctggcaaccagcattccagtttctgtctctatgaatttgtctgctctaggaacctcatataaatgaagtcatatgctgtttgtctttttatgactggcttgttgcatttaacattatgtcctcaagattcttccagttgtagtgtgtgtcagaatttccttcctgtttgaggctgagtaatattccgtcatatgtacacaccacattttgtttgtccatggatggacacttgctttcacctcttggccactgtggacaatgctgctaggaatgtgagcatacagataactcttcagagcttgggttttaaatgtaaaaactgtaacatgggaaagctacagagtatggctgaatattaaacctgcctaaccttaccagcactctggtcatggtacatttgctgggcccagtcctgaccacagtgaactgtgcaggcttcataacatgcatggtggtctggaagccatgtgataagaagaagaaaaccacccagcaatgacatggtcacatgggctctcctggagtttgctaagcacctgggtgacctgggaaagaactttgtcattcatgtgacctgtttgaaagaatgtgatcagttgtttctcccatgtgtcaacagttccaaagccaaggaattaggccgccataaaagtagaaatgttttcagggcatagtgacaacttttgttggaaatggagcctactaaaaactcactggtgttacaccaacacagaaaaggactctgtatcaaagtctatttctgtctatgtaattctttctttgttttatataccctcagggtttggaaatgtttgggatttaaaaataaaagggccgaaagctatcctcacgacatttcattattgatgttgttgacacacagtgaatggaagcagggtgagactggacaaaataaagtcctcttatttctttttttgtttgttttttgttttatttggttttatttgtttttttggagacaaagtcttgctctgttgcccaggctggagtgctgtggcgtgatctcagctcgctgcaacctctgtctccagggttcaagcaattccaccatgcccggctaatttttatattgttggtagggacagggttttgctatgttggccaggctggtctcaaattcctgacctcaactgatccgcccacctcggcctcccaacctgctgggattacaggcgtgaaccaccacgcctgaccaagtcctcatgtttctaaaaattataccactaaatagtgtagatcctacctaacctattttcaacattgaaaaattctgccttcttgcatttctagttaaaatgaaaaaatagaatatatgtgtgtttctataaatagcagatttaacagtgtggctggagggtttgagtctctaagcttccagtggaatccaagggacatcgtcctaccagtatgccgcgtgatatgtcagatcgtctctggccgtcctttgtacccaattgataacattttgttttccatttttggccttttcgtgttactcattgaggccaaaaattcttacacaaggtaaataaatcaaatccctctggtttcctcagcaacagtaagtcacagccgaggactcagtaggagaggatgactgtggggggtcatgaggaatgttcttttacttctactaagaaattgaatttcattattatattttataaatattttcttctttggcttataacctgattgcgggcttgttgctgaggtcttggaaggtaggtagggaggggcagggctggagaggcctgtttcttctcaggtgtgcctgtggccccagatggaaaccaatcaaggtgcgatttatgttcattaagtgcttgtcaaaactgaaaaattttctaatcaacagcaatctagctgcagccccctcgatggctgggagggccacctctgccgcatcggctatttgcctgttacaactctaggctaaaaatccgctgatgattacattaggctaagctgcgaagtaaatgaaccatgtcttatttaggtgccactagcttcagagtagtcctgccccgcagggcacttgatagcattttatggctttaaaattagtgtagcttcccatttgctgcagggtgctacatgttctgcctttgaactcaataagcaaagggaacggggccttttgtttttcccccttctttttttccccttgcattttagcaattttgttttgcatcttttccagacggcattttgcaataaaaatgtctgactaccatatacatgcctcccccatttaaaaaaaaaaaaggtgggggaagagaaggaggaaaaagcagaaaatgtcatgcgtttgcagaggacaggttcccccccccacccccacccccgcctgtgctacaaagtgaaaaatggctttgcaggtcaaccctaatgacttatcatgtcagaattgctacctcaagtgggaacaacacctttagcccaagaaattgccacataaagtcaaagggaaaatagttcagtatttttattggacaagagtggtgagagctaacatttatggagggctttggcgctctgttaagcacttgagtattatctcagtgaaccctcgcaacagtatcatgaagctagaactgtttttaaagatgtggacatggggaccctgagtgactgaatgacaggcccccagtgtgcaactcggaggagagtggaggcactctgatttcgaggcttattccctgaccaagagaaagtcaacttttgtcttccaaagacttctttaggaaatcagaaaagtgtggttatcagtgaattatctgattcatttgaatggaatctaatacaaggtgctgtgaactcccttggcaggcattatgtttaggaaaacaagagtagttcctgtaaaagcaatgcatgggaaaaatacgtatagaagacttctaaataggcctaggtggaaagtttaaaaattagaagtactgaccctttgtcaaggggaaaaactgaagtgggagtttgtccgtgttaccttaggtctcatggcagaagacatgatgtagcaatcgatattcacctcagaggacagatgtatatgctctgctgtcttaaaactctactgtttggccgggcgcggtggctcgcacctgtaattccagcactttgggaggctgaggcaggcggatcacttgagatcaggcgttcaaggccagcctggccaacatggtgaaatgccgtttctactaaaaatacaaaaattagccaggcatggttgcaggcgcctgtaatcccagctacttgggaggctgaggcaggagaattgcttgaacccaggaggcggaggttgcagtgaaccaagatcatgccactgcactccagcctgggcaacaagagcgaaactgtgtcttaaaaatatatatatactgtttgttttagcgctgcacattttagcaaattcgtccaaagaaatctgaagttttaaagagacccagacaggcagtatcaccatggtgaacatttccttataagtcaaaatttctaggatctaactattgatccagttgtttcaagccatattcaaatattaaaatactaggacagcaaaggaattgtgttggctccttgaagttcattgtaatgagaggcctacagtgactgtgtagagacaagcagctgttttcatatccgaggcatgcatcgtacaggctaggtttgagcaggcatgggttacaactgcgtaatactcaatttaacctagaatgagaaaaatctttcaggcagtgtaaacctcaatacagtaggtcagtcaagacagatacagtcaagaagcaaaaggtgtattcataattcgatttagaattttctgctttttgatttgtagtagaataacttaaccctttggactggtggacttgagcccacgcatgttggacactggcctccgcagcacatgaagcagagaagtctgcttttgccatcatgtagggactctccactgtacatgaagctgccaccactggtccccaacaaggcctcaccagccttctcgtttaccacgtgtagcataatgacccagacccaataaagcatttactaagtcaagaatattccacacatactcttccttacctccatgatggagtagtagactgatttcatcttgatagtctgggtcagtcactccagccaacactgtaacttccttcttagcctgttgactttgaggtaggaggagcccaaagtggccaggtgacaatcttacagtttaatggaattgttgttgtgtctcggtggcagcatttctccctctggaactaagacccctaggccagcagaacgtaatgttgtgggaacaggaagcaaaaattttgctagtgggtcactaggggtgatggtgagtggtgccacttccatttctgccccttgattcctggacctgtgaatcctggcaatgggaaaaacaataccatatattggacactgattcagagcatacacagccttctggagaactttgcctcagccctgcaaagtattgtcacctagttggcattgtaattgtgacttcaaaaggccattccaccattctattaatccagctgcttcaggatgatggggaacatggtaagaccagtgaattccataagcatgagctgtttgcctctgtgcatgctacacatctgattggccaggtgccttcctcctgccatggctgctggtcactgtcatgcacttacaagcatgggtcaggtagtcttcaggaacgcagttctgaaagtgaaacactggaatgcttttggctgtcttgggaaacaaagttatttctcatgggatttttccctttgaagctgcctcctaccttgctattgtgactatgatcctttggggagaagagtaattgtcttcttgagttctgtgatctgaagggatgtggccagaagatttttcatagttttacaatattttcacagtatttttaggagcatgactttggtctgcacctgtgactacgtacaaggccattgtttattattcataaatgtgggatgtgaacgtttgcttgatctttttgaatgggtggtcctatatatgtctttatgattagtttcctttgaatataatattaaatggagtttgggaatagtagtgaactttacaatggcttctcttacatacttttttttttttgagcccagaagtgaggctttttaaaaatagaacttcacaaattactgcttccttttgatactggatattcatgaagtgcagtgaaaatagggaataatgagtcattcttttcctccaggagaaggaggaacaaacaaatgtgaaaacatttacaatatctttccacagtccaaccctttgctcctccccggttgtgtacataaaagcatacacatggagccaatggctgctttgcagacatgaagctagactagtggttctcaagactttgggctcaggacccctttatctttttaaaaattatgggccaggtgtggtggctcacacctgtaatcccagcactttgggaggccaaggcgggtgggtcacctgaagtcagaagttggagactagtctggccaacatggtgaaaccccatctctactaaaactacagaaattaggtgagcataggaacgtgcctgtaatcccagctactcaggaggctgaggcagtagaatcacttgaacccaggagacagaaattgcagtgagccgagatcacaccactgtactccagcctgggcgacagagtgagactccgtctcggaaaaaaaaaaaaaaattatggagggaccccaaagagcttttgttcatatggattttgtctattgatattcatcatgttagaaattcaaacaaagaaaatatgtaatccatttaaaataacaataaaccacccattacatgttagtataaataatatttttgtgaaaagtataattttcaaaataaaaaatcatgagaagggttgcattgttttatatttttttaggtctctttgatacccagtttggtgtaagacagctggattctcgtatctgcttcagtctgttgtgataggttgttttggttagtctttgagtatctcacgttacacagatgtgtggttggaagagggaggaatatttcaaccctcatttcagataattgtggatattcctcttgcacacttcaccaaaactcaacatgtgatagtttcttaaagcttagtaatgcaatgtgaaatcactattttttttcctcctctactaccttaaaatccatccaactgacttgccctttgaatgatcttttacgtgtgttttatccatgcaggcatatccacatgcatccatgcatgtgatgtcataccccggtcatttcaagaaaaactatttttgaaatgaagtatgcagatttctaaatagtgatagttttcatcatataacatcaaaaattttcatttgtatcaccgccaatcttgtcagaaaagttgctaagtctttggaaggtgtcaagctcatagttagagatacaagtttgccacatacatagaactgaaaaccagagtcagtcaatgtctggcacagtcattctttcaggtaaaaatcttgtcccaccaaaaaagtggctggttcagcttgcaactccaacagctgcagaagtgcgtttctgcaagacaaccatcaccctccggtagccagcaaaaatgctttatgcatgctttttccatgtcatacctgagaaaatgaagacatggactcaaaggtcgaaatgtttaaaaatcggtagcacttctttttttaagtgtattcagagcatctgtgagacttttttgtttgtacttaaagagcatgccagtgaataatgtgatgatgactagtacagtttggggctactactttgattcatgttaatcaccagcatgtttgcaccatcaaaacaaatttcaacacagcaataaaaaggcaagtactgtatctgaattgttttgaaaatcttattgatttgtctgaaaagtgatctatcttttcagtattatatattaatataaaatattatatttctcaacatacatgtacagttataaactagaacttaatggagaaaacgaattggaacagattgccactattttccattatttttttccatcatttaactatgtaaatttaaagtcttaatacttttttgaagtatacgtaaaaatggagtatgctgattacattttctatccttgaagaaagttgagcttaagcactgtcagattttcaaagccatatggttatttctgatctaatgttgagatgccaatcatatagtgtatgcatttcagtttagctttaagatcttgttaactgcttttagtacccctgtgaacacatcagcaaaccatcttttcaccagacagccaaaggtaacctccggatgtgaggcagtgagaatcaatatagtaagggtatttttagggactgttgatggattgctgtattttgagcttaacttcaagtgccaaaggccccagagctgactaagatgaactcaccatttactgaggacgggagaggccatcaggcacatagtgggatctgggattgccaagacaagatgtacacacctttccctttgtagttttggggagaattcttgtatattttttagtagcctaatacggtattttgatgaggactttgtaccaccctccttgctggagccaagtgttactcatttggtaacctcccggtcctgggaacacataactgtgaaattctaggacaacgtgatacagcagcgaatcaattaattctctgtatcaggagggatctggtacaccgagatactaatgactccgcgtccttctccaaaggcagccccacagaaggcgggcgccacgttaagctgtgctgctgtcagcaagctgaaagctatgggtctctgacacggctctcaattgctagcaggtttctctcattgcacctcatttgcatctgggacatcaattagcatgtttgttgaggctaattgaatgaaactcaatcatagctcttaattgcttgactatgtgaaaagaaatcacattaatgcagctaattaagtgtacggcaatagatgcaacataattaggagcgaaatgtaaaaaacaagggatggcaaaggtgccggagcagggttgcagggggacagcgaggcacagttaccgagcaattggcgggttcggaaacaggtccctttgctctggcgcctgcttggaaaaaataagccgcatgatgatcatggacaacttgagaaggaaaatgcaaataggtttgcaattactactttttcaagctgttgaggggcaggagatggcacctctggggggcctggctcttgagtgggccccagggacttgttaagtgctgtttaaaagtacttggctttgaattaccctcacgccttgttaaagggtttttcctcttttatcttcgatcagcattttcaacaaggaacatggagaagggtagtatctgtaacatttgcatatcaaaatcaagcttcctgtcttaattttaccgaggtccctaactcagacccgtgaagggtctgcacagccccttgacttctacggaggacattgtttagtggttgtagctttaattcctcaagtaccaagctggggagagatgaaaaggatcagttctttcaaaaccagaaagctcagtgtcgtttctcttgggaggaacttgaagccacagatacatgtgtctttatctcccacctgtgtgtgaagcgctgagtcggagggcttttattgagtaggaaatgcattttgtaaaatttttaaaaatgtgcagtgccttgaaatataagaattggctattttaaataccgattttatttattttttttttttagagctagttcttctgaggttgtaacgcctaactcaggcaagaaaacagatcccttagcccatgctgagctaaagataaatgggttcccttgccgctttcgaatctggagagcagacacttggtacatttctataataattttaaataaaatatcgtggttattgtatgttaaaacatgcctattaaaagagcccatgctgaggcttagtcactatctgattagcctcattttagagcccataagcaataaatgctcaattacactcctgttattgtattttaatttgttaagaattggcattaaggaagaaagttatagcaagttgatatttttaaaggagtaactgtgcaagaaggaattcattatttacaagcattaactttggtttggaaagttgggtttgcatattttcagtggatattaatggaagtaaactaaagatgcttgagaaaaaccttttttaggaagtgaccaacactcaccactctacggtgtgcttttcctttcttttctcttttcttttctttttgagacagagtttccctcttgtcgcttaggctggagtgcaatggcatgatctctgctccctgcaatctctgtctcccaggttcaagcgattctcctgccttagcctcccaagtagctgggattacaagcacacgccaccacacctggctaattttgtatttttagtagagcaggcatttcaccgtgttggctaggctggtcttgaactcctgacctcaagtgatccactctcctcggcctcccagagtgctgggattacaggcgtgagccaccgcgccccgcctgatgtgcttttcatttgtcaccctcaacacagcgcagtcctgagaattcctgtgccgcttccagctctagctttccttccatctagtttaacagagttaattcaatagtaactttctttctgtctttggtctacatcctctcaaagttgattatgttttgtggagtccagcatctcaacttccaagtggaatccctttcgggggctggtgaagtcagatttgttgttcccagcccagataccaccctcccgttacccgaacccaccatgacagctttcctccaagggggctgtggctgactccagccagcctgccctgagagtcaggccatcctccctgagccaccctgtaaaatgaaatggccagtcaccagcctcgggtggccgggcacctctgctcccggcctctgggctgatgtgagatgcacgcgtgccagggttttctgcctggatagcctgtctgtcctttgccggggaatgcccggccttgcccctgcctctgaatttgccccactgtagcacagtttctgatcctttctccagtggtcttcagcccattgttcttcctcctggttctgaccctggtgttttgagctttctgtctgcaccaagacttccgtcctcaggggtcaccagggaccctgaaacatcttgtccctctggggctgatgtaggggagcctgctggggttctgtatttatctgccagagtgtcccccgccagtgtggctgtgccctcatgtaaagaggttctcctcccgcccgtcctgccgttgagaattcctgcacccttttcccttgagtctggtttgactccatgtggcagcctgtaagtcatgttggttgcgggaaggtctacattgtcacaccccaggctcacccacctgaccatggttgggcagggagaaaacagctcttctcatcctctgccctgaggacccacagtttcattcctttcccctgaactggaattgtgtactttgtggcttttgttgtgccttttcttctatcagcaaacatctacttgttgataaacccgtgactccttcacaagtgtgggtgttgccctgcaattaaaaggtggactgcttgcctgtcatcccagctactcgggagactgaggcaggagaatctcttgaatccggaaggcagaggttacagtgagctgagttcatgccactccactccagcctgggcaacagagtgagactcttgtctcaaaaaacaaaacaaaacaaaaaggtagacagcccgtttcctggaagccactgggatctcgctttggcctctctgctaccctaccctgtgtcccagcagcttcctcaatacacttggccaagtttccttgtccctgagacagaggcttccgacccttgcatagtgattctagaacttgatccaactatctctctgcatcgggtaactgccattgggcagttaaaagacagcagcccacttctccaccctgcctcggtcccttgcatccagcatgtgagtttatttggcagttcttctaaaattacgttggctgagcacggtggcttgtgcctgtaaccccagtgctttgggaggctgaggtgggagggtgacttgagactaggagttggataccagcctgggcaacctagcaagacctcatctctaaaaaaattaataaatgaaatggaattatggtcacctgaacttaattacttttaacaaagacaaatttattggttttcacatctaaagggaattcaccaagatgctgccaaagaaagagcatatttattcccacttcctgcatagtcttaaaacacttgaaatgttgtttttccaagagtaattttcaaatacagtcatttctctgtattcatgggggattggctccaggaccctccagaataccaagatcctcagatgctcaagttccttatataatacagcatagtatttatatataacctgcacacattctcccgtataccttaaatcatccctagattacttatacctcatgcaatgtaaatgcaatattttcttatttgtattttttttaattgttatattgttacagagggctgagtgtatattctttcttaacgtgtgatatcaagtaatatgtgtccagaatgcttaagatactgtgtttgcagacagggagtctcattaccagaaataataataataacaataataataatgagtgatgatgatgctgcactaaaggatcagtaactcactggccagcaggcccatcccccggctctcagttgcttgttcaccttccccgttccctgcccatcagccagtttccaggtagtgtttgactccacagtgagttaagtgagctgccagagagcagtcactgtccaccgaggcttccctgtagttctctgattgctgctggtcatttgcttccaaggcctagaaagccagataccccttggacatcttcctggttcttagcacaacagttgacctttttacttccagttttcacctgatttttcaccagagagcttcagtcttatctagattttaatgatattcccatctgagacagaaaggttattacaaaatggtttcctactccatggaattttacttggaatttataggaggagcctaatgtaccctctgataagcaagagttcaaaaaatcagattttgtgtgtagacttacttcctaatgacccttgaaggaggcacctgctgtgtctctccttacatctctaggtcctggattagttcaggacacagaagcaaaactctgatttaaatataataatgatgttaccagtactctatagataaaaatctcatgatttttaaagtactttccacagtggaagggtcatagggttttaactcatgacgtctgatagacccttttgttctaggttgtaaaaggtcttttttttttttttatctctcttggatgtttaacattttcaacaggattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcaggtaagcttacagcaaatgcactaacaaatcaagttcaacagcaacaggtggtccaggctcgaggataatgttggactcctaggttaagtggagacagtaactatcacattacagattaaggtttagaaacctgatcacttctgtggctgatcatttcctttaaactttcagttccgcaaatgccagcgagcaaatggtgctttgagtcacagctgcaaaaaccatgcatctaggcctttccagggctgcatagtggaaagtgaagttaacatgtgaactgggtttttaagatccttctgaaaaacgtgaattaacgttaaagtgtcaaagattaactcatttctgataactgtatgtatgaaagtggaaaaaccattcggagcaagattcagaggaaaccatttgacctatataaaatgtaaattctgtgttgttatattttaattatctgccattctttaatgcaactttagttctctgtattctcttttaaaggagattttttttcattcaggatcagagaaagctgtattttctcaaatgttgatgtgtttagaaattcctggcctctgtgcccagttgcaagccatccaaaatgacattgttcattttatttacgtttttgcaaataattgccctgtgtcatgaaccttcccatgtctgctcatcagagataaggagaagatcctcttgagccctcccataaacacacacacagagtcaggctccttcaacatggggacatcccttcaagaatttgcattttctcctgcagaaagtccagaactttcttctctcccacctacatccagtcttcttaaaacagatttctggctaggcgcagtggctcacacctataatcccagcactttgggaggctgaggcgggtggatcgcctgaggtcaggagttcgagaccagcctggccaacctggtgaaaccccgtctctactaaaaatacaaaaattagccgggcgtggtagcaggtgcctgtaatctcagctacttgggaggctgaggcaggagaatcgcttgaacccaggaggcagaggttgcagtgagccatgattgcgccactgcactccagcctgggtgacagcgagactctatctcaaaaaaaaaaacagatttctctcctatgagagtttctggtctttgatgctgcactttcctcttctgaaacatcaagtgcttttaaagagggatggtgctgactgcctggttctgaggcatgaacgacactggtaggtgagagcaagatggtacagaggagttcaaatttgggtccaccatcctgggctccgctgcatagtgttaggcagtcactgagctggttccttcccaccacattggggtgctcttgcctggcctgcctgtgttgcaggggggcggtgtcagaggagacaacatgaaagtgctgggaaagctggatacaaacacaagctgttgtttctaatcaaagttaaaactggctttatgctaaaggagtctttagtgcctcccaaaaaagtgagaacagtatttttccaggggcttctatgacctgctgacctttcttccaagacatccgtgagatttttcttattagagcggtgtgctaactatggggtgggaagagagaaaagaagggcacaagaaagaaaaaacaatccgtagtgagtaaaatgctgaaggctttattacattagtacgttacataaactcatgcatttattcaaaaaatatctataggccaggtgcagtggctcacgcctgtaaccccagcactttgggaggccaaaatgggtgaatcacctgaggtcagaagttcaagaccagcctgtccaacatggtgaaaccccatctctactaaaaatacaaaattagctgggtgtggagatgtgcgcctgtaattccagctactcaggaggctaaggcaggggaatcgcttaaacccaggaggtggagtgcagtgagccgagatcgcaccactgcactccagcctgcgcgacagagtgagactccgtctcaaaaaaaaaaaaatctatcaagcacctattttgtgccagaagttgtgcgcactgcagatacggagtccctaacctctagaattcttccatttccacctcccttctgaccatcacatctagtcatctagttacataagtaaaagcatttattgagtttcatttttataattttaaattgataaaaatgtattaaatagaattaatttaacttaaataaaaatttattgatctttgtaacatggtgttttgaattatgtatacattgtggaatggctaaatcatgccatttgtggagtttctaacgtgtgcctgagtcacagttcccgccttcaggaatctcccctgttgttggggagaaagacaagtagatggaggccacacggagccacaggccccaggagggctgtgtaaagggcagggcttggagacccagtgatgctgcggtcggctccccaggaggtaggccaggcttcaagggatgggggctacctgctgagtttgaataaaggataggaatttgccaggcacacagatatgaaggaagggcaccaattctgtgaagaagcgttcactatgtaaaagtaggattttgaacttcctaatcttgagatttatgttccttggagccaaatgccactgttgtcctaagggaaacactaatgtgtgattttaagtagataatacaaaggccctataaaccgtaccatatctgatggagtcggctgtggcatgggcctttctctttgagggagtgagttgtgtgtccttggaaggcatttcccattgcccagtttcattctctttaagagcccctgttgggcaaatgggagggttgcgacaagattgaaatcccttttccatggtcacagccctcagtgtgtaacaggacatctccgcaaccctcaaacaggttaatcccacacaggggcctggctgactttccctcttctctggattccaactagggatagagaagtggaggtatgaccttagcacagaggcgttgccactttgggaagaagaaagtgcctcacggccacagcagtgctaagggaagtggcaccctgaccaagcatgcgggtgaagtcatcagctggtgtgcggcaggagggcgcagatctcagatagcagctccctgtttattgctcagcttcattcttgggttctgagaataagccatgggcggaggcacttctgtaagaggaagcagcttcattaaaatcttgggaaattttaatttgcattcaccttctctaaacatgaacatgaatctgtaaagtgatacgttctttcttgcttaagaaattaaagcatttggggatttgagtttttatactctttgaaaattgagtttcttgtgctaaaatcatcattcacaaaatgtcctctcacctgaggaattccaacacagcaaattcaatctgaaataaattgaggctacatttaagagacgggacttccagctaaaaataggtattagagagctgtttttgccaaaaaattgaatacttaaccttattcttcactcttgactcatttgttttgtctcagttctgggtgaactggagggttttctttctttgtattttcatttttgtattcattttcttaatgcgattgaattagatcaacattttatgccttctcttcccgtaacttgcattcacatagacctgatatatgtatgagcctaaatctttgtggttaacacttattattgctttggaataactgtccatatatggaatgattcattcggttggtataaccatttacagggttcttgatacacatttccaaattaacttctaaaaggttttacatgaaaactcttcccatccatagccatcaccagtttcacctcacacacttgctaatgctattaatattattgttagaatttatgctaatctgatgagcgataaaaatgcctcatgttttgtttatttggatttctttaatcggtaatgaagttgaacagctcacatgtattaggtgtatgtgtttcttacgttgtaattaattgtttaggtgtatcctttgcccatttttgcactaggttctttttcttattgatatctgagaactccttgtatatttaggatatgaatatattttgcaggtatttccccagtttattatttgccttttaaattttatggtcttctttacataaaaaggttttccctcttttttatttataatcagattatcttttactgttgtgatttctactttaagctatttagaaaacctttcataatcttgaaaccagatcacagtttacatatatatacttctaagttttaattttattgtttttttcccttaaaaaatatatgtatgtgtttatgtgtgtgaatatatgtatatgcatatatatctgtgtgtatgtgtgtgtatacatgtatatgcatgtatttagcccctaatccacctttaatttgtttgtgtctattgtgtgtgatagaaatctaattgaattttttattcaaataaataatcaactgtcgtttttctctttgttgaattttttttctttccctattaattccatatgttgcctttgttgtagaactcaatcacttcatcaaatgggctgtgtttctggcctctcagatgtgttccgagacctggtgtccctgcattgtcttaccttatgtagatttaccacagtgtcttagatgtatgactccgtttgtatctggtagtataacacagttgaatatttctcttttatcttccagtttttcttggctactgctgcctgcttatttttcctcaaatgaactaaagagtaacttgaaaccttctcctccttgataaaaataatcccctcattggtgcacatgacatcaggacctcccgaggctgtgatacgggcacgtaaataaaataataaaaataattctatcatggcttttaactggcattgcttttaagctatgaattgtggaggaagtggcatctttactgtgtggagttccttatcgtggaacactgttctttcccagtttattcaaatttgtattatagcctccagcaaagttcagcattttttttttttatttagctgctggacatgtcttgttaatctattctgtttataatttttggtgcattgtgaagctaatcctttttagagaggcggggtctattatgtcatctaattggtcagaaataaaactcctaatttttgtgttttctattattcagccatcttgctgaactcttgttagttggaatagctactggatgtttctgttgattctctagcacacagtcataatgcattccatatttcaaatactataatgcctaactgtgtgccaccagtttactgatacagagactggattgtgttgcctcctgtgccattcgtctccattgttactgagtctgctgtatgcccacccttgattaatgctctggatattggggtggggggaggacaagacgtctctccaggagccttacactcaagtgggggtggaggagtccaaagataaacacacaagtaagatcattgtaaggaatgataagtgctgaagggccatatggggcaattgaatagaaaatacctggaggggctcgggggtggggtattcctagcatttgggaagtgatttgcctgtattgaaatagtgactacatttcacactttaaaatgctggaaatgtggtcatcttcatgtcagtttttgccatgggcttgggagagaggaagaaacacgcactgtcagagcagctgccttgtgcactgctgatgactgggctcaggccaccctctggggctcatgcattgaggagagcagaggagctgcaatggtgatggggtggctctgggttccttgtggcggtcgtggagttcaggagtgggctggggcacagcagcaggctgtgcgacgaaagcaaggagagctggccagtgttgtccctgccaccaacacccccaggagagcatgcatcggaacaggcagcatgcctagggagagcagaaccttttgatgtggatgctggtgctcaaaaaagggaaacagagatgattgtgaaactcaaacatcctcagtctcagaagaagagaaagaaatggagaggcaaggcagccctgaccgtaggtggtatgaagtgcaccggccagctcacagccccccacacggtaggtctaaatgaaacccgccagtcattatgggccatacacctgctcagagcccacaaccagccttctggttggccaaggctgcagagaaaaccccttcatctgcctcatcaacccacatgctcttattcatagataatggacaacgaaggtgtttgtgggaaccaacagtaaaatgtgaaggataactgatcttagtaagagtgacattttagtgaaagggaatttaaaaggaaattataactcctatcaacagaaggatttaatacgttagttattaatgatactcataaaatgaggcaaacagagagcacgtgtttggcccagcgcagtggctcatgcctgtaatcccagcactttgagaggctgaggcaggcagatcccctgagcccaagagttcaagaccgattaatctaggcaacatggtgaaaccctgtctttacaaaaaatgcaaaaatttagctgggcatagtggcgagtgcctgtggtcccaggggagactgaggtgggagaatagcttgagcccaagaggtcaaggctgcagtgagccatgatcatgccactgtactccagcctgggcaacagagtgaggcctgtgtcaaaaaaataaagagtatgtgaaaatactataggagaaaaagttttatgaataaagattgtgaaaataaaaaattcattagataaatactgtaaagaacgtggctaaagacatgttggtagtcaaagatgtaacagaagaatatatgctagaagcaagtaaggatatctgaagagtcaagtatcaagttggatgggagaggaggctctgcaaaaatacaaataaaatcttaaaacacaccaaaaataggagaacaacaaggttacctacaaaagaagagaaatctgactgtagacttctcaagagcaacatgcattcttaaatataatggaaatattccctcctaaggacaaataattctgaacctagaagcctatgcaaagacgactactaatcaaatgaagatagaaaaaaaagacatctttagacaacctacagggttatacaacatctctgtcttaaagggttttgaaaaaattactgaagggtctactccagaaaaaaaaagaagaatccaaaagatattcaggcctggttaaaccttcccttcctcattcaaggtcactggcttctcaagatgtgcatggccattatccacttccattcttttggcctggaacttacatagtcttaagttgccattctaatgaggatccaccagaagccacattttggagaatcttcccaacttgaatttcaggtataggtccagagaaggaggtaaaacgtcaaggtattttctgacatgaatgtttggccagcctagtttggtgaagctgtatccacatgtaacaatgcagagttgtattagcttccacagttattttcacatttaagtagagagcaggaaaacataatgtccaagagcaagggtttcggagtccaaatcactgaatagaatcccatttctcctgtctcagacccttctgaagttgtctcactaaaccccagcttccttgtttttaaaatggggaaatgatgtccacctctgttctatggagaagaacacacggcattcctttgaaaagcttggccgatgctgacttcacagaattacatcattaattcatcatcatggttatgccaaaagcaaggaagaggggaaagaaattatgttcttgaattaatttttcaaatacaataaagcattgacatagcctttgagtggacataatggacatagggcttagacttcacaaacccatgctccccaacagacagcatcccactatcatggcagcaagggggcagacagaagaaatgctcttctggactttcatggatgtccatggagctgtctgctccagttctgtgtcctgtggtcactttattctgtaactcctggttgtgacatttttgttctaggatgacagataccttcttgtctctaaagtgtgtctttgttgggtttttgcaactatggatatgtttttatcctaaccagattgatgcttagacctttgtcaaaggaatcctttccccttctcctctacatcccccccttccctacttgaggcccccagcggtttcgaaatattaaagccttcaggagggttgaagctgattttccaggggaggtgggggaggcggggacagcaaatgtgttttgagtattgaactgccgttgacatctaaagtctcaaccatgctgttttctccacacttcagcaatcaggacatccagcaaacccataaaaaaccaaactaatagcatgaatattcagtgacctagaatactaattattgtcatgaatattaatgtgatcggacttgctctttcctctcctctttctctctcgtcctctttctccctctctccctctctttttttccacttagccggctctaaagatgggtcataatgagagcatttaagagggagcgctctccgccgtgacagggaccggggtaataaggagagcttgattaacgtggtgcacttgggggagagatgagaggcttcacgtggtcctgttcgggggaggcaatgaggcaccggcggctctgttgctgctcccggagattaatgaggcctaagagtgcattaggaacagtgacaaaggtttgatctaatgggctcagtcatttttcctttgagtgacagacgcacagaagtaattggctgtgcagaatggcagctcattggcggtacttaaggatacattatccccgttgtgtggcccgcagaggctgtttatcaaaactgctcacactgcagacgcggagtcgcgaagctgctgtttcagtggtaatagctattaaaaaaaaataacgtgacatcaaaactagacccgttgttgtctcatggaaagaaagtttttctttgtttagtttcaaacggtctagaaaacattataataactctggagtccggagtctgttgtgggccctggatgagcagtgtcagtccacacctgtcccctgccggcatgcggtgtggccaaggcttggtggaacacagatccttgcttcccactcatgtcgaccaaggtcactcgggagttttccacacattggatcttggttacaacatataaattggaagcttctgctaagtacccttctagcaccttggtagaccatttgcaaatggaagccttactggtcgagaattatttttctgaaataaaacctcaatatcagtagcatgtgatatctgctttcataaaccaggttttgttggaattggttttaatgtctatttgacaatttttagggaaaatgttaatgttttgtgaggcttctcagacatcagaaagttagctaaatctgacattagaggacactaaagttcatcttagttctttttaagaattgcagcatcttcagcttttatgagcaatgcgttctcactattagttgtttccgtgtttatacattgctcccactgaggtttaggcaaattcgtgtggtattgtttccatcattaaattgtaaactctttgaggcatacactgttacttctctttctttgttatcctctcttagttttgtgacctagcaattattttctcattaggtatatattcctgcatgttacccatcatgttaaatgtaagtgatggatgttgaggagattagttgctttcctgcagataatgttcccctgtagtagctctctgtggtcctgagcattggtgtgtaattcagaagtaagtattgtacttcctaaattaaggatagcttcaattatttgaactctaagtggagtgttcttttctgaaagaaccaactaaagcaacttgattcctgatgatttcagctgagacatatcaggggatggccaggaccttgagttggatgtggtaacaggtgtgcctacaagtaaataaaaggtgcttcaaacactttttttctctcaaaaatgtgtgtgggcagggaggaatagtgtttcagctgctgaactgatgcttccgagaccagcgaagtggtctgcagggtcagctgtgggaaagaggaggtgcccggaagagcctctgtgaattacccgcgccccctccaccagggagccagctgccagccccgggggccagtgagaaccgaggccttgggaaagggcttctggttcttccaggctagagttgagtccgtggcttccctgcttcctgcagtcctttcccacactggcagaggagagtttttcgaagtaatcgtgacatttttccatctcgaaaccttgtggcccattgttttgagttaccactcatatagtgaacgtttgcgtttctggagtatttctagggagtggtcaaaccccgtaacatcccaaccagcaaacctgtaaaacccgcctcatgttatcagacttgtgagcccggggtactccttggtgctttgtcttccctgtgtcattgctggattcagttgtgagatcattttgtaagaactggaaagcagagaaagaagtagtagtgaatacttctcaggatagagctgtggggccacctgctcctggaaggggactgtaaaattcagagatgaccggggaacgctcccctcaaaacagtgttgtcaaatgaaaatgaatttcatgttaaaaacacacacacacacacctgttgcatttatcatataaaggagaaagaatattgtaaagatggaaccgttattcatggcaaaggaagacaccaaacaaagaaaaattcttttcttctccgtcttcacaatgcttacacccctcatcctcgctgttgcatcagcttgtccatataacccataccaggagatggattgtggccaagacaagccgtacgatggcgctctccataaacactgtcggaatctggagcagcacgtgttccttcagcagataaaaatggcaaaatgagaatggcacacattgttttgcaaaggtcggaataagactccacgttttaggaagtgacgacgaaccgtctaattctaggatgttgaattctgcttggccacgttgatgtatttagtagtcgttaaatttgtcattgcaactgggtctggattctgtatattcttttttctgttatgtagaactgtgtggctggagaaagcaactttgtctttagaataaatacttacacttatttctaaatataattacttaaatgagaacttagcgtctgacatggtaaatattttgtcttaaattgtaccaattgccacatgatatccactcccaacatggagcagtaacccagggatgggagggaagggatgactctggcgctccagctcactgtcacctgctgtcaggccatgtccttcatccgctgcatgcgcatggtgccccaagcgcagggttgttgttttttttctctccttcctttcttttgtaaactgtacctctgacaacattggcatcgctctgatcatcagacctttgggatgctggaagatggggggtgccgtggagttctccacagcaccaagcacttcactagttgatggtgggtgttcagtaagtactcacagagggaatgaatgagctcaagcaaagtgatgccaactacagcactaaagcaaacaggaggcagatggcatgcacagttcatacatgaagagacaccattacaagggaaacataaggaaaatattcagacattttagattttaaagacaaacaagattagcaacatcaccattttaagcttttgctaaaaaactgtagagataggaaaacccactgttgatgagattaataactgatatctgcagaggttttacagtttacagagtgctttacataatttgatcattatattaaccacatggggcatactgttatcattatcaccatttcttcattattattattatccacttagaaattatggactaaattgctttaaagatgcccaggttccatcttcttttagttactggtcattaagaaaattaattagcaacatatatcatgaatcagaaagatatattatgctgtttgttccagtaataacgctgctgagaatttcttctaaggaaaattcaaaagtagaagatgtcctttgcagtgttgtttatagccagaaattggaaacaaccaaaactatccagaagtagaaaaatggtgatataaattatctacattaaatcaataatgttacatatctaaaattatgaagattacataacaacatggggaaaatggttaggaaatcatattaaagaagtgtataaagttatatcttttctgtggccataaccaagaacaatgtatgcatatgttcaataaaaaattgatctgttagacgagattttggtggatttagtttacattatttgtatatctgtacttttgccaagtatattttaacagtacaacaaaataggcccccattatttttttccttgacatcataatttagaacagggagaaagcagcatacaatgagctgtttctacgttgtaggaaagagctgtgtaattccaggatgtggaatcctaagcctggccacgttgctgtatttagtagtaattacatctgtcattgtgactaggtctgaactctgtactctgtcttgataaacataacatggaaaatctcttaactaaacaaaaggtatcaagaaacaccagatttgtgtcttcctagtagatatgttgaattgtactcttttacaaaacaagtatcacaggatgcagagtcccgaatgcctacatcttataagatactgaatgtgtccttggaaaaaaaatcctctcagcctgaaattccacttgccaaaagcaaggcagatctccaatgcaaatacaggagcgaatgggccccattcacaggccttaaatcgtgtgtctcactttttatggtagtgttgtgaattctgttctttttgggtttgtaattagaggacagaacagatggcgaaggcctagtttgaagtgatgtgactgttaacgtcgcctccttcatccagttgtgattccagggaacccggttttcccacacatgcgcacaacgggcgtggtgcagctgtagggtttgcaaggtagccgctcacgctgagtttttacagcatttgaagctgcctgtgaatgagattggaccgaagaaagccgtccctggatgtttctaagggtgaaggctccataggggaagggtgaattcttgtcaatcatattcctgtaattaggatttgttaaaatagaaggtatacaattctgcagtgggaataaacgtctgttttacactcaagtgctcatagaatcctttttggctttttccccgccctctttctatgtacatgaaagttcctatcgccatcaccaagagttgctcctcttttcaggcttacttaaccaataagtcaaatgccagctattattttcctagttaaatgctttggtgaagttaagtcctatttgtaaagacagaccaaaattggaaggcgcagggaatgaacttttgtattttgttattgttattgtaaagatttgttgatgaatctttatttgaatgctatgaaaagccatcatttcagagtatatttttaaaaatcagaacaggctatttttaatgtaataagctaatagcttaaaagagggattctgtctttgatgtcatttggtggatgaaaacattcttgttcaatagaaaaccagcatctttttcatgctcatttgagatcagttcaggcaacatactgatattcattcagatataaatgccatattcactttgaaatgcaaattgtgtaaagaaaaatagcatatggtggaggtaagtaccttttcaaatcaactcttccactttagggatataagtacagctaaaattattctttggaaagaatctggcgcttttgacacatggaagcttgcactaatcaaggcagctcagtaagcacacacacatatccatatcaaggaagtggcgcagcgaggacatggattagcatggtaatgcagtcaccccctgctaatcggggcgagtaccagctgatccgtagatggggtatttgaggaaacactctttctgagttcagaatgggccatgtcgtcagtcatgtatttcatggtaacgcaaataatatttgggggacgatgccgaaaaggtccttttatgactgccttcctgtggaagccagcatcctatactgtttggggctgggccactttttaaggacttattgctggtacagctgtttccttgtacaaccctgttctgtctcttacacttcctgacctgacctctgcattcacaagccattccaatgacattttctaggtttttggataagtgttactggtacaacatacacataagacgcacagaatcataagtcatagccacgtttacaggggccgccactcacatccagaagcagcaggtagccagccctcatggaccccttcctgtcccgtgcacccccaccccaccccaccccactcacaagggtgaccaccatctgatttctcactccgtagatgggtttcgcctgtccttggacgggatcctaacagttggcactctcgtgcttgtctccggctctgtgttctgtgtgtgatgtcaccgcagttgtggcccgtgtcagtagttccttgttgtcattgggtaatgttccgttgtgccgtgatgtacctacagtgatggacagtgccgtcattcccagcgtggggctgttatgagcagtgctgctctgaacattctagcacctactttttggtggccatgtttatgtgcatctgtatgatttaaatctgaaagatgtgaaaggagaagagaaatcttaaaggaggaaaaaaaaagaagtggacttgaaatgttttatgaaagctttgcatccagtaagtcaattagaagagtggtgtaggttgtcctgggacagccccgagcttaggaaacccccgtgtttaataagagcacgtaagcaagcctgtccaaagtttgccgtggagagtgacatttactgtcccagacagcaaacagatgtgcccccctcgctgggagtagacactacccctgtctcaccagtctgttcattctgtcaacatcccttgcaagatactaccttaagtctaaggtagtatcttaaggtagtatcttaggtagacttaaggcagtatctcccctttccatctattctttatctagatgggcctaattccaaagtctaaaagctgcagtgtcccctggagcctctcctgtaccttccagcagcggtgggctccctgaccctcatactttctggctgctcttgtgttactctgccttgcgtttgggccacatgtggatctgctgtataccttctactagactagattgtaggttccctaagacagggactccttccttcattgtgcccaatgcagtaggggctcagttccatgcggctgctcggcccgctagaaggtcaatgttagaataggcggcagcttctgcataccgggtcccatcttcccctactcgcgagttagcaggttagcctgccctaggttcctgggtgatgagactcctggatcaaaatgaatgacagtctcttgcagcaatagcaatagtgagagtatcagcattgtcatgcactggcttcccaagcctcagttcccacagggtgacaccagcacacacagtaactcatgttgtaagaggaaccccaagcttaggaaaccccatgtgtttaataagagcacgtaagcaagcctgtccaaagtttgctgtggagagcgacatttactgtcccagacagcaaacagatgtgctccctcttaaagtagacattacccctgttgtaccagtctgtttactctgtccacatcccctgcaaaataacacagagcagagagcacctgcccgtgtccacacccagaggaagaagaaactgaggcccgtggagagctggctgccagcaacagtggggtgggatgtgctggtagcagcagggagagtggaagtcagggaaggatggaagggaagggaagaatggagagtactcaccccccaaagtaggccacatccttgtacttatccccgagtataagtgtaccctcggcttccggggtagaagcttcctttaagacccttgtatttgcgcgtgacttgaggttggtgaattaggaccacttgttagactcacctcgtctactccaggaaggagggcattctaatctggcttttacaatctcctccttctagggaaatacagacatgcctgcaaagaacatttccaacgatggtgcgcagagttttcccacatctaaacgaccccagcttcatatcttactccttagacacgggaatgaaattctgtagcaaaacggctgtgtgttgaggtggtccctgatggagacaatccagaggctctctttcctgggcattactggggctgagggttggggcgtggcttcctgcagaccccacgcaccttgcaatcctcatggcatttctgaatgtagctctatttctattagccttcctgaactggcaactttaatgcctgggtagcaagcacttgggcgtttccttaaactcaccgtcttagctatcaggtctaggtgtgaaaatgtgatttaactaatcaacacagtagcagcagagcttggtgtctttgttgactgtcggcggccacgtgggtttaggtcccctgcccttcagcctggttgctgggtatgaggcctccacctcggcaggactgcttcgagctgacctggactgtgtttagaacagtgtttggtgcacttgtatcctagcttgtcttgatgtcaggatccttacccctcaagcaatcaaaaaagttatccagcttgtttcacaaatgagaacttcagaccttcagccttaattaataactcattaacgtgaaatgaattccagtgagtgaaaacagttgccctcgagtactttgagtgagaatacagtgattttaaacagaggctttttttatgcttaaagatatttccaaaagtgttcaaaactcctgtgtggtaacacatagggcaggtattgcttgatgcttacataacaaaactggatgccaggacagcattagtaggtcaattagttaatgacattcattcaagaacagaaatgagattacatattagactctgtatgcatatctgtatcaaaaaatgcatgagaaagtatgacactataattggatatggaatgtgcatgattattaaaaagattcactccacatttgggggtggttcgtttctttgacgggtggatttactgaaagtaagtggaaatgcctcaaaactgtggccactggcctgggactgctgacacatggcacgagatgctccatgggcgtgttaacccagcatggcagcttccacagtgtcgtggctcaggtcgtggaccactggtttgcctcagagtttaagcagatgtcttcatgcatttacgttgaaaggcaggtactgtgtttggatcccagaaacaatatttctgaccctgtgtaattttttttagtcaaatatgtttctgcattatcacacaaaatacttttgttttcttttgttggtttttctgaaagaaaatttaagtgatctcaaatatagtgaatgggtatattttgaaacagagatttactcccttaagagaaaatcggaaatgttttgcttatggaatgagcctcctcctccgcatatttttggaaggtcctgaccagaggtcaagagtgaggtgggttgagtgcagtggggtgtggggaggcaggtgtgagcctgggcaaccccggaacccactcagatccttcagacagatccagagagagaggctgtcagctctttgttcataaacacaggcccacagctcccagatgctttcattttctaagtgatgccagaaaccaccaatttttaaatgaaatctcccaatttaattctactttgaaaaaaatgatcaactaagtaaaaatgtctctatgagctcagcctggacgtcaggcgatagtctgtggatctgattgaaagtttcacctttatcacggtttgtccatgtatacaccttgatgtggcccaaattcagtcatgctgtttcagtgtagtcccgcagtgggaagtgggtgtggctggggctggggggccttcacgagctatagggctctaagagtctgccgtcagaaggattgtggatagctggtctggtgtcttccatctggacaccaggagcatgtggtcttgccaggaggttcgtcaccccagaggttccaggttggttccttggggactctctcaggaggcagaaggtgggctctgagccacaccctcagagctgctgcaccagcatctcagtggattggacttgtccttgtattttgatggacagacagaagtttgaaaaccagtacattcacagcagcattcacagcagagtcctgttgtttcctagtgtgtaggcttgaaggaatctctcccttcctttttggcagtgtgatgtttggccatgagatgaagaactcataaacctaagatgagttcttgatcagcaacctccattggaacatttcgtggtcccttgtctggggttgagattgacttggctctccttactgtgtgttgatacttacttctggagctttattgcaagtagtcagtgatggatgcactgaaatactgtcctctgccttttaaaggaaattgttctggaaggtttctaggcctggttgtcatcggagaaccactctccagggagaaggagcaagagaagcggtgctctattgagtgccatgttgtcatcgttgtcccaaagatggagggacagacagacacagtgaaattcctttttgtttttcaggtatttggaccttgtgtgcctaaagctggtataaaatgaggtctgtggacagatggcatgcttaataatgacttgacaggggtctgattgggcattgcagtgtggaaggaattacctccttatcatcttacctacacagcaggtgtccctgcaggtagagcaggcccagaagtgcctggcacagcagtcagggtcccagcaagggaggtgcccccccaatcgcacccccagctgcttgcaggcatcttgtcattgtccttttccacctttgcggagtcctttcgcccaccataacagtgtcagcagtgtctggaagccttttgtctgctcagaattcacgtgatgaaagcggaaccaggccagggaagccccggcagccactcttgggaggcgcctcctccccaaacgcaccttcgatgggtggatgtgtgggattgagagagagaaggggaagagaagcacacaggacagtgcaggcaccagggctggcagaaatgcaccaggacaacccatgggccccaagggccaaggagagagggggtcacccagcaagacaactgctcggggaacgagccctggagtcagcacccaccctcaccctcctctctcctttagattcctgccatgctcaccattggttgagcccagtgagaagctagaaggtgctggagccaacaggtgcagcccatatgggtgccttcccaggaggagagcagggcggagaagggatgtgaagggatgtagcaggaacatggtgggcacgggctccaggagggggtcccgagatgggagtatctcctctgctcctcagggatgctgccttctgtggggtctgaatgccctattgtaatagggatctggctaaggcacacaatacccagaggacagccacagggtggcttcgatggtggcacgtggaaaatacagggaggagcatgagtgctccccttagtgccatgtcgccagctctgggctgctcctccacgtctcttaagatgccacatgcctggcccacctcccccggctgctgtgaggcctggtgcaagagcaagcatgggagcaccacatggcactgtcattcaagatgtgggctccaaatgacgctgtgtgtttctagggcgttagggcacgcccatgccctgagatggagctctcagaacatcagggcttgggggcatgagaaacggcctcaagaccctacatgtaagcaggggagcccagacccgaggcttccgagccactgccctcgctcctcccacctgagccccttggatgccagtggtctgccgtggtggagttttgattgtgattttttgttttatggtggtgactttctggctggagtggtttttttaattaatgtgcacacagattgcctgggatcttactaagaggcaggtggcaggtggggcctgggattctgcatttctcgaatgcctcttggcgatgctgcttctgtaggtccgaagaccacaacctctgtggctttccgatccttccttccctggggcatcactgtgggcttttttctggaatcaagcagacctgcctatgaataatttcccttatgacgttcagaatgtactcagttcagacaacagcataaaataggtatcttttctttttttttaaggcagaactctattcttcaaagccaaacgcctcgtcgtttgttaatcgctgattgggtgtagggctcgtacactacgcttcagctcgtggttccgtggcttcccagtgctgcacgggatcgcagtgaggccgcttgtttgaggggagacctggttcctgcctctggcttctcatccatatcaccggagtgcttttgaaaatgcatcttttcccaagccccattcccagagcttctgaatcaaaatctgtattttttgaagccactagttctaaaaagctccacaggaaattctggtaattggccagatttaagaactgctaatatgggctgcgtatttattataaaatcctgcactgtgaaaaacttatgttgagacagcttagaacttagctggttctgaactaaaacaattggaagaaaattttttttaaaaaagccccagtacctccgaagatctgcaaatagacctaacagactaattcgctggcagcagggtatgattggctgagctttagagaaaggcacttaattatgtttttgagtctaaaattggtatgaccagataataattcattttgatgttgagcaactgattcaaatcattaagtatacaatggaatcatttttcatcacagcccctgtgctctatgaagtcacgcaggttgtttttcctctgcttagtcttttcaaggttaagagtaaacttatctggttgaagagcctgcatttcctccgtgtcgtgtctagggactttgatttgtgttgatcataaagtatggcttccccatgaaaataatcctctggcaccagacagttgactctcaatgggtgatcattttctgttccattggtagggtgacatggccgggctcctggagcccccatcttgccggcctgccggatcgcggtgtctctgctaagactcgctgggtcttttgtcttcacttccactcgatgttgcggttgcggttgggttgcgtctttgtatagggttgttcggtgcgagccatctgtggcatcgggtcccttcacattgctttgtcaggcaccatcaagattggcgtcccccttttattcctcccgaatagtttctgtctggcgcttccgtttgccatgcaggcaggacaggggctgctctcggtggtaaggtgcactatgtgccagcgtgtgggtcccatagactaactcgcgctggtttctgtggtctgcagtccgcggtggtgttcacctgacttgtttattcctagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtggtaagagggggctcagccccacggacccgcagccacctcaaggtccttcgttgtaagccaggggctggacaggacgccctaagctctcatgctcctctgggagcgcagcaccctgtggggcggctgcatcagagactcacatcttgcctttcatctgtggaacgttttgtccttgctaggctgtcttgcccctgtcatctcatctgttcctctttggcacagggaggaggtagtcatcccatttggtcagtttggaaactgaggcggcagacagggcaactggcttacccagggtcacgtgacagaagtggcagcgctgagaaataagatctgattttatctccccaatcacactgccctacgtggcgtggcccacactcttccaccactagtgcacattttatatcattagggtgaattcagtctccttgtctgttttccagaattcctggtgtaccctctaaattctggagtcccctttgtaatccttcagttttcaaattcctttggcattattattattattattattttgacaagtgtatccagctttttggggaataagcatgcacgttggaaacgatctcgccgtctgtgtggagcgtgaatgacgcagcaccgagggcaccctggtggctgcagcagggtttgcctgtggcgttttgtctctggcctgttcaccggtatttaaaggaattcccactgttgtatgtaatctatcagacggggttttagagtaatcttagcataatttgttctaattaaaagattcagcatcaggtcttccctgtagacccaccagctgctgcagcaggacgtttgctttgggtaaacatcatccttatttctagtggctccgcagacgccaccaagcagaagccttaaaggaagacatctccaaaccaagccgggagacgcggagtcagcgaggtagctccacaccatagcggtgcgggtctggaagagccttgtgacttggagcagacacacacagcgtcacgcggctgccccggctggcccattcccatcccagcgccagggcttgctccttccctcaaaagaaggtgctttgttagatagcaaagatctgcctgcagcttcttcaagggctctctaaggctctctgcctcatctggaatcacgatgataaccctgaaaaccccaaacaaggaggtttgaagttatgataaattaaccgtctacagtttactctctttgtaaccactgcatgccccagcgggcctggtagtcagcctttcatcagccctgtgtgtgctgcagctgaagccccgccacctgccagccaggcagcctaggatgagcctccgtacctccatgagcctccgttttcttatctgttcaatggacacgttctcccctcccttacgtagaagttaggcatgtgccacaacacaggacagtaggctcttcgtgactgaagaaccactgttaatcatggttcctttaggaggagcagagagttcacatactcgtttcattatcaaatactttaaaatatgtattatcaattagtattactatttgataaggtttcattctgtggccgccatctcgtgaaggtgttcttgcatagggccacgtttgagggcgtggggagatgcacgctgggccttctggagccaggtgcacaggtgacacggacaaggccttgccttaccaagcagcctctgctgagtgagagtagtctaggtgccaataatacaggtgtttaagtattcatctaaaattcatcctatacagattttccttttgcacacttacctgtttgataaaaactcactaggtaactttccctctactgaatagctctttctgttgagctgtacgtatgtgcagtgggcgtttccacaccgccacatcgtgagacactgctttccagagcctccgtttggttggaagtctctttccatggaagtgggctgcattgtctgcacgcatgcatttgtacagtacccatgtgagactaaagtcgcctacgtttgaatgccagttttttattcacaaagcaatttctataatattaacacacgtgggtgtccattaaagaccagtatgctccctgacctcgtaaatcttgaaccctgaacatagaagataagaaacaagcaagcggatgccccaggtgtcagcctgctgagggacatggaaggagagctgtagggagagcccagggctgaaattgtgcaggtcgtttaaggattgatagagttgatcaaggaaagcttcccaaagaaaatcaaacttgagaaatgcttaaagaaccagatggatttttttgtgcaaaacagcaggaggaagttattataagcattggggcacttcggacaaagacccagagaggaggaaaagggaagatggaatagccacgagccgcagtgaagtgaaaggtgatagttggggtgcagaaaaatgaggagagaccagaagagatgagtgttgagagcccagcactgccaaattagcatctgattttcagacttgggagctgacattttacagagcaaagatccagaaagacagcagaatggtgcacagaagtctgattcctacagctttatgggggtcttggttgattcctgtattttctaaggatttttttttttttttgagatggagtcttgctctattggcaggctggagtgcagtggcgcgaccccggctcactgcaacctccgcctcccggactcaagcagttctcctgcctcaggctcccgagtagctgggactgcaggcacgcgccaccgtgcccggctaatttttgtatttttagtagagacggggtttcaccatgttggccgggatggtctcaatctcttgacctcatgatctgcccgccttggcctcccaaagtgctgggattacaggcatgagccaccgcgcccggcctttctaaggattaatagtatgtcataccggaaatattttgaaaagggagacaataatcgtaataataagagctacagtttattgagggctttatgtagataatctcatttgatcctcacagagtagatcctgttgttacctgccttctacaggggctgcctttggtacagaaggattaaatgtcacttgctcaaagtcacatcctgtgaggggccaggattcaaactcaggtggcccgattcagctctccatcactgcatgtcaaggtgtgcctccaggagcagcagcagcagcagcccctgggaactgcttagaaatgttgatctcaggccctgtctcagtcccactgaatccagtcctcaggggatgggaccaggcaacctgtgtatagcaagccctctgggatcacatggcatgctgaagcttgggaaccactgctgtaagtcctcacttcccaaagcctggtccacggaccaagtggcatttgacagctccggggatttggctggtgatgcagaattcaggctccacccaggcctgctggacgcatccttgtctgtctgcgccgagggtaccatcccggcgtccctctggttcgcgtcattcccccctttagtgtgctgcttcgtcaagtggccagaccccagcaatgtttagtgaacaccagggcacaggatctgatggacaacttccagaaaacgtgtttatgaatggatttcaagactcagccttggcataaacattccctgcagggcttagaaaataatcacagaagaaacaaacatgattaagagctttctgtcatgctctttcttcttaagttgccggtgatataagtcccccctgcccccacttccttttcgaatgtatctgcccccatccctagtctttggtttggatttcagagtcgcttactctgtgctggcagcaggaatgaatggggagagcctaagcagctttggaatacagacgcccgtgttggcaagtgtgccttcccattgttgtgcactcttactctaaaacataataatcacggcaacattgggattcactgtttctccgccccccgtccaccctaaattaagactttggctctggagaacttttcaaagtctcctctctagacacaccggtccccccggggtttcttcctttaaagcagctgtgagaaactcctaattagatagattcctttgtaggggcaacctacaaaacaggaggtgctgcttaaattaagggaagaagaaaagaatccatttcgtgaaatggaatgcccactgctttatgactattactgttgtaaggtttcacatttaagtacctgaggtttaaaattaaatgtctaatataatttggcgttgctaacatgagacctgcatctgcccttagagaaaatgcagacagctcggttgagggtttcaaattgccgtctgccggcttgcaagccgcacggaggattggatccctcctctgctgagtaccacatgctgctgagcgtaattttttaaatgcagaaacatattcatcttgagcctctgcattgaaaaaggccgttccaggagtacatgaaaaattaatttttttacattttttcccactcttctaagtgtttgacagaagtaatttttgcagcaagagagaataaaaactggtggctgtaaattcctgtcctgcaacctcttgtgtagattctttatggacccagaattgatctacatgtcagatcctgttgtggtttaaactgtttatcactgtaatggcagtagtgagcccgtgaccaccaacttataatcctgggtgaaagaaattggtgtttgcagtcaatgaagaggcagctttgctttattgatagattcagaacaattatctctgcaacaactattggctgagggttctcttgaatcttattggaagcctgtaattttttttgattaatcatttcctccataggtaatttcctctagaagcgttagccacgagtcagcatcactgtgggtagcaggggccctggggggtcgtatgtggcatacttggccgtcctgtcttacttcaagacaagatgcacgttgagatgcgtcacacctgtcctcagggccagagtgctcacctgcctgcctgcctcctgagtacctgggtgagcctggcccggccctccccgctggctcctgcctgggccagcctcgtcgggtggtctcagctaatgctgttgccatggcagcctcgctcccccagccctggactgtcaggttcttctgatagctccaccccatccccgattgcttcagtccaacagtttatcttctgccacgctgactggccatcactgttaatactgcatttcttcacgtgactcttccatgtggctcttgagcctcacttccctcggcctcccccaggccaccacgcagcctcgtcaccatcgagcacaaacaccatgtccatcttccacatggaaggagtgtatcacatgtgtgtgtgtacgggtgtatgctctggtccctgtttccttctggccacgtaatcattatatctttccagtagactctgtggttataaagcagccgatcctcaatggaaagcatttgagtttttgccagcttttaaatgtcttttctcattataaaaatgttttgcacgtcgattttgatgatgggggttcgaaacatgagtttcagcttcggaagctgtctgtcccacacttactttcggagccaatgcatttgaaccacactttccagcaagcatgtccacaccattcatcaattttaatcattatagttggagcattttttttctcttcttggatattatactgacaattttagtgtatgaccagcaggcggcggtaatgtgatactgccggtctctgacctggaagcttctttgatgggagggtatcagtgaagcgtggtggggaggaaatacatgtgttgacagcctccgctgttgtgaccttcatgcctaacactcgtttccctggggatcatcatctctgataactgagcttccaaaaggctgagaaaccaagaccatacttatcattattagccaaaattcaaacccagatctttctgatttcaaagcttgtaatcattcccctctgcttttttttttttaaggagaaacgcatgcttagtactaaaacattgtatcataaaaattgtttgtcttttgatagcgcttgcttttcaaggaaatatgttctaagatggatagacattttgtcttctctcactgatgctgaagtttcctttatcaattcttcccaaatcttggctggcattcaaaagcgttccctgggggttgtcatcaaccttcagcttagctcagtgttaaaggcccctgggctctcatctctcaaagctgggcactccctgcctcaccgccgggagggctgctcggctcgccaggctggccggcctaattaaaaggctgaccccgctcccttctgtgctcggagcctgctttcctgtctctgcatgtggccgaggagcaggcagaagcgtcctggggtaactggacacagggggtgaaaggtggattttttttcctcccaatcagaatgttgtaactttgtactttgtctccttagttccttcctatcagctattttcagcagtagctgctgaccaggggaaacagaggacagtgaaatgctgccccatgatcaaaaccgaacaggggcagcacatttcattcccgaagaccagaaatcttcatgttgttgcaaggcaaaaaaaatctagaaatgcttgtaaacagggagtagagaaggatattgttgctagttgctgtagtgcccggaccagacctcttggccctctggccctcggcgtgtcttcacctattccaggggctcgcagccaggggtgattttgtctccttgggacagttcgtgatgtccggaggcatttttggttgtcacataggggagggtgatgctactggaagctagtgggtagaagccaccagggtgctgctgagtgtgccacggggcagagaccagccccccacagccaagagttattcagcccaaaacaccagcggtgccacggtcaggaagccccgatctggacaatgaaagtttcgcttccttggccccttccagctgcggttgctgcgttgcacagtaattcagtaagaatccttcccaaagaaaggaaagccggtttctggtttgcaagagggtcactgcagccaacccagagcagtgcctgatcctcagggtgctttccacacagcttctcagagcatccgcctggcggcacggccggttcagcggcagtcctgctgccaccagcgtagatgtgatgtaacattcatggaactcactgcttgccaggcacaggcccccaggagatgagtgccagagccttccctgcttcagatgaggagatgagtgccagagccttacccgcttcagatgaggaagcaggggcagaaggcagttgggcctatcgcagcagcaggtcggtggtcaaggctagattcaaacagcctgtgtcataattgtcactaagctgttctcctgcccacccgaccgcctccaagaacgctgggtgcgcagcgtgtccccctgctgcgcgtatgaagacagggagggtgaggccatcagatgtgtggatgccacaagctgagacataatctacattgaaatctccagatttagagactacaaaatgggttgaaactaacaaattgaaacagagataaaatcttgaattcaggctcaacaaaccaacagtacagataatggaacaggagtaccggacctggtggggaaggcttgggtgtggtttgtctgcagaaacgctgtcaagacttacattctgcactaagaggacgagagaggttctgaatgtctcactgggctccgaggatcctttcgggggccacattttgagaaagacatcggcacactgggaagcacatgaagcggagggccgagatggggagaggggcctgaaacccacaacacctagcgtggctgaaaacctgggagggccggaggaccctctcaggaaggcgtcgtccaatggctgcccattatattcttgggggcgatttttaaaaatacttgttcctggggccagccgctagagatctagtccatttggcctgggatggaacccaagcagtggaatgtcccccaggggtttcagatgcgcagccagggttgagaagctctttcagagggacctgaatgatgtgtgtgaatggtggttataggacaaaatctgatcctgattctgtataaacccagagaattgaactgggagcaatgggtaggatttgcaggaaagacaactttgacaccaagtagtatgatgcagtgagacaggtcccagcgactgtttccagccttctcctctggcatctctgccttcctctcccttgcctgaaggccctctgcatcctttcccgatgaaactggggaacgtccccacttctctcccatgccaaaacccatgcctctccagcctctggagcttccatgtatgatctgttcctgcttggacatggggtagggcatcccttccacctctgaactcatcacctctcatcttccaagggactctgcttccgcggacaccctctctcctgtcccagcggtttctcccaggtattggatcactcccttcagcttacatacctgctcggccatcgctcagcccaacaccatggccctctgcagtttccacctctccttctattctccttctcaccacacgttccaggacactcgtctgtcctcagctaccacccacattctcttcaaccctctcccatgtgtcatcagcccagcaccctccaacactgctctcatccacttcagtcccaggagcaccccttggttcccgtggtaatcttcatagtgggagacctgctgactccacatcttgcttgaaaccctctctcctctgggcttctctgaagacacacacaggtttttcctgctgctctctggctgccccctgtgtcatcctcctttaccagcagacctcagacgatagatgtggcccagaactcagctctctcctgtcctccctgcactcctcttgaaataggcctgaccattcctctagactcagaagatacccaaattcacatccccagccatgactcctctctcctcattgaacgcaggtaagcagctacctgctcggaggggagttgggcggctcatgctcagcatatttgaagaactccagctttcatccagagcgtctgtttctcacccaccttttcaccatctatcctcccagtagttcaaaacacacccaaagcatcacttgcacaccctccctcggcctcacctcacagtctgttcatttgcttggttccctccacttgacctccaagaataccagctgggtttgtcctgtacctccacctcctctgtgttcccctggtccttctgctgcgtcggtcctaactcatctctggcctgtcattcttacttcccaaaagtcctctctctctgcagccaaattcaccttttaaaaaaacaaaacatgagccagattgccactccccacacccactccagtggcttcccactgccagtggaatagattcccaattcttgatttctggctgacaaggccccagctggtctgacccctgttttttgaccgcctctccatggctccagccggcggctttgctgagatctgggatgagtcatccaccagatagttcaggcttccgcccagacgtcagctccagcgtgtgtacatcactgcagacagccactctccatcccattctttgcggttacccagacttcttgtttttctcagcatgtattgtggcctgacttactctggacacattcttgttcgactcctacccagtcacaagtggtcatcctgcccctggcatcttgaattgttttcctagcatctgtcactatctgaaatgatcctgtttgcttatgtgtcttctgcagtaattctaactccaccacagagaggggcttcagggtcttgtctgtctccactttcttgactacctggagctgtgtccatcccatcatcacaatgtcattgcacggtaatatgctgagttagtgaatgagcacacttggatagcatccccaaataggaatagtccaagtggtggcaggggtggggtggcttggtgtatttcgttcgatttgcaaaatgagctccaaggattctgccagttttatatgatataatcttctgaatttttaagtatcttaatgctttgcatattgctttagaaactggttcttaacagagaaccagtgctggtgccccttaagacagagcatgttggtcacagtgtatacagtttatggcagaaaacactggcagcagtctcagcaacaggttcttaaattagtataagtagttagagttgaaactggttttcctccctcggatcatcttagcctgttcctgaatcataagtaaagtcagtggtgtaaattaatagggattatgtagattagatacatttcacaacaatttaatttcttatgtaacttcatttagtccacaagtatttattgaccacttactgtggccacccactgccctggccctgggagtggagcaggaatccaaacggagttcccaggtctctctaggtacaaaagaagaatcgacggataatcactaaggaaacaaattgaaatgtgctttgtcaggtggtgaaaagtaaaatgagggtgagcaggtgcaaggcatacgttcgcattctgaagtcaagtcgtgcatgcatgagtgtgcgaattcctaagcatgttttcaactgagaccatcacagcaatgtatctgttcatcattcattccattcacttgacaaatatataactagcgctttatcgtatgcagtggtgtcccagggtacattgggaagtgaccccagagaagatggacacatcagttgatccaatccaatcaaatgctgccaagaactcagtaggctaaagggagtgtgggatccatgcgaagggaagggtgtgtgcggctatggagctttgttgttgggggggtaagaagggcggacactgaaggcgaagcacagaggaaggaaggagcgttccagcccggtatggaagagtgaggaaaagcattctaaaaaggtttgcccgtgatcctgagccagcagaatgccctgatggatgtggcccagaactcagctctctcccatcctccctgcactcctcttgaaataggcctgagcattcctctagactcaagatacccaagctcatatccccagccatgactgctctcatcatttcctagggaagagaggaatgtgatttgaaaagatccctcttgagtcagcctgggttatcatctgctgtgtagacagctcatgccaggctgcgttaatcgagagcagagtgggctcactgcagacaacccgcgattcccctggttccaggagtccagtagccacgggtagagccgtcactgaaatttgcatctcgttctttggttcctttctcatttgcttggcccagtttttaatcaggtcacttctcatgggcctcaaggcaacaatgtgtcattaacttacattttaggctgggcgtggtggctcacacctgtaatcccagcactttgggaggccgagacgggcggatcacctgaggttgggagtttgagatcagcctgaccaacatggagataccccgtctctgctaaaaatacaaaagtagccaggcatggtggaacatgcctgtaatcccagctactcaggaggctgaggcaggagaatcgcttgaacccacagaggttgcagtgagccgagatcatgccattgcactccagcctgggtaacaagagcgaaactctgtctaaaaaaaaaaaaaattacattttaaaaatttcctagcatacagaagtctaaaattttgtaaaattatttagcattttattaattttttagtccccatgtttgcagctgcaaattttcaatttcagggggacttttttaaagatagaaagcatcttgactatcctagcttcaaattaggaataggtagtacagtataaaaagatttgtcaatttgagaccaacctgggcaacatggagagaccctatctctactaaaaaaaaaattcatttaattagctgggcctagtggtgtgcgtctatagtcccagctacccaagaggcacatatatttgaagatttgtcaaatatatgtgctgcttctccaactggaaataaaactttgtgatgttttgtgttctcaacattagaacgtctgattttataatgtacattttgaagcaatacaggactttttttccacatgactttatacaactcttgggacaggaaaatattcactttgtatttctgtggtttgctcagttccacaacctaggaacccaacaggttaagaaccgtcaatcatactgcctccctggtgactttgtcaactgttagaataacattggtcaaatctttttcatttcctccctcacttccttttgtagattttataaacacatgcaaaaaggcaaagacctaaaggacttaatttttttttttttttttttgacacagagtttcactcgtcacccaggctggagtgcagtggcacgatcttggctcactctgaggttcaagtaattctcctgcctcagcctccctagtagctgggattacagccgcatgccactatgcctggctaatttttgtatttttagtagagacggggtttcgccatgttggccaggctggtcccgaactcctgacctaaggtgatccacctgcctcggcctcccaaagtgctgggattacaggcatgagtcaccatgcctggccacttaaaattttggggggtatcgagaagaaagaaaggcatggaagaaatgagtgttggagaagagtggtgtttaaaatgaacaagttgttacaagatggttataacatggctaggtcgagagacagccagagatgggtgacagagggtggggtgtggctgagcaagcccactgtccagcttctccgttaggatttgtatgttactttggttttgcattcttaaacttctttcaatgaatatatcatgttacatcttggctttattatgtgacagataaggttattaacagaaagtgatattaatattaattatacaatgatactaaaaattttatatcacacagaagcagatggttatttttaatgacttaaaattttactcttttatatgagaagaaacattttaaacatatttagttataaatgctattttaattgctacattatttctgcagcgggatttttaaaatcttactatagttgcagggaaatatttctatgtatatttcagatcctcttaaattatatacttatttacaggaaacaattataattacattgagaaaacagaatggggggcttcaaattatcgataaatacatcacactattctcacacatgatcattccatctggtcatagttcaagaattcagctctagtaggaggcttactctctgagcattcatcaagttaacaaccttaccagttatctttttaggtactctatttttgtaatgtttgtagataaatagtcctttgctggatttttaaatcataactgggtaagcatacgacttaagaattatttcctatgcaaaatagaatcagaaaattccatctacttacaaattctttatgtacttccacattttaagctttccaagttgggaaactcaacttcaaaccagctgttgacccatcctttgttctatatcaagctttgcattaatgcagaaactgaaataagtatctccactccccaaagtgatacatctgaagtcatctggctgactgtgtgtccagaggcaccacgtcagtgtctctttgccagagcctttatgggggtggtacgaggggaactggagtctgggggcacgtcaggccttcatcaatcagaaggcagtggcagcgacagcaagacaggcgggtcaggcccccagatgagatttgtgaggctgcggcatcgattctgaccacacattctggaaaaattatcatcctacaccaccttctgaagcagtcaaggtttgggttattacctggaccagcacccggcttttacataggaccttctcctgggggacggtggtatcgttgtaaaccaaaaggttattgatcaaatcttgctaatccaagttcctgacaattaattttttaaaaaagaaattatttgtccttttaaagaacttttctcttttcctaaaattatgtgaagcttttcatttttaaaattcttttttgtttttttgagacggagtctcgctcttttgcccaggctggagtgcagtggcgcgatctcggctcaatgcaagctccgtctcccaggttcccgccattctcctgcctcagcctcctgagtatctggggctacaggtgcccgccaccgcgcccggctaattttttgtatttttagtagagttgggggggggttcaccgtgttagccaggatggtctcgatctcctgacctcgtgatccacccaccttggcctcccaataaaattatttcattacagaagcatggttaacgcgtgcgctagcagaaaagtcccaccattaaatggaggccacagtgcatggctggagaacagcaggatgttggtatctgttgcacatgtttcagcctgtttctacaaatctgcctttttcttctaacatatgggttaactaccatttctctttgctaattttacaataatatctttgcattttcccctaataaaaaaattaaattttagaaacatttaaaatgcagttaagctttttggtttctaaaaaactcagtcctacacaaagctcttagattcgggagtgggtacctgtatgaatccgttctcacactgctataaataaacacctgagactgggtaatttataaagaaaagaggttttgttgtctcactgttccacaagctgtacaggaaatgtgatgctggcgtctgcttggcttccgggggggtgcctcgggaaacttaccatcatggcagaaggcagagggggagccggcacttcacatggctggcggtggtggtgggggcgatatggggggacttgccgcacacttttaagtgaccagatctcatgagaccaacaccaagagggagctctgcccccatgatccagtcacctcccaccaagccccaccgccagcattggggatgacaattcaacatgagacctgggtggagacacagatccaggcggagacacagatccaaattatgcatttttcccctaattaaaaaaaaaaatacattgtagaaacatttaaaatgcagataagctctttggtttctaaaaaactcagtcctacacaaagctgttaattttgggggtgtatacccttccagtttgtgtgtgtgtggttatgtgtttattcccccaaagtggattggatcataataggctttttttcctttttttttttttttttttgagacagagtcttgttctgtcagccacgctggggtgcagtggtgtgatctcagctcactgcagcctcttcctcccaggttcaagcaatactcctgacctcaggtgatccacctgcctcggcctcccaaagagctggggattccaggcttgagccactgtgcccggccaggccttttccacttaaacatgtaatatgtccactaaaattttccatgtcttagaatattttcatgtacttaacagcatttaaaagaaaataagtataaatagataaaatttcgacactctcagtgtggaaactagaaacaatctcagttcagaaactagaaacaatctctgtgtccagaagtaggggactgggggcccctccaaggagaggctgggcagccattcaagtgctgctttctatgtagtagcttggaaagctggccattgaaatcgccaggcgtcattgttctaagaaccagcagggaggcagcactgtgtggtcccgcccctctgcccagccaggcatatccctgccaccccagtgccttttcacctgctgtgcctgggaacccctccccacccttgtgtccaccaaataccaccttcaccgtgaggcctttctgaccccagtttaaacgtgcccatgtccttcttccccaccttacttctgcgtgccaccagtcaccttctgacagcctttgtcatctactccttcctttccttttttaaaaattatatatagatattttacttaactggttgaaatgtgattccttttttctggtttttattttgatttcagtagttttttggggaacaagtggtttttggttacatggatcagttctttagcgctgatttctgaggttttggtgcacccatcacccgagcagtgtacactgtacccaacgtgtagtcttttatccctcgccaccgcccaccctttcacctgagtcccaaagtccattgtatcactcttacgcctttgcatcctcatagcttagctcccacttatgagtcagagcataccatgtttggttttccattcctgagttacttcacttagaataatggtctccaaatctgcccaggttgctgtaaatgccattattttgttcctttttatggctgactagtattccataattatatatacatatataacattttcttcgtccactcgttgattgatgggcatttgggctggttccgtatttttgcaattgcaaattatgctgctataaacatgcatgtgcaagtgtctttttgtataatgacttattttcctctgggtagatacccagtagtgggactgctggatcaatgttctgatctgtcatctccccccgaccagaatttaagcttcctaaagggagggactgtcttgtttgcctctattctcaaagcctagaacagtgtctccatcagtaggggcacagtcagcctctgttgagtgaattttccaggtatcaggtggtagaatgagcagttgaacgttactgtttgccagtgtctaagccctggattaaatgctttataggtactatttgttaagtctacgctgaagttctctgaggtggtactattatcctcatttttaaatgattaaactgagtcctaaataatttgaataacttgtgcaagagtgtgcaggtgatgaggatccagcgtgcaatgtacggatcaaagcctgagcgttgggctaggccggctaggccaggctccctgtgtgcccacctgaatgcaggtgtccgcatgaaggccgtgtgaatgaagagggcaggggactcatgggaaggtttacctgttttacctgttccatttcagcttttagtaatgaggacatactcatctaaaagtgtgccaggttttctggggttttttttgtttgtttgtttgttttgtcttagagacagggtctcactgtgtcatccaggctggagtgcagtggcacgatctcagctcactgcagactctgcctcctgggctcaagggatcctcccacctcagcctccggagaacctgggaccacaggcatgcgccaccatgcccagctaattttttgtatgtttggtagaaatgggggtttcaccatcgtgccctggctggtcttgaactcctgagcttctgtgttccccccacctccatctcccaaagtctcctggcattatagacgtgagccactgcgcctggcctaaaaatgttttaaataaagttattttaaaatacgaatttcataacgagaacacaaattgagaggtgaacatttgagaatttccatggccgctttggcagtagggatgtttagtttgaaactttaatttaaaaagtgagtgcagtgagtctgtctttgtagcgctagagatgggtcctcagctggccatgatagagaaggatgggcagaggcgggtgtttgagacttggaggggacagtgggggcacagcagccaggcagaggcatgtgtcagggcagagtgagaatgctaggatcctggcccccatcctcccacttgccacacagtcaagaaaatgacaggtgtacgggaagacccaattcaatacagagcagccaggtatcaaatcacagtgctgctctgcagagcctatcccgtgtccagtaaagcagacagcattccagtgttatctggaattatttacaaacgcagtgtccacaatacgatgaatcacaacttacagtttagttagattaagcgaattataatttttaatagtcagtgaatattttcacctgcctagatggggagcaaggctctgaatcctctcttgccccagccccttctccctgggtgaggcaagcatggcatgagcagattggtttttgtaaagtgcctgatgtgcagtcaaatacaggaaggccccttctttcatacatgcacgttgagttccctaaacccaaaatccaaaatccgaagggctccattgagcattgccttttagcgtcatgtcggcactcaaaaattttcagatttcagaacatttcggatttttggattagggatactcaacctgtaatttccatgataattttttttctggaaacacctatgaagttgaattggtaagaagtgctgccataccacttcaaaagagggcggtggccagggggtgctcttcccaaggagctgaaaaataccatgaaattcctgattatgccacctctccgcctgttcttctgcaccgtgtctccggatcatcatcttagtctctttcttcacaactgaacagatctgcttaaatccctcgaacacccaaggctgtgtagatttgccgctttgggcatgcctagcgaattccatttttgtgctcttttgtgcctcttttgcatagtaagcttatgagcgccatgctctttttgctaatatcagttaaaatctttccattttccacttatcctcgtaaaacaaaagcaaaacatgagttggtccagctgcataaacagccttggggctgagctaccccagccacgccgcacccccgagcacgtggaccctgtgctcgtctctgatcaccacagtaccaaaggccagagtcacagctcatgcagaatggaaagttctgccaggaaaaatagactccctcgcctaggcaaaagtatcatggatctagaactagaaaactaactggaatttcgtggaagaaactgcacctgtttcttccttttctgtagccagcgctgggaagtctgggaagacaccaaaaatagcaatgaagcagctccctggagggttgctgggagatgcttgggcacagagagtgaggtgtttgctgggaaaagccatttgggatgggtgaaggtccatgctggagttggagagcgcagaaaatggggtgagtgtaaaagtctagcctgggttacggccccagtgatcctggacaaatttggagtaagaaactcccgccagtctcatggccagagtgcccagggaaagtcttctctcccagtggtgactccgggtttccctagcccagcacaaggacttgggctggtgagctacagaattgcaaagaagagcaggagccagccagccagacctggccatggctgtgccataggatatcacagggtgtgtgggcaggagcaaatgccgggagtatatgcaagagaaaattatggctggtgggaacctgcaggagttgcaggaggagcaaagggatgtactcctgaggtttgggggctggcagcgctgggaagggagggagggaccctgattctggatgagaggtgggtggatagtcactgacgattttaacctcaccccaggggatgaaggctgctgtagggaagaatgaccagagctttctctgctgaatagccagccagccaggattctgcttcctgccgcatccacccctgacccttccagcagccacaggaggtcagggttttgcttaaagaaagagaggaaaatgtcaattattacattttggagcacaatcttacctttcagtttattttaaagcaattttccctaaagatcaaccacagtatgtgactgaactgtattaacgaaattttagcttgataaaggaaatgctttaaactcacagcaaatgtaactcgggatctccaagcacttttttttttttttttttttttttttttttttggctggacagcccaaattccaagacactagtaaaaataatatgataaaactttggtggtgcaaacaaagtcagttcttttttacaaaaagaatattctaatagtatctaatagtaatggtgaattactcatagttttctgctggaagtaaatttaattctagtttttaaatatcattaattctggaggttgcactctgaatgatttcttattttgtggaaaatacgaaataaagaagacacatttggccactgtgatggagctgctttgaaaggctgtgctttagaagacacttccgactttgatctgcagttgcggatgaagatgctcacgagtggaggtgttggtggagatagttatcccaagtagaatactcgatcgatgtccacagcacattcaaattatctttcatgttacaaacttttccagcagttaccagccccaggtacgattatggacaatgctgtcagtcatcgtgagacagagtagcatggaactgaaaaatgtgtagcaggttttcaaacctcttacttgcccaaagcttagtcaaaattatgagatttcctctgaactttgttcttctcgttatttttggaatgattgcagggttggtttaagattgccatgaccacatattaatagttgcactgagaaacaggcgtaaacagaggttgtcccgggaaaggcagaatgaatgtcacccaccctggggaaggtggctcgtgtcactaccctttgctacagctgttgtttctcactgattcattctcgggaatcgcttgttgtctgttggtacaaaataaacatttcctcctatcctggatgactggagccttgggctgcagatgagttacaccacaccagtctcccagtcccatcacacacaggcagtttttacaccagccaaacttagagcttcataaatgcaggaaactgtcaggttcctttcaagaggaagtcttagctacagatttttggtggaaacaaatggtccaccctgatctactcatttaccatctggtttggggaaccttctgtcatcctacctgctatgtatttgtgacctgatatattatttttaaatacagttgtttaatagtgtagtcaaaaatgaaaggtcataagcctcatcttctcattaacaccacaccagattgattccagtattcagtgcacagataacctcatgtttcagcttccttattgacgtgaatgtgctgagcagagctcacctgcctcttgtcagagacatgaatgggctgataatatctagttttcaagcagaggaagttagaggtgaaccgcagcctcagaatctacataaaatatgcagcacagtcattagtcatttgcagtggcccagcaaaatcctaaaacagcaggagagaaaaatattttcttttcagtgtctgtcaaagaagttataacataggttttaaaaaaaaaaatttcatcagccaaatccttaaaatttaaatatgcagacttttttcctgtatttttatcaaaaatgtttatactgttaaaaggttatccaggtaccagataggtgccccaggcagctcatgatgcaaatgtagacaaatatatgttgagtgcccctgtgtctgtaagtcagtctgtatcagtatagaattaggattggattagtgtgaagtgtttgcactgtaaattttatctgtgtttttttttaaaaaaaactggaaatattctgttttgttccactactatttccccagggccttaaacagtgcctccccctgagtggccctgggtagttgttgatcatatctgtaaatatctggagtttccgcacacacagacttcgagtgtgccatcaagatggtgtccctcggtgctgagcctcaccatcctggtggtcctgagcagttgcatcccctccttcagctcagccccagggccttctgttcagggtcactgtggataaattaccagtggaacccaagccctcaaagctgccctatgggctgggcggctccaagagccagagtattgctctgtgacctccagccggttgactggggcaattgttagagccaggtgtggcggaaggacccatacagcctctttcaagtggctgggccttctgtacgaggcacctgacaccacgatgctatcaccatcctcgctgactgggacatgccacccacctccaataaaggcttgggagtcgcaaggatcccttttcataatgaaacttcctgtccacagtttaggagagagtcttgaaatcacctggaacaagaagtttttcaaatattttaggtgtttacaaaatatttctatgaggacagataagggggaatgaattttgcaaattagcatttgatttaacccccaaaaaagtaccccgatggttcccacagttgccttctaacataacaaaaggttacatgtgatggccaagggaaaagaaaacgtaatttatcgttataagatgttaattttttattctccaaaatgttcagactgcaaggatatttcatacagatttgttagctggtatttaaataatattcaacactcctaagccttaaataggcaattagaagtatactgcatttttttccctccagcatttcaaagacattactcaaattttgtttgttctttgtgctgcagtggtcttacttggcaactccctgtcttgacagacttgattacggagcacctattttgtgcatggtgcttgctggccactgagcatctgtaaagaaaattttttccacgcctgtaatctcagtgctttgggaggccaaagcagaaggatcactcaagctaggagtttgagaccagcctgggaggtatagtgagaccccatctctacaaagaaattatcagggcatggtgggtcatacctgtggtccacgctccttgggaggctgaggcaggaggatcgctggagccccaggagttcaaggctgcagtgagctttgatcatgccactgcactccagcctggtgagggtgagacattgtctgaaaaagaaaatgtacttttaaaaatcaggccaggcacagtggcttatgcctgtaatgccaacattttgggaggctgaggcaggcagatcacctgaggtcaggagtttgagaccagcctgaccaacatggagaaaccttgtttcttctattctctactaaaaatacaaaattagccaggcgtggtggcacatgcctgtaatcccagctactcgggaggctgaggcaggagaatcgcttgaacccgggaggcagaagttgcggtgagccgaggtcacgccattgcacccagtgtgtgtgataagagtgaaactctgcctccaaaaaaaaaaaaaaaaatcagagggacacagccacataaaggagacatccacagaagcaatcatagcacactaagggccatgaaaggggtgcagtgtccaagggagctgggaagagaggctgcctcctgtgccactgaagggcaggcttcagccctccaagcgctgctcataggcacggtggtttgtgcagctttcattgtggcaggtctaactgtatttcccaacatcctctctcatcgttctctaactttctccttacaatgcctcatcttttggcggaagtgacttgcatctcgtatgttacggttctgtgttgaggtcctgcgttttaactgtgtgaatgataattgtctggaaaagctgggggccctcgacagccatgtttgcacgttctttaggaacaaggggagcttcagcacaccagcagcctccacaccccgcctctacctgccaaccccttgtgagtccttcaggtttgtccacagcccttgtcatccctcctcgtggtcaatatgcacacatatatatgcttattaactctctccgtttgctggaacctaagctctttagggcaggagctttgtttatttactgctattatcgcagctcctaggagacagcctgaccagggcatgggtctctctgtccctccatgtgtctggatgttgtctagccccacaccaagcacatggtagatgggccacatggcactgcctccccttggtttggcgtggagggtagagttgccttagtcagtctttaactggctcttggccatcttagttgaccaagatggagaagagagcaagagtagggtgaggccggttgagggtagaggttcaggggtgctattttgttcatttcctgtgtgaagaaattgaggctaaaagaaatgacatgcccagggtcacgtggccaggtggctaggctggggctggagctgccttcgagtctgtgcggttccagttcatggagcactgtgcagttttctccctgacctccatctgcttccttcttgtaccctgggtgcgggccatcctgaggagcggggacctctccatcagcacgtgggcagggtgggagctgaagtgtaacaggcatgtcggctccagcgacacacagcttggacatccttacacaccgttggtgggagcagcacagaacttcggctcagcagcatgtatccagagccccacgaatgctcatgttcatgagcctgtgtctcaaaagctgccccaaagtcataatcctaattactgaaaacacacagaagtactgatttatggtcataaatttggaatccttctaagcagctgggaactgactaagcaaaccaaagcatattctgctctttatgatgttaaagaagaaaagaatcctattacttatcttctatgacatataacactcaacccatgggatgatatctcacaaccaaattgcctcttttttaaggctgggcttctgcatatcaggttttcccatagctgaggacaccaacacactttttctaaccacataatgtcagtagataagagcagggatgtacttcgaagcagcggcctgagtttggtgtattgctgtaccttgagcggagtgaagtggccaggtgcattcaggaccctggacaaagcccctcgctgtactggcctaaggagcccaccttccccactcagataggacactttcctgtgcagcagtgggtcatttgactgcatgtgacttttcatagaaacagctaagtttctaaagatgagaaatgtatgtgatcaaagagggctcctacatctaattaccttcctgatttaattgagttttctgcaagacgcattcagtctctccccagcctgctcaccctcacacgtgaaacagaatctcttttcaatttagcagatctgagcacccaacttgagaaatggtagtggctgattatgtaaaaagggaagaggctggggagaagcgggaatctctcaaaatgatttcatttccacctaacagcgctgcgcatcgtgccttcccatttatcggagttcaccgtattaatttaaactttgtgctgcttgcattcagctaaaaatcagctagagaacaatttgatttttgagccttaactataaattcctgatatgcattgcattcccaagcatgctcccttctgtcacactccccacggcttccccaggctttctgcctcacttggccactctgtgttccttctgtcatcccttcaaactggatgatgccattcggcaccagctggccctctggcatgaaaaaaaaaaactgttgtagtggacaagaaaggagagataccaggaaacggatggggtgcaaagaaagtgacaggaaccaagaggagagagcagaggagtatgacctgggaggcgagaacacagagaagcttgagaagcccagggctgtcccacctgtggtcaggaggaggctgggggacaccccttcagggtagggccccatgagcagctcaagactgggacctcctgtgggtcagctgtgtagagccagatcctggtaggtggctggaggccagacagccacgtccatttgttcatccagactcagctcatggcccaagtctcatgatggcctttagcttcagtttctgggggaacccagccaccctcctgtcccctctgaccctctcccccgtctcactagaccgtatagtggacgttttaaaatcttccttatttaattgctttgtagcatttaatacaacgacctctcccattttttttaaacagctttattcagataaaaatcacataacacacttctcccatttaacaggtgcaatgcagtagtttttagtatctcacagatacctgcaaccatcaccacagtcaatctcagaacattttcatcgtctcaaaaaggaaactctgttcttgaattggtggtcagaatatgtacttttttctttgtaaggctttataaacatatttcagtaatcaaggtcctcatctcaatggaagatcaaatttcctaaattcctactgactaggcttaatttagagagatctctgggcgtaattgaaaatggcccaagtaggcaattcttctctcctgtgtgttctcttggttctggctcctcctattgtattcctttcctccccgtttttataactcagtctaacactgtgttgtcttttcctttcgccaacacctgtcatcttcctgggccccctgccgtgtccccgctgcccctctgacattgtgtacctctgtgtgagcggcaaagggaaagggacaataatgccagtctctgaaacatcttcagagatggggaattcaagtcaacctcctcccgctgaaagctcccgtcaaaaggactatgcgaaggggtgaggttttgaacctcacttcacactcaccttttaacagagacccaggatgttgtgatttccttggatggcaaaggtggcctgttctttatttaccggcctacacatctctgtaagcttcagaaagaacagagcccttattaaagatccaaattagctttatatcgttggccgtgtatcaaaggaagtgcgttttaatttacgagttcctacaacgacttcatcttgagttcacagggggcttcagccctcaactgatttcctctcctggcacctacaaatgggcctgtctttgataattttaaattattttaataccaagcaaaaaaggatttttagtcatgtacctgacactgccaaataggtaaattaaggtgtgggtggaagtcagcaggggcagggggccgatacatacgtgcttagcattttcctctctcttttcttttgtctttcttttcctttttttccatatagatgcatgcttcttatgaacatgttttaaagcattttgtatctttaatcaacatgtagaaaatgaacagccaacccttcgggaaccattgcagctctcccagagtgagtgttgcctgctcctagcaaattcgtggcgtgcccctcatcaaactacgtcccctgagggagagtggttggaggtgtttctggagggccctgtactccctgaaatccaggctccagggtcagggaagatctgacccgggagaggattagggccctgctaacggcagcagtaacagcgggagtccttgcagcagggaggcttgcagagatcaagtgcacctacgcccagcacctcccccagcggacacatttagagaccctcgggagcgcgagggatatgagaatcacaagcacagagactcatctcttgaatatcacccgggatatcaaaaacctatcagcacacctggcgaggaccctcaccaaggcgagctccctgcaatggttcatcaaaaattgcccagctaatgatcggctgggcagataatcggaggagagttaattgtaaggttcgatatggcatcttgtcagcagagataagttgtcacgttttccacttgagctgaaactaaatgattgtaaaataagttatgagtgtccttgggcctgtctgccggaatgatagctaagaatacattcctggcccatcagtctcaagcaggctgcttgatatttatgcggacggaatgttattttattccccctctagtcatgcttgtcagctctccgagtgaaaagtgaaactgcttctttgactcatacttcacgttccgaagctcggagagactgcagattgtgatcattattgctcgtattatatattttttggggtgtgcgttgaacattgatgcccgattgggaagaactaatggctgacattgaatgtgcgggatggtgccggcccatcccggctcagcgccgcgcagctcgggaccccagtccctccgtcagagccggtttagatgtggagtaatgaggcgctcgcttttttaatttggcatggcttttttctcttagcctctcccctcccatacttaacgccgtcgacagtagtcgtctgtcccggtgcccggtaattgatacaaaataaaatgcattctttgtatgcagccaggaggagcggatggcgctccgtgggccggctggagctcatttacagtgtctcaggcggggctttcggggcctcttcaatttgaggaataccttgtcaggcgaggggagtagttggaatggaaaagcacagcgtggaagcctagtgcgttgtgattgctcatattttaaaccaggggaatgttaaacaactccttgaaagcgagctctcgacacctagaagccaggggcattcatattcccgtggccgagctcagcgcccagtggacgggaacccggtccttcttgccatgagaacacccagcccaggagaggtcagggcctggcctccaggtgggtcctctctggtcgctcctcactggtcttgagtcccaggtgacacttcctgcccgacttctgtctcctgccacggcccccctcaattcacatcctaattcaccccgccatcaccttctcagcaccatgatggccactccctcgtgtagccggttcccctgctgctgcagccgggccctcccacaggcaagcatctggaactagcaccagagcttcctcctgtcaaagctgtgccactttccccactggctgcctgtccgctcctgccaaacctgctcccacccgccccagcccagagcatgtggcttctctaagggcttgagtgcctcccttttgggccaccgtagacaccccacctctgagtggtcaggcgccactggttgtctccttccagcaagaaagttggagtaaaatgtccagggcctgggctatggagtgttggagcattgccgtggcaggagaacgcagtgggcagagacgcaccctgccctgcctgcagcatggcctggaaagtcactgcctcaactccatgcctccaaatgggggcggggagggtgcttgcggacccaccctggaggacctcggccctgtaagcagcagatcagagcgtgggctggtgctgcttccaggatcacaggtgctttgcacacgtcagttactcgagtcatagcctcctgaggacgactgcaaggagctcatgaatgctggcctggctttctgtttccattcttgagattgcagttgtttttatcccatgacaaccctgtgtcctctgaaaagcttgcctccttctccccgcagtggccaggacaaggctcacatttttctgttctctgtctccccagccctctcctgggctttctcccggtgcaatgacaccttcatctccctgttggtcccattctctggggtggctggaggtggcctgggtatgctcggtccagtgcaggtgggcgtgcggactcttccgtacctcacttctccctgcacctgtggcccctgctatcggcgtgcttactggagatgcgattcccctcttccttctttgttcaggtagcagggcccaagaaaaatcgtcttttatggaaggcatcaagcaagaaatttgataggcattctcttcactctagaaatcagccccgtgggacaggggtcttgccctttattctctgacagcggccagctcctagggcacgcttggtgcgtggggacactcaacagggagatgctttctctgtgtcaatagacttcactcatggactcagtcgttcgcctaaaaatagattccaaatggttggaaactcataggacagtggtttggcacaaaagcgtgcttgtggctggttttaaaactaagtcgcgaaattgatacactgctgtgtgatacaccagaaagtggtccgttccatccacccgcgcaagtgtctgtcacacagaggttagttctttcataaaactttattacgtatcgaaccccattactcatcctgaatctgtttcaggaaggatgtgtgctggtgaagaggatgagcgaaggcctgccttcctgaagctcgagcgctcatagggaagatgttccgtaaacaaagaaacacgcatggagcatgtcatgtccccatgtggagagagccacggagcacagggggccgggaggggctggatgcgccagtggccagcttggggaaggcctctcttggggcttcctcctttggctcctggagtctaaaacttcctggtgtcccttctgcctgcctagcagaacccctccacacggctccccgtctaaggcggcagggatgagctgtgtggatgctgctgagactggtgtgactgctttgagccttgtccactgatgcagcacctgcagggtgccgccggccccagcaaggacacaccagtggttggtgggatgtgagcgggactggagtgaggccagccgtggacagcagtgcagagggacaggccctagggagttgtgctttaaagaagggcaggagtcaaatgtccagggtggaggtgtgcggccaagggagagttgtgttaaaaatgtgagatgacagggccgggcgtggtggctcatgcctataatcccagcactttgggaggccaaggcggatggatcatgaggtcaagagatcgagaccatcctggccaacatgttgaaacccgtctctactaaaaatacgaaaattagctgggcgtggtgcaggagaatctcttgaacccaggaggcagaggtggcagtgagccgagatcacgccactgcactacagcctggtgacagagcaagacttcgtcacacacacgcacaaaaaagtgagatgacagctcatgtttagtgccgggtgctgggtgagcgagggtgggtgagcatccatttcccaggggaggggccccgcgcccatggagactgctggggacaggctggggcagggcggggtggagggtgtcctcttctgatggatgcttttggtttttggttttgttttgttttgttttgttttgttttgttttgtttcagtgaagtgaaaagtgaggtcatcgtgaggatggtgtggggcgtggggtgtttgaagcgggaggagaagctttgaaatagccccttggagagtgggaagtgggttactacagaagtgaggtaggattgaagggcaggccagaggccactgaggggtacactgaccacacagaggaggccggtgtgcatggcaccaccctctcccagccctggcccatgacggtgctgagcaggtggagggctggaagtcagtgaagttggggcttcctactcaggagagatggtgggagaagggaaacttacaagggtgagtttcaagtcgtgtgcgatgctgcccggctgtataagaaaaaccgtgggatgtgagcgggttggacgtcagatggcatggaactcagggcatagaggagccacgggagtgaaggcctagtgagctggggaggcaggggtgggggtggcagttagaccctagaaactgtggttcttgctggtagcaagcctgggtgagaccatgagagagggtgtctgaggtccagggcagaagagattcatgagggtggagtggcacagaggccagggtgctggagaggacacccaggaggctgagatgcagacagaccaaaattccaaaggaggtgtgtgcgagaggttgaaaactagaagctctggttgaaattccatggggtttctcgctattgatattttaggtatttgagactgttctttgtggcaggggctgtcctgtgcattgtagggcatttttcagcacctctggcttctaccatctgatgcctgtagcacctccactccacccagtttgatacccagaaacgtctccagccattgccagaggtcctgggtgggggttcctggagaaccggtggatctgtgggaatccagagtcccatggggctagaagtgctcgtgtggaaggacacaaaaggaaaacgtggatgtggaggaaatgctgatgggttggctgtggtggtctcttagaggaaggtgggtggtggtatttccaagtgctgtctccttcccaagactgccacttagctgcttcctccaggtgagtccgggatttctcggactcaccaagagaattataaatattgcaagatatggagaaagcttagaaatgagagggccctgtccctgtcaactgttttgcaaaaagttttctacagctaaaagtgggaaggggcctagaaacagacgtgccattttgatttccagaaacgtgaattctgagctagatgccagtgagtcaggtcacaaccaggtgggattctgaattcagttgttaaagggctgctttgtgtgcacatagaaaaggaaacagatgtatttgaacagaggtagtttattaaagagaatgaatagacatcaaatagatggccctttatcgttttcagttgtcaaaaatacgtgtgagttgggtaccatatagccctcagcagagtatttgacaagatttttccttggtttcctcataggcaagttgaaagatatgtgagctgaacacaaagacagtgtaatttatctaggctcagtggtcactcttagaatcttccaggagcggatggtgcatgttaaggtgggaagctctatcttgactccaccctgttcaccatctttttcattgatgtggatggatatatgggagtatatgctcagaacggtcaagcataactaaggcgatagtgaagagtaacaacacataggcttagaacacagagacatagagtggtggcctggaatagagagcctagcggtagacctaccacgcccctgtggaagcctgtcgtgtggacggcatagctaatgtgtgtgttctgagtgtcttcgaaatagcggtgtacactcataaaaacaaccgctggataacggaagagagtttatgatataatgcacctactgtaggctcagcattgcacaagtcaccacaggggaggcgagcactggtggttgccctgggcacaggcatgctagttagattgagataagcgactggcagcctcgtgcagaaggtcctaactgtgggctccgtgggagtgtagagatgagaaatgttagtttgggagagagtgttacaaacacagagtgacagagggaaggacgcacagttggggatgaacatggcctgtcgaaatgagaggacacccaagggacagagtaaaataatatgattttaatataataatattacttaatagcggcccctggcagccgaggagagttgcgtttgcctgttctgcttatctccctgcaggactagggttgagctctctgagggcaaagacagtcacagtgaccattgtttcccatggcctggcaccatacctggcaaagtgggctcctaacactgaatagagaggatgggatggtaaagacttgggaaccctgggcagaaaatatttaaaatgagcaaaaagattgcctgcctggtttgagcattgaataacacagagaagggttgctttagaatcaggtaatgatcttggggtctctggatgccccaccccctgaacgttatgaggcttctgaacactgttaaatcataaataaaaattaattaggctcgcccttttttttccaagatatctatagcttttatctgatattcagtggaatctagtatttcagaaatacatataagaaccactactttagaaatatcagtattgtaaaatcatgggacagcttaaaaggtgaaagtctgggaggagaaggacctcgtggagctggccgcacagtctaggcttgggggtaaggtaagaactggaccaggggtacgtggtgcttaaatggagagcaggcagtcatggagcggctttgtgaaaacaggctgagctcgaggtcccaggctgctcaaggcaagggaagtgtcttatttaaacctgcccgctcccacctctgcagttccaccacaaccaaactgtcatagtgcaggctcagggggtctcaggactgctggctacacctcgggtacagttaaccaaggaggtttaccagatgtccaccgtggaaagcaagtgttgggcagaagtggcagggaagtggcagtttcaagggtgaagcccaaggtgatagcagagaaagctgcccggaatgcaaaggtcagagtgagtgctgtttcttgggagccggctgccgggaagagagggtcaggtagagccaagcctggaactggtgttggtgtcatgcacatggagaatgcccctgtggacgtagggaggagaggcaggaaaacatggcatcttgggccagcacagttagcatgataagggaaaggaagtcttacgggggcgaaggaaggcacagtgaaacagtgtgccgttttgaagaagcaatggtgaaggaagccagacttcaaggagtcaggaagaaacacagtggatttaaaccctctatctggataggaaccttgtctggagaggtctgcagcggttttgagcagacctgaccgagctctgtgacttcagcaagttacttaaccttcccctgtgccttggttttctaatctgtaaagtggaggtggtagggataccacgtgcctcagcggattgcttaagagtcctgaacgcattgctgaaggtagagcctggaatagcccctgttgggtagtaactttggatgagtgtttgctgttgagactgtggcttcaagggttaaggaaataaccctttaaggaataatggggtttaggaaagtgggcatgaaagatcttgggacctctgaggacagaagtgacgcagtggagagggaggaatgagtggaagtgacctggccaagacacctgaggatgaaagatgggaccaggacaagctaggaatgttcatttagcaagagaggggagcccattcctctagggatggagagaggggagtccgttcctctggggatggagagagggagccctttcctctggggatggaggagaggggagccttttcctctggggatggaggagaggggagcccgttcctctggggatggaggagaggggagcccgttcctctggggatggaggagaggggagccctttcctctggggatggaggagaggggagctcgttcctctggggatggaggagaggggagtctgttcctctaaggatggaggagaggggagcccatttctctagggatggagagaggggagtccgttcctctggggatggaggagaggggggcctgttcctctggggatggagaagaggggggcctgttcctctggggatggagagaggggagcctgttcctctaaggatggaggagagggcgagaaggccagtagaggagccgtgatggtggagtcacaacagaggcaccccaggaagctgacagccagatttctgccattgatgttacctctcacctaccaccaggggacagtgacctgtccgtgtgcctctgcatctaaggatgtgcgtccataggaagcacctcctgcctggtagagggaaagttgctgagacaccgaattgccacatttctcgcaactccttaaagtggtgaagggaacttccgccttttgtgagtgagtgaccacccacaaggagtgcacatggttgacacagtctcaggtgtctcatggtgtccagtgctgcctgggctgccctgcaggagccctggggtggcccttcaccctcttcgcaggaggagctccccacagccctcttcttccatgtgtaaagggtgcatgcaatgaagggtgacgcttccgactgtgcagagaggggcgaggggtctctgccttagggcggccaggaacgtacatcagggtgttcttgggaccgtatgtatttctcagataccttaaattgtgtgtttgtacatttctcaacatatgataaaatttcctagaacttcacaaaataaaaatattttcaattcattttgatttccattatctttgtatttgaaatcatgtcactgttctgctcagaaccctgcatggctccccattccccccaaagcacaggcgagggtcctcacggtggcccgcaagccccctcctctccagtgccaccttccgcaggcctctcccacccacaccggccaccgccactcgggccccctctccgtttctggaacacaccaggctccctccttggagccaggctctgactgtttctctgctctcattaccttctcactcctctgccattttcaagtcttgattcagtgtcccgtgctcagcgagacctaccccagctaccctattttaaatgacaccccccatcactgccgcctctccccagcctcccagccttgatgccccgcgttcctattcggtctttcccataactcttaccagcttctgatggactccaggttctggcccggctgccatgtcactgccactccactttacagagtccccattggggcaggaatgtttatctgtttctcctcgatcaatgatggctgccaagcatcttgaaaagccgctggctcacagtcagtgctcaaaaaataccagctgaatgagtgcggtgtgctgtacagaactctgactttggacttaaagatgctgaatcgtgaaataaaaacttttcaagacgccgtaggcatgcaccacctgtttttcctgcacgttttcagtgggcttttttccacccggcttgaattatatgcgcgttctggtcatgtagtaccgctttggccttctctttgataaagatacaaatggacataatacattgagagtttcacttatagtgaataatcacgtgtgcactggttttgaaactgttctaagtagcttcaatgaatcaaaaattggcaggcctactatatcgacttccaaacactgtcactggacattggtgagagagagaaaaaaatggcatagaatttttcactgataataaaacaagatgaagttatagtcatctgtaatattgaggccggaagaaaggatcaggaatcccttatcctgtgcacccacaggagtcaaacccacttaagatgatatttccaaatgtattcttaaatgcatcgttttcatttctaatatatcaaggtaattttaagaagagaaagataactaaaaagcataaactcacccctttccttttgcagagctccagtcatgcagaggagagaaggagaatgcatccatagcatgctgctgatagaaaaagaaatgcttgtgttttaatagcgggaggcacagtagagcaagggggactgagcccatctcataccagaggctctaggcctccaactcagcaatacagtaatgggatgttatttgcagggcctgtgtggtatgagaggagcgtggctgtgctgtttctgcgcattctgctttgtaagtgctcactctgcatttttttttttttttttgccttttccggtccaatggcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaaggtaagggttccgcggtgccccgggagagagtctccactgcggaaaattctctgttatttttcaaatgcgtgaaattagacacccttagcacaacaaatgcacagtaatgctggtcaccgtatgtgctttctgtttgcaaggtggcacgagagggcccttgggaccttttcatcactgtctgattctcatattacgcaaccaaatctgctgtcatcactcttggccgccgtcgctggtagcgggtaggagtgctggtctcccagccaccagcctgatccagttctgaggtctcgccccaccctggcagcctgggcgagtgtcctctccagccaaggtgggccatgctgcgtgactctgctggggacagtgcccacttctagtttaggaatcatctctgatattggttactcttaactaaccagacacctgccttgatttcagcttttagcaacgtgttatgataaacacttcttctgttaatgtccatcagctctttctggtatgtgggctctattaatattccagttgtcacagctcattgtgagtctcctttcacctgagtgcttccttagtttttattgccactgatggctggatgtcagcttcctgaagtggctccttcaaatgaattccctttttttttttaattcatagatgcaagtagagataggtaagcgcatgcgtacacacacacatacacacacaccccccacattatgagaggtaaaattaatgcagttgtaacaaaggaatacttaaaaggaaaaattaaagtttgagaaccttgttgttagaacatgaattattacctgtgagaccgacaatggtgagagagtgtggttacctgtgagaccgacatggtaaaagcgtgtcttcagtgagggtctcatgcccaggggcaacatttatggcttccatcctttctctttctctatggctgccatgctttttccagatactctacttgatcgagggttcaaacctgcgagctgtcagacagtggctacattagagggagtggcccatcccgtccacatatccagagcggagcacgcaaacccacggtgcgtgtgttagcagggaaggggcagagtgtggggtgtgctgtgtgtttccataacaccggaggcagggagcatcatttctttcatcatcaggaagctgaagttcggagctctgagtagcccgccagcctccgcagaagggttagaagcctttctccttcaccacgtttcttcctgttttgcctcctgtaagcttcctgctaacatatttagccaataaaaactgatttttcgtcgggcacggtggctcacgcctgtaatcccagcactttgggaggccaaggcaggaagatcacctgacgtcaggagtttgagaccagcctggccaacatgatgaaactctgtctctactaaaaatacaaaaattagctggatgtggtggcacatgcctgtaatcccagctacctgagaggctgaggcaggagcattgattgaacccaggaggtggaggttgcagtgaaccgagaccatgccactgcactccagcctgggcgggcgacagagtgagactctgtctttaaaaaaaaaaaaaaaaaaaaaagacgatttttctcatgttgtggggagtgaggataatcccattaagtcagcgatggtggaaaataatggttatgggtcagagcagccacagatgccactgaccttcccactgaaaacagtatcagccgcaggcgctctgtgttggtaagactccttcagacaaccgttgggcaaaaatcaccctgccaagcacgtgcagccacccctccctgattgggaagaaggttagcctcccccagggtgggcagcctgtaccctccacgcccctaaggtgcacacacaggggcgggcgccagattccctttaaggacaggccttgttctcactttcacaggcacgcgtcttcttgcatttgttgtgtgtttccaaccgaggtctgtggttttttcttatgcacaacctggtgggaactgaccgttgccacttagatacacgttcattatcccacccacgtgttgaccgctgtgtaaatgagtgaataaatcagtagcgtttctgcacatttgatggagcagctggcaccacccagtgttccattcagcaccggtgagtttgaaggaagtttgacaagtgaccgtgaccacgttggacgcctgatgtttcaggtccacttgctgagtgagtgggatggtatgtgtgtgcgaggcaatagtggatacccaggctgagacacgggctctgtccaagcagcaaatgggggcccctttccttaaagggtcttactgctgaggtggtaacaccagcagaaagatttcaggcaccatggaaactccaatattaggaaatcacaggtgtctcaaacatggatgtgtaagcgggtgacgtgtgtttggaagtccaaggcagaggttccaagggagccacctcactctctaattaggagagtctggtctctacgtcagcggctatgacatctttccaatagcaaataagtcataagttatttataaaaagaaaatgtatcatttttccctaggaaaagttacttatcagactacaaatgagtcacttttgtgaaaaagtctatatttcattttttcaaagccacattttccccccaaattgtaacatatctgaagtcagaacatatcattgtagattcagtgatatatgatatttttgatagttttatttactgttaattccttgaaagtacattgtgtaaaacacccaaattaaacattctgttctggccgggcacagtggctcacgcctgttatcccagcactttgggaggctgaggcgggcggatcacgaggtcaggagatcgagaccatcctggctaacacaatgaaaccccgtctctactaaaaatacaaaaattagctgggcatggtggcaggtcccagctacttgggaggctgaggcaggagaatggcgtgaacccaggaggtggagcttgcagtgagccgggatggcgccactgcgctccagcctgggcgacagagtgagactccgtctcaaaaaaaaaaaaaatctgttcttgaaactaaagctagttatatatgttttattttatttatttatttatttatttatttatttatttatttatttattgtattttttgagacaggtcctcgctctgtcacccaggctggggtgtagtggtgcagtcacggctcactgcagcctcgaactcccaggttcaagtgatcttcccacctcagcctcccaagtagctgggaccacaggcaggcaccacgacacctggctaattttttgtatttttgtagaaatggagtttcactcttttgcccaggctggtcttgaactcctgggctcaagcaatcctcccacctcagcctcccagtgctgggactacaggcgtgagccaccacacccggcctatattttatgttttgagaatactattctattataaaaaaccatttctgcctctctttcctgcaaggctctgtgactggttactactagtgtattctctatcgcctgaccaagtgctgaaaagatggaattacagatataaaacttctatagaagatttgtgtaaagtagttgaattttatggtttttaatataccctattggaacaaataactaggttcaaatctctttagagtataagaaaaatagaattccattgaagtaagcaaatttatcagggtcctttgaatccattggtcagtagaatccattaaactcagctgatgaatctggaatgggatggggctccccggctggttcgccgaggagtcttcctgggcctgtctgcagagatgcggggagaaagtgggtttggtgtagaacccggggtgtaacggggtgaggagagggcaactatttgggaaagcttccagctaggagctgtggccttcaagaaagagacctgtccggctgtggtgaccgggaaggtgagggtgtcctcactcttctccctcccactggtctccagtggcccctccttggccaaatccaaccagaggccaaaagccctgagagcccacgatgccagtcacacagttggctcccaggaccaagacaaaaccaacagaagccgtagagtgttcgtgcctttcacagcacctcctacaagcccctgaagcccgtgccatgccactctgttggtggtccacaaacacaggaaacgaagctctagagggcaggggtatgtgctcccctccatcatcccccagggtctggctttagcctggcccagggagccctcgcggcttcctgaacagacctcagtgcccttccccagctgtgtgcgacaaggaccctgcgagaaggtcttcctagactcccagctaagcacagaggttctcactctggccgtttcttacctctgtggcgcacttattcagaaagtaaaggctaatagtaggaatcatcagtacctgctgctgcaaacccagaaacactgtgtctacacggggctgtcagggtgaccgatggaaattgggccgttcctgccctggagtttctccctgcgcaggtgctcgctgtgctctttttgctgaagaacagccactttgttctgcaccagatggcagagggtgtcagaccccagcccagggagagcatttattttcttaggtttaccatttaaaatgaatcggaggaatctggaaagttacagaagcagggacggtgactggagaatcccttatctttttgtgtatattttgggttctgaggattaccaggagatgtgtggatgacagagcccgtcgctaggctcttatgtcacagatgggctgctgtgctgcgtggtcattgagaccaatggaaggaaattgagatgtgactgggcaggatggtgacagggcctgaagcctatgcatggagggaacgtgcagtgaccagagagaagggtggtgatgaggatgagggccatgaggcatggtgactgtgaccagctgatggaaggtttgcaaagaagggcgtcccaacttgtcctggatggcccaggtggtaaccatgggacctgatgggtggaagcctcaaggaggtggattttgattctgatattaaaagctctagaaaaagctctacgaaccagggccacctgagagggagtgaccccgaccctgcatggggtcggcatgggttggaccagggcagaggaacctgggctctagaaggtgattgcaccacggccctggattcccaaccaggtccaagttcaagggtatgtgccagggaaaagcgcctgggcagtgggattttgcagatctttaatggcttgtcagctcttggcattgtctttgaattacagtactttctgggcatcttcatatctcgggtccagtagtgaggttgtcattgctaaaatgaacggtctctgcagtcccattctgtggccccgaacctggtggttctcgttagttttataacattcatgcaagtttgcattaagtgctaatttccctgtttccccagtgaaaaggctgaagtagagagaggttaagtggctttcttgtccagggtcaggttgctggtaggtgacagaactgtctcttgattctctgcctcaaactctttccaccaggcaaaaagcaagtctttgaggtatgtggagctgcttttgaatctgggagtggggcacactgaatagcttccttgatatttctcagattccatgtaaagacactgacttttatatggctcataacatctagaagttgtgtagcaaagatctttctttaaaaatgcaggaccagactggatttacccaatcttattatacaagagggtatgcagaaatcctggtgttatcccccccttgggttcacagcgctttgttctgaaggtctcagaagggaatttattttatccttctcatcttgttcctttggttgttcattctggtctttatcgcaccattgtgtggttgatcctggatggatattgaaagattctcctgtagagggtaagtcacaaacgggcctctcactgttatggtagaaaatgaattgctcatcacagctgcactcactgagcaatgaaatgttgacaaatttcattaactccagagttgcagaggtcacccaggacttagtttcccttcactctttcaaaggagaacctgaaattgtagatcattttattctttcatcaaatatgaagcaaccaccacagggaaagcactgtgtgcttgcctccatgggagacgttgagaaataaaactcggttcctctctctctccaaggagtttagagcctgattatggagataagacatgcaagaaactgtaacgaggatgtcaggcagaatattcgagaaaggcatgggaattcagaagaagcacaaatacacactgagttgtaaaagttagggaaggctaacctgttgtagagcttaatttttattgtgcagatttagcacataatggttatcttatttaataaaactgcagaaatcattactttttcattaaatgttgcctacttacaactttaaacaccagtggtggtgatttaattagtcacaaaatggagttttgtttttacttagatgctaagaaacagatgttgctattgatcagttaccttttacctgaggacttttttttattattattaattagttgatgtcttggaaggcactttggagagaaattaaagaatcgtgcatgcatatcgtacagtgttgttttttttcttgcaggaaagcaatacgtgggtgcgtggaagctctcagttaatctgtaaccatccggttagatggactatcatgcagcttgagccattgctgggtagtttggggattttgcatgccgtgattgggagggcagtgtgcttgttttgttatttagaatataacaaggttgtaagagtcttattagcacaaggctctcatcttttctcactcctggggtgcaattagtgtgcacatgacggtgagcacatgactggcaaggagtcagggcccagaaactgttaccttccaggtttatatccagtctacaggggctttcacattgaattctgtgttatttggaggtggctggaggggagatccagttgcacaagtgttactgtcattcttccctcaggttttctccttttcttctccatgaacattccaccggcacctcccgtgtctgctccttgtttaacattggcagctacccaggaaagggaacgagaagtctccacaatcagctccctaaaaactgcataatcaacagtaatttttgatacaataaggacttattaattaaacttccttattagcaaaccactggttagtgcatctgaacagttgagttgaacagttcattatagcaaatgtggaaaaccaagaatgagaacatcttcctgggagatacactggaaatgcagtagcgaatgtggaaaaccaagaatcagaacatcttcctgggagatacgctggaaatgcagtcacttcactctgctaaggatatcaggagactggctgggtttcatcacccttgggctgtcagtgatgggagccaccatgcatcccgacggacttgcctcctccccacaaactagatgacttttccaaagacagtttgctctcaggttgtaactccagcttccaagagaatgaacttgctgaaattgagtagatcatctgggtttactctagacattgacattgtagattgggcacagttgactcaaaagccatcctgcagggtacagtccggccgccacaaacacacacaagcagtaagcgctctcagatcctttgtggaagccagcaggtcggaaataaacaaagatgagtcgatcacagcaggggcagccagaacggaagattcccatcgtgatgaaccgacgcacagaaggatgtttgtagtgtggtttttgtttgtttgtttgttttaatttttttaaccacacacaaacttaaaggggttagattcaggtccaaaaatgttcattgagcacctactgcacgcaagagttttgtctgatgctggatgggacatcaactgaagcggcccagccatcaggacacacatagaccagtggagaaagcagaaacacgccggggaacttggttatgcaggagcacagggcacccccagctgcctggaggacctcagggaggttccccaaaggggagtagacactcacacacgttgtatagacaacgaaatatctgctattccaaggaggaaaaaaggaaaaaatctgaaaagtcaaaacaaactaaatcttgtaaagaggtggcttggagctcctgggggtacctaggcaactcctgacgccacagacaagcatttgagctccttagcctgctacacagaagcataaactcacctttgaaaaatgctgactactcacaaggtccctttctaagatacagaaatgtgacggacctcaactccttttttttagctagacttagagattctcttctgcgagtggggctcggttagcacaagctgctcacaggctccggcgtccatcagcagagaactcggggcaccgtgttttcctgtgtgcaccctgggattggaattcgggctagcttgggagaccctgcattggtcgactttcattagaatctaggatctgtcttgaagtcattttcttgatggtctcaaaatgtttgagctctgaggcttttcggatgtcatttaagtctcggtgaaattatggtccacttggaccaaggtcctgaagccagaagaggggctggttctagcggccagtgctgttcaacttgtgtcttccttactattctaaatcctcatctactctttctactttcctcagctgcatgtattttacacacaaagtacagggatacagattgaaatgttcagcagcaaggtatgagaggtccgcatctcatgcacgagggtgtttttctcggcctctgcagccctcagatgttcccacgctctgttagacacatgcggcctgggcttcaggaagtagagatgcccgggggttatattttcagatgttctagctgagctcgctttgtctttcctcccaggcctggcaataatgaaactaggcagtgttttatctcacaggcagtggcgacttcattcctctttctaaagatgtaaaacaaaaggggatattgactaatgcaaaacttagtctgtgtggaagcaacttggcaaatggggaggatgaaataaaattgcacctaccgtttgtcttagctcagcctgccatatcaaaatgccacagactgggggcttaaccagcagaaactcatttatcatggttctgaaggctgcaaagtccaagatcacggcaccagctgattctcttcctagggagagctctcttcctggcttgcaggtggcccttttcttgctgtgtcctcatgtggcccttctgtggtgtgcacacacacacagagagagaagctcttctttttcttataagaacacccctcccatcatgaaggcccagccctcatggcctcatctaaccctcatcacctcccaaaggcccagtctccaaataccagcacattggtggggtgaggaattagagctacaacatgtgaattttggagggagacaaacattcagtctgtaggaccattctactttctattcctggctgtgggattaatgtccctgtggcccccacccacccactcacccacgcaccatatgccatttaaggatttcatggactgtctcaggtcagaaactgcttggacagatcacagctgtcctttccccttcactcttccctcccaagtcttggatttgttgtcaggagacatcatccagtgcaaaggaagaacaccatggatttactgcctgcttgtgcgctacctcattgcatccttaaaacaaccctgtgtggtgttggcaggtgggtggtggcatttctgttgtcacaaatgaggaagagggttgaataaagttgagtaatttgcccaaggccagtagatgagtggcctctgggacttggaagtctgtattttgctttgcatttcatctgttaacctggaaaaggcttcagggggttggagtgggaggagagccttctgcaggcctcttactctcaatcctgtggctctcagagttgcttctccctctgtgcatgtccatttctgcagcacagcagggccatgcccacggctccccaccactgcccttgagaactgggaagcagtcattcctttgctggttttctcaggaggcctgttgtgttgtggtatggcttccttgcaaacaagtgcatgcacactctgatacgtttttaaaaaaaaaagatgcaaatcactgcttcagctgctttgcagacagttagaacctacaggattagatgggctctgttataaggggacatctctcttgaaatttttttggacttacggacatttaattcagatgcagtgaacccagtttttctgttcattttaagattgatatgctttttctttttttggatgacagaagtgtatttgtggggtttttttgttgttgtttttgtttttttttttttgggatatgatctcactgtgttgtccgggctagtctcaaatccctggtctcaagagatcctcccatgtcagcttcctgagttgctgggatttacaagcatgtatcaccacagccagctagagtgcacatttttaagggcagtttgaggttggagggaggagggtggtgattgattaagcccccctgtcgttcatttgaatcctgcatcgctgatttaagtgttaatcaaatgcctgtctcgcctggctgcggggtccgatcatagttactgactcgcgctcattttatcaagatgtattaatgctttggagaaggtgtagttgagataaactttgtgtgtttatttagtaatctttgctaataccctcctggctttccactccacccctttctcatctcagacataccataggcaccaaggtgtggagccagtgaaagaacaggcgcagcgaacgttccggcaggcattgccgtgcacggacacacaacttcacaagggcctcttgtgcacgtgggacatggagaaaattggccatttgtctgtggggtaatgggctttgctgcaatatgaaaatctatcaaatgggtaaaatcaatgacattgtatcagagttcatgaaaagtgcctactgcacacagtttaattctatttaatttttttaagtggaaaaaagcaaaggaaaaatgttttagttttctcttaagctgatttcgctctgctttttcttaaaagtgcctttctagttgccacacagtgatgtgatcattatctgccacctcgtcgccttgctgcctctgcatgcagtaaaatacaaaaaaaagagagatagagaaagcaggggagcttgtgaagtatgactccctatcccaagactcattgcctgcgattcgtaccgcttgacagtaatgatcttattacagtactgtggaccttgaagagatttcatgaggagagtgaaaggacgaccctccgtgtaatcaagtggcgctgaatattccacgcgtttttgatcacacactgattgggcacagttttagcccatcttctagtcaattatgcatggcccctgtgctcctcgaatagtcggaaacattgatggctgttgtctgggttttggcaggcagccaggggtttgaagtgccttgtacatcgtcatcccaggataagtgctttttagttggaattgattacctttctttgggttttgcttaatagcaaaactgcatttggagagggcttcaggtgaaaaatggacatattagccattgagagcatccgaactcctagtcaatttttaggcttcccttgtttccgtctaatttctgtttaatgatacagtgtttgataatatttaagatatctcaccgcatttgccgctgagcacacatgttgagcgtcgaggacaggttcaattatgtggccactgtgttcaggttcccggattgatccgggggaggctctaagctttgaggagatctggcggttagtttccatcttggcataaaagcattaattatctaaagatcttttcatctgcaggaaaataggcagagaattcttcctactgttgagtggtcgctccgtgtgaccgtggagctcatgtcagcattgctaggtttgggctcagcctgctaccctgtgcccaaaagactttctcccattgtttcctccctcccctcgctattgagcttgaagtctggggacatttgaaaggatgggattgtttcttaccaaaatgaggcatgatgttgcctcttaagaaaatcagacaattaaaccaatgttactatgtagaagtgaaaactggtataaaccaagattttttgcctcctcctgttatgctcttaattctgattcttgtcttacggattgtcttagaatgattaggaaaacttctaaggtgttttatttttttgttttaacattttgtgcaaggctaaggaattagacaccccagagtatgtgatcactgtgagatgtttctcaaagtctgtcttgaacttgccaacacatgctgcctcggggcctgtggtcactaagcttatatgagggacgagagccgtagcattgctccagcaggtatttcaataacttgatttgactcttcttaattaaataaataggtagctttgttctttggcttgattattcatttgggtctttcttgctttcttcaggtaggaatgattttccccttcagttggttttctgcagaagccatgatatactgtaggcatggttaccagaacacccctaagagagctgaccagaatttctaagttcatgttccatgcgtacacacacacacacacacacacacggtgttattttttttctttctgaatttcatgaaaataaaatattttctaccagaatacacatttagtgatgcctctttcaaagaggaaatcaatcacgaaacagaaactcagagttgacaatctattagcaataatatcactatcaattattgaccactgccatgtgtcaggcactgggcttaagtgctttacacgcagcgtctcataaccctcacaagaacctgggaggtgggtgccgttatccgcatttttataactgaggaaaccgagggtcataaagtttaagtaacttgctcaaggccatagacgtagaaagcagcgatagggccaccgatccaggcgagggcagcagtgctcgccgcctctaacacatctccacggtgaccttcccttcccttggaagggggcgcttgtcttttcagcggtcttgcctccgaatcttggcttgtctaggattcttcctacagaagaagttcatataaaataaggggttttattatgggttatctgaagagtgtttcttaattttaataagttaatattccaaccataaaaacttctgacattttacccgaggctgtgcttcagcagattgacagaatgcatttttacagcacttagaaaataccagatccacgaagaacaaatgatcaaagtttcaaaggctgtaattttggaaagctggcatatataatgatgatctcttcgcagcctggtaattttacctggacaagtaaatccatttctcacatttaaagagaatcaaagagtcagtaaacatgcagaaacacttttagctgtgaatgcagagtaactcttacaattaacatataattacctcaacgggccaattaattaagcaatttaagatctataactattttcatgattttcccccaaaatattactttattctgcacaccgtggggacatcagctgggagggtcatagctaggaggtcagaaggaaggggggacgattcatgcaatgaggcactgctgttgtggggtgttggtttgaagaactcataaatggtaaaagtaacctgtattatcattggttctaggggactactgaagataagaattttcaaccttcctcttcgttgtctgctctcccaggctcattgaaggaacatagagaaggtttaggccctgtttcttttcgagcagcacagaaatacttgcccagtccgttcgtggaaggaaagaaccgaagccagcccttggctgccattctttccagacttccaccattgtgccctgagtggttccagaatgtcattgatgggaaattggttttctttccttctggacattcaaagattaatatgttactgtcatcagtgacttgttaccttctgtttctgattgccagctcatcagcttagtttgcccaggagagccactttttcccacgttcttttacttgagttctgagacaagatttgatacccattcatttataggccaaatccagttcttattttaattttttttcccaacccctaaaaagcatttgcaaacactcctccacactgttcagatgagcgatgtgtgagcatgaggagacattccttaagccagcctggtctgtggaggtgtgctcactgctgcagggccatttgctgagcaggaagctggcctcaggggtctcccaggatgctggggctggtggacgaccccagagaagggacaggatggggggttatggaagtgcccagcaaggggagctgcaggagggtctctttacaggtgtgcaaaggaccagcgctgctgcagggaacatggctgggagggcatccaccggggcaggggtctgggcaaggggcttctccccttgctaggccccctccttttgttcagctcctcctctccagcaccaacctcccatcactttctacattctggcccctttttctcctttccttctttctcttccattctcctttttcctgtaagactgtccttgcttctcttgtttaatttcttttttcttcttttcccatccataacctcatcattgtctttttctccctttcttattctcttttttctttgaacttttttttattgtggcaaaatacagtcatgcatcacattacaacattttgttcaatgatggaccaagtaatgtgatggtggtcccatgagattataataccgtgtccttactgtgccttttctatggttagatgtttaaatacacacttcccattgtgttgccactgcctacagtttttgatacagtcacatactgtatgggtttatgccctgggagcaataggctctgcacatagcctgagtgtgtggtagccacaccatctaggcttatgtatggactctgtgatggtcacacaatgacaaaatcgcctaacgacacatttctcagaatgcatcacttaacgatggggatacatggctgtatgtaacataaaatttgccattttaattgtttttaagtgttcaattcagtgccgttgaattatattttcacattcacagtgctggacaaccatgaccgccattcccaaaacattttcttcactccaaacagaaatctgctaaccattaagcaacaactccccagcccctacttctcccagcccctgtgacctccagcctgctttctgtctgtgaatttgcctcatctggatatttcatatcaaaagaatcatatgatagttgaatatggatccttttgtgtctggcatcttatatttggcataatgttccatgttgtagcatgtgtctgtacaccattctttttaaaggatggataatattccatagtgtggatttacaacattttgtttgttgacagacacttggattgtttccgccttttggctgttatgaaggatgctgcgtgaacattgtcacacaagtatctgtttgagtccctgttttcagtttttcctagggtataaacctaggagtggaattgctgggtcatatggtaactctgttcaacttttcaaggaaccaccaaattctttttttttttcctttatttcttaaaaaaaaaaaaaaatagatgcgcagattgtgcaggtttgttacataggtatacatatgccatggtggtttgcggcacctattgacccatttctaagttccttcccctcacccccgacccccaaacaggccctggtgtgtattgttccccgctctgtgtccatgtgttctcgatgttcaattcccacttatgagtgagaacctatggtgtttgactttctgttcctgtgttagttcgccgaggaagatggcttccagcttcatccatgtccttgcaaaggacatgatctcattcctttttatggctgcatagtattccatggtgtatatttagcacattttatttatctagtctgtcattgttggacatttgggtttgttccatgtctttgctattgtaaatagtgctgcaataaacatatgtgtgaatgtgtttttatagcagaatgatttatattcctttgggtatatacctagtaataggattgctgggtcaaatggtatttctggctctagatccttgaggaatcgccatactgtcttccgcaatggttgaactaatttacattcccaccaacagtgtaaaagcattcctatttctccgtagcctcaccagcatcttttgtttcctgactttttaataatcaccattctaactggcatgagatggtatctcactgtggttttgatttgcatttctctgatgatcagtgagttgagcttctttttcatatgtttattggctgcataaatgtcttcttttgagaaatgtctgttcatatcctttgcccactttttgatggggttgtttgtttcttgtaaatttgtttaagttctttgtggattctgggtattagccctttgtcagatggatagactgcaaaatttttctcccattctgtaggttgcctgttcactctgatgatagtttcttttgctttgcagaagctctttagtttaattagatcccatttgtcaattttggcttttgttgcaattgcttttggcatttttgtcatgaagtctttgcccatgtctatgtcctgaatggtattggctaggttttcttctagagtttttatggtttgggttttcatttaactctttaattaatcttgggttaatttttgtaaaaggtgtaaggaaggggtccagtttcagttttctgcatatggctagccagttttccgcatatgactagccagttttcccagcaccatttactgaataggaaatcctttccccattgcttgtttttgtcaggtttgtcaaagatcagttggttatatatgtgtggtggtatttctgaggtctctgttctgctccattggtctatatgcctgttttggtaccagtaccatgctgttttggttactgtagccttgtatatagtttgaagtcatgtagtgtgatgcctccagatttgttctttttgcttaggattgttttggctatacagggtcttctttgattccatatgaaatttaaaatagttttttccaattctgtgatgactgtcaatggtagtttcataggaatagcattgaatctataaattactttgggcagtatggccattttcatgatattgattcttcctatccatgaggatggagtttttttccatatttttgtgtcctctcttatttccttgagcagtggtttgtcgttctccttgcacacgtccttcacatcccttgttagttgtattcccaggtattttattgtctttgtagagattgtgaatgagagttgattcatgatttggctctctgcttgcttattgttggtgtaaaggaatgcttgtgatttttgcacatttattttgtatatcctgagactttgctgaagttgcttatcagttcaaggagtttttaggctgagatgatggggttttctcaatataaaatcatgttgtctgcaaacagagacaatttgatttcctctcttcctatctgcataccctttattttcttctcttgcctgatcgtcctgaccagaaattccattactatgttgaatgggagtggtgagagagagcatccttgtcttgtaccagttttcagaaggaatgcttccagcttttgcacattaaatatgatattgcctgtgggtttgtcataaatagctcttactgttttgagatacattccatgaatacctagtttattgaaagtttttaatatgaagagatgttgaattttattgaaggccttttctgcatctattgatataatgatgtggtttttatctttggttctgtttatgtgatgatttatgtttattgatttgtgtatgttgaaccagccttgcatcccagggatgaagccgacttgatcatggtggataagtgttttgatgtgctgctggactctttttgccagtattttgttgaggatttttgcattgatgttcatcagggatatttgcctgaagttttctttttttgttgtgtctcttcctggttttggtatcaggatgatactggcttcataaaatgagttagggaggaatgtctccttttcaattgtttggaatagtttcaaaaggaatgataccagccctttgtatttctggtagaattcagctgtgaatctggtcctgggctttttattgttatttatttatttatttatttatttatttattggttggtaggctattaattactgcctcagtttcagaatttgttatttgtctattcagggatttgacttcttcctggtttagtcttggtaggatgtatgtgtctagaaatttatccatttcttctagattttctagtttatttgcatagaggtatttatagtattctctgatggtagtttgtatttctgtggggtcagtggtgatatcccttttatcattttttattatgtctgtttgatttttctctcttcttctttattagtttagctaatggtctatctattttgttaatttttttcaaaaaaacagctactggattcattgatttttttcccccccaaaaaaccagctactggattcattgattttttttttttttttttggagggttttcctgtctctactctatcaattcttctctgatcttagttatttcttgtcttctgctagcttttggattagttcgttgttgcctctctagctctttccaatgtgggcatttagtgctataaatttccctctgaacactgttttagcggtatcccagagattctggtaagttatctctttgttctcattggtttcaaataacttcttgatttctgtcttaatttcagtatttacccaagagtcatttaggagcaggttgttcaatttccatgtaactgtgtgagaaccgccaaattcttctcttacatcattctgtgacttcaccttgtcctcatccgttcatgcgtaatacggaattaaagaagctcctgtaattaggctccctcctaattacaaaaataggtgatataaacatgttaaaaatattgttgctttttccagaaaatcaaaccgaaagtatgcagaatgttggtagttaaaactccttttgttattttgtgtttgttcgtttgttctgttttgttttttgaaacaagagtctcactctgttgcccaggctggagtgtggtggcatgatctcggctcactgaagcctccacctccaaagttcaagtgattctcctgcttcagcctcccgagtagatggggttaaaggtgcccaccaccacgcccagctaatttttgtgtttttagtagagacagggcttcaccctgttggccaggctggtcttgaactcctgacttcaggtgatccacctgcctcggcctcccaaagtggtaggattacaggcgtgagccaccgtgcctggcctaaaactccttttgattggtgcgtgggtgacaatggattccctgtccctgctgccatgaatcagtcgcacctgcttcagatactactcagaatttcttgtccttaaatgccacccccaacccccgccccgaagtcaggaagtgatttctgaactttagcgtaagtgttctctggcaggtatggctgtttttctgagcagtaggtacttagtcaaggcatgcaggcgtttctccttgttttagttcatctgcagaggtcagctttttccattgtctctgaaacacttgcatttttcctgtaactttccagtaatgagggggcccagtgggtaaatggaatcttaaagacgagaaatgattatttttttcccgccgactccactctggccaagacgagctctcagattgcacttcagaatcggtgatgcgcactcattcccctgcacccacccttttttctgtggtcagcatgtgtttcccagactgggcgtcactgtcgcctccttgactctcatcactcacatggtcccccagcaggtaacttgcttcagcgccactttgcctgggtgctggtgatcctccagttctcacacacctgcaccttggggtcgttgagttttagtttaggtcttccgaggaatgcacagaccacacgttgtcaggcttcccttggccaataatgtggagtcttttggtttttctgttcttcagagtttgcatcccctgagaattcctctcctgtgtccttcaaataataatgtgagatgaagatgatgatgatggttgttgttatttaaaactgcaagacgtaggcaataccaggtcttaacagcttgttgtctgtggtgtcttccttcttccctggaattagatatttttcgttcaagctgctgacaggtatttattgaccaggtactgtgtagaggtcgctgctgcgtgtggcttcacccagctcctctgcccatctggtgactttgcaagctcacaatgtcctgaatgaaaacctagttcctaagcccttcccccaactggaaccatggagggaggaagaacagaccaggtgaaaacatcaggaggagggtccgcagctcgatggtgatgagtgtaggggagaggtgggtgctgggacaggatgagctgggctggaggagggtttgccctagggaggcagccccaggcagggcctgggcacactggtggcgtagctgaggggctgcctgcgtgcaaggaggacatgaggccacatacaaagcttagggccacccaggaagatgtgggagaaactagaggggattaggagagttcgggctgcaccagctcctgggtgttggttggagaaagagtcatgaatcaaggagcccaggaggacggggaatccctggaggaggtgggtcagtgggaggaggactgaagacattggcaagcatcagtccgtgcgggagacgtgcatggagtggaacggtcacagcagcagctcacagggagggacagcctcggaagaggaaatccatgcgtcttccttttgcccacaggagaagagatgaaagagaggggaggggctggccagtcagcaatctggacagtttagatcattcaaatgcgtagccggggttgggaaccagtggtttaggttaagatcagctagatctgtgtgaaggaccagtgtctcacggagattcagactcataaaaatgtgggccacaccccaggacccacagccacacaagccgttcttatgttgtcccaagtgctctaccgttaggattcctgttaaaaccttttttaatgtttttcctaccctgtcttattggtttaaatcaaattgcagaaaaataaaagctcaaatattatctgttatgtcaaagttactatttgagctgtagatgctgttttcaaaacagatcatcctccttaaagcacccatctctctccactgacatgtgcccctgtgtccagccgcaccttccagcagagttccctgcaaagacgcttccctgcagcctctgtgggtcaggaattagaatgggtgcagctaggaaggcctgtgtctgcctcgtgatgtttggggcctcacctggaagactcagaagccaggactggcaacatcccgaatcccagtcactcgtgtgtttgatggttgatgctgcctgttgggtgggacctaagctggggctgtcagccagaacacctacacatgacctctgcaagtggcctgggcttccttccaacatggtggctgggttccaagggcaggcatcacatgagagaggtacatggctgggcagaagtcttgtttcctctgtgaccttgcctcagaggacacagagtgtcaattttactccatctgtagtcaacacagtcagagtcccacttagggtctagggtagcagaaatagactctgcctctggatagagagtggcaaggttctagaagagcatgtggactaaaatatgaccatggccatttttggaaaatgtaatttgcaacagtaaataagtgaatgtgtattatgtcagattgtgatcaacacaatggaacaagatagagtaagaggaattgggaccaccaggggtggggcaaggttcttttctgcaaaggcagccaagcagggctcaccgaggagaccacatagcacagcccagcaaaggtgaggctgtcgccaggtggccctctgtggtcggcatcttcctggccagggaattgtgtttgcactgttgtggtggccaccttaaactgagtacttgtttgtagttaacatcacgtgctatatgcttatgttctactgtattgtgtaaaacaagctgaattttacctagatttttgtgttgtacttattctctggtaatatgactggagaagtattttatgtctcaagaattattatgcatttcttatttctctgtcctttaattttgaagggtcagtataaaaatactttattcagtatattctagctcattctccacatacaattatattccaatatttgtagggtttattctctccaagcagcatgatcaatcagaaaattggacagttttaaaaagtggtccagagaaccagcaaatatgaaggcaggctaataaaaatgcatatcactctaacagtttcaaggcagtttcctcgggagactgaggtgggaaggtcgcttgagcccaggagttcaagtcctgcctgggcatcccagtgagaccccacctcttaaaaaaggaaagaaaatggttttttaaatcatttcatttcgtataagattattttgcgaggttggtgcatgacattggagttgcccagcaattggaaaaagacatgagcgtttaatactgggcgttctttctaaggctcttaaagtgaaggcaatcacataaggctatcttgcttcatgggtaattaaggcatttccttctgcagttcccaaatctaatgaagaagaaggaatttctcttttgctgaaatatttcttgtaaggttttcatttcttctcattgctccgactttggaaaaatgttctttttacctctgattttctcttgtaatgtcttcttgaattgtgagtcggggaaaaaagtaaaagattcgctacagattcagacttgcaaaaaaacgcttagaatcttgctgtccgtaaaactgaaacatccagcctcacaaatgtccacatttctctctcatctgtgaaggcccgttgagactgctcagttggtgtctcctctgtccacaggacatggccgtagccgtgtgtggagaagggttgtgatggtggccatcacgagacccagataacaggagtggttagaagcgcagcggaggagcctgtcttcctgggtccgagttgcgtggttaggagcgcagcggaggagccggtcttcctgggtccatgttgcgtggttaggagcgcagcggaggagccggtcttcctgggtttgagttgcagctccacctcttcctggcgggtggcctgggcgagtgcctcacgctcccgtcagtgctctcagctgtaaaatgggaacgatcaggttgtctacctccaagactgttgtcaggattcactcaatgaactcctgtgctttgagtgtctggcgttcagtggcaggggaccctccatgtggggacagagactgccacccattcctttctgaggattcagttcttatagactacagtattactcgtgggagccaaattatgtgcagtgtattttcagattttattgactcacctaagaaaggctcggggacactgttgtgttctgatgtaagagatcacttgttatattatgctttttaaatgttgaaggcaatactcatcagagtatgcattaagtagcattgaaccacatttttaaggtgactcttcaactcaccaagaatatcgtggccgctgaggtcctgcacacctggggatgcgtcgtgggcgccgaggagagcgtagcctcctgttaacgtagcctcctgctgctctttggggtagaccagccgtttccacgcacaggctgcacattgtttcatggcctttgcagttgagcttgtgttggcctctttccgtcgtgaaccatggacgtctctccttgacctcctccctacctgggagaacctggctggccacatagtggaactggaaatgcctccatgctgacgtgtctgcctttcatgaaagatagtagcaaaagttattgttatacgttacaaaaaaccagtttaagacatggacttttttcatatgtacatctgaaaatgactttagcagagattctagctaatacatggagttgtgcttcctaagtattgatagcggcgtatatataggattcccacaatttgcagttgtacagttcaaacaccaaactgtttgtggggaggagggtgatttgcagtgatcttttcctcaactcaggccagtctatacaatactattgatatttactgccttggagcagccttggcagccttgtattctgagctgctgtcagtggtttaaacatttcacttgggttagccttgtcccttcgactaggctggaagcccaagaaggcaggagactcgtctcagatatttcctggtgtccctgaaagtccagcacagtgtgtgcacgtggtatgtccctgatggaaactgcttctcaaagtggaagacagggagcacctctgcaggcctatagggaggtagtaattggatttgcgatgtatttcttttctgcaagtatggttttgtgtgatagaaaccaatgcttcccaaagttcacattgtggaaactgaagccagcaagatactgtgaaggaaaatgcttggagaatgttgcagcctgtgtccctgttggagtttttgctgcccaataccaaattaagggctctgaggaacgcttcctttgaaaataccctagtttaacttaaactctttcttaccaaaccagctatgccacgcccttctgctttggctgtgtagatgctgttccagtcctggggagcacaggtgtgtcctcacgtgcgcttggagaaagtggagttttaattacttacccagcaacattcaggacgtcctgagacctcgtcacttctgatttgggaaaagtctgtgagcaaatgggattttactaatatgaaaacccagaacattccagatgtcctaggaacacaggtcctaggtgtttttttttagcttgggaaagttacgatgacccataagcctgctccacaggatggctgtagcacagacaccttcccctgggacccccattggctgtgtgtcccccagcttctaattcctctagaatatcatgcccaggttaggcactctttctgtattccccaaagcttcataacatggttccatatgtgtcctttttaagagtcttgtcgtttcatactctcattttggcaagacaccttcgtcttagagtgcctacatccatttctgttgaaactggtcatagttagcatttctccatgtctgtgcttttatgccctcctgaaagctggttccatttaggggtgttccctgtcattttcgtgctgtgcaatagttgatgaagataacatagtttataacgcacacctcaaaattcatttcttctcacgtaacaactttcttagtgcttgtacttgtgtgcctcttggagttacttgttgataggacagcgttaagggggtcgtttctttctggtttgaaagttgagaagtaggtcatcactgtcatcgtcatagtggggacacactgagaggttactttctaccaaactgtttcctaattgcactccctgcattgtcttattcagtcccgactttcccaacgcctcgcagcccgatgatacagagacggggcagcagtggagagctcggctcaaagtgcgaagttgtttagatttccacgttacacaaacacacaagcttctcaggggaagagcatgatgaatttctttctttttttttttttaaactaaaattagaataggccgggcccaatggctcacacctgtaatcctagcactttgggaggccgaggcgggcggatcacgaggtcaggagtttgagaccagcctggacaaaatagtgaaaccccatctgtactaaaaatacaaaaacattagccaagcgtggtggtaggcgcctgtaatcgcagctacttgggaggctgaggcaagagaattgcttgaacccgggaggcagaggttgcagtgagccgagatcgcgccttgcactccaaccagggagacagtacaagactctgtctcaaaaaaaaaaaaaaaaaaaaaaaaaaaaacagaataagatacaacagtatcttattctgtaccacagtagtaaatatgttatttggaatatagcttataaataaaatatttaatttacttaaagctgtcatgcccaccaccctcccatagtgaaaaaccaaagaaaaggctaggcccagtggctcatgcctgtaatcccaacactttggggagccgaggtgggcagatcacttgagatcaggagtttgagaccagcctggccaacatggtgaaacctgtttctactaaaaatacaaaaattagctaagcttggtggtgcgcacctataatcctagctcctcgggaggctgaagcaggaggattgcttgaacctgagaggcagagtttgcagtgagccgagatagtgccactgcacttaagccttggtgacagggcaagactgtgactcaaaaaaacaaacaaaagaaagaaaaaattctacttaaagaagaaagaccctctgtgcatcatagatggcaggcacattcaccgtgcacggcagccccacaacaatgtgtggcagacaaccttagcagggcagcttgacactgcgggtccgattctgccatcaagaaagctgcacagacctcatcagaagccactgatgctttggtcctattgaggattccatctctctgtctcggagccatactctagatgcatcactgcaagctgtggcctgagtgtggtgatggtgaggatgaccctgtggtggtattcctttctttcttgcctctggctcttctctccctcactttccctcacccattgccaaaaatgggtttggaggtcattgtgcagtgggtttggaggtcactgtgcagtaggtctggaggtcagcctcaataaaagaccagttttcagccctcacagcctccctgcagtgttattagctgttcctgatttggatgtgtaagcccaagccgccacgtgggctcggaggggtacagagattaactggaggcttgccaaccgtttgtcacacaaatagcagtgccagttaactgagatacgataaatcatttttctcaagattgaaaccttttatcagttgtgtcagtttcattattcgataagcaattagtagcagccattgtcatttagttatctgtagttaacaactcaaagctgctgccagcagggcacccgcttgacacctgcacccaggtggaaacccgtccactgcccacctctccagcagaaattaggccaaactcgcctcctactgccccttggccgattggagattcgtatctgacaggtgtcttctaatttttttaacttacgctctgacacatagttaagttgtgctgtagttaagagaatagtaaacaggtgagcattattctattaccacctactgatccttttatgaaaatattcttgccttttaatttaaatgccaaccatcttgattagagaaatagtgttattccttcctgcacccaagccctgacgtcagcatgacctggcggtagagccagcccctgccagctggctgcccccggggaccttctgttcaccatcaagcggcagttcatctggagtaaggagagaggctggagcacagctcccagcctgcaggaacagacctctggagatgccaagggcctgaaatctgtgtgtaggtttatgtagacagaagtaaccatatattgaaattgtggttaatggaaagcaaagtcgttttagaatgttgccaaattgtgctcatcaaaagacgcctgcatactttttaaaaattgggaaccactgaaagagattaatccttgccaattttttcactttttcactcaagtctaatttatcagaaaaaataattccaccactagctaagtgtaggagaagaaaaaaatcactgaatgtatgtatcattgagacctatttaattattctaccagtgttctggctttacccataatgaagacaggagtgtgtgtgcatgcataggtacatagatacatgcatattgcctttaatgaagatcttttttgttgttgttgttacggagtttcactcttgttgcccagactgtagtgccacggcgcaatctcggctcactgcaacttctgcctcccaggttcaagtgattctcctgactcagcctcccgagcaactgggattacaggcgtgcaccaccacgcctagctaattttgtatttttagtagagatggggtttctccatgttggtcaggctggtctcgaactcctgacctcaggtgatccgcccacctcggcctcccaaagtggggattacaggcatgagccaccgtgcccagcctaatgaagatcttttaaaatataactcataatttaagacgtcattctaaattgcatttctaatgctttccagcacctttctctactaccttaaggttagtgtttggtatttttgtagcgcggccatacatttttgtgaggcctggagccctgtcttgtgccttccacgcccgcagcatctacactgactgtgtggtaactgcccactgtatgtggggactgcatatgttgatccttgtgaaagcttttggtttattgtttaagaagaagcggttttgagagcttctcagccactccagctccccagcgcagtccgtctccagaatcaccaataaaaacttttttttttcctaactaaaaaatctgaagaccattcaaatggaaggttctggtctgccctcttaattgtatagtagctcagtcccttctgtagggattgtatttttaagaggacttcccagtacatttgtttatggggtattctttgaaaccacgagccacagtcgtcttccacgtagcatttcggggtctcggaggctggtgttacacatgaagggcccacagtttggatgcagttaggtcactgttatctgctgttttactctgaaagtggaccccaggcatttttaatttcagtgattaacaaaatcatgtcagtaaactgagagactaacaaaggattgaccaactttgagttttgccaagcaaggatatttaaaacaataaccaccgtggactgccaccatcatttcatagaagaagactgcataagtgcccacaggagagagcaagcgttaagctctggccgaggtacaattaactgacttaccctgatgctgctcagagcctctttttctaattttattgcagatgggagaaaaacattttgtattagtgtttaggaagctctgctcagttaccacctagtggagaaatctaggagaaagggctaaagatgacctgagacatatgtcaggtttccttgactccaggaacaggagtgagaagatggatgccttggaggtgagccagcaggctccagggtccctctaactgagcccctatcttacccctgaaagctgtggggcttcaacctagttcttacacctctggaatggagatagattagtacttcactcatggaaaggctgggaaaatggaatgagataatactttaaggccaactttctaaatataagtctatggtaagtgctcagcatggtacctggctcagcaaaagttagggatggtgacggtgatgatggtgagaggtggtggtggtggtggtggtgacgatggtggtggtggtagcagtgatgatgatagtggtgatgatgatggtgatggtatgatgattaatatggtacagtggtgatgatggtgagaggttatgaagggggttgtgacagtggtggtaatgattgtgaccttggtgagagttggtgatggtggtggttgtgagtgtggtgaccatggtgagagttggtggtggtggtggtggtggtggtagtggtgacggcaatgacgatgatagtatgatgatcaatatggtatggtggtgatgatggtgagaggttatagggctggtggtgacggggtagtggtggtgattgtggtgacagtggtgagagttaatggtggtggtggtactggtgatggcaagaatgataatgatggtatggtgaccaatatggtatggtggtgatgatggtgagaggtggtggtggtggtgacaatgatagtgattgtggtgacgatggtgagaggtggtggtggtgatgatgatgataatggtgatggtgatgatggcagtgtgatgaccaatatggtatggtggtgatgatggtgagaggttatagtggtggtgacaatgatagtagtgattgtggtgacgatgctgagaggtggtggtggtgatggtgatggtggtggtggtggtggtggtgatgatgatagtggtgatggtgatgatggtagcatgatgaccaatatggtatggtggtgatgatggtgagaggtggtggtggtggtgatgatggtgagaggtggtggtagttatagtggtggtgacaatggtagtagtgattgtggtgacgatggtgagaggtggtggtggtagtggtgatggtggtggtggtggtgatgatgatgatagtggtgatggtgatgttggtagcatgatgaccaatatgatatggtggtgatgatggtgagaggtggtggtggtggtgatgatggtggtagtgattgtggtgacgatggtgagaggtggtggtggtgatgatggtggtggtggtggtcgtggtggtgatgatagtggtaatggcgacgatggcagtttgatgaccaatatggtatggtggtgatgatgctgattatgatgttgttgggagcaggagatgaggaacctgtatcttgatgcttccctgaatgttgggggtcaggtctgagatgtgtcaagcggggcagtgttctgacttccattcattaaacttgtaagtcacgatttgtgggtgctcctgatgtgtgcccataacaaacctgctacaccaagaacgtagttttatagtcatgagttccgaatagtctcatagaccattgatcctgcttctaatgactgtcagaaagaatacgtgaaggccagcttctagaccagtgtcctcacgtgcaggcgtcctcgaaggtttgtttgttagtagccataaccgtgcagcatccatcgggaggacacacacccctgcaggccagcttttgtctcaacatcactggagagctgcatattacgttgttatttttgtctttccaattacactaactcctcactcaatgtcattcatcaataggttcttaaaacttcgacttgaagcgaaaggacttataatgaagccagtttttttccttatcagcatcataatgaaacaacgtgggaggaaacaaagttatttgaggacctgctgtacacagttttgcttaaagtcacacatttccaagaacctgtcaatggcattgaggactttctgtacaaaaatcactacgcgtgacagctcaaataataaacagttgttcagagacagtggtactgcgtccccctcctccagtccagtcccccaccctgagcgttgatggtggggtgtgcatcccccaccccccaagcctgttcctagaaggccatggcgcacctgctctgtgcagaggctgggcgaacaccagcccgagcctgacttaagcaggatgggcatggacatcgttggcactcacttccctgcagggaggtgcacagtgaagaataaaacacaggtgatttcagatagtggcacatgcctgaggcaatcagccccgatggtgtggcggggcaggtactagagattgtgtttgcagtgagggccactaaggggggcggagaagacccctgacagcaagaaggagccccacttgtgctgttctgtaaggagggtcttccaggcacagagagtggctgatgagaaagggcctgtgtggaaggaaccagggccaagcgagggaggcagatgccgcgtggcgtgaggagggtgagagtccatgccataaaggactgtcatccatctgtcattggctgaattgtgacctccagaaagagatgagttgtcctaacccccactacctcagaatgtggcctcatatggaactagggtcatggcagatgtcattagctatacaggaggggaggggatggaccctcagaggcgagacggacgtacaggaaacaccacatggagactctggcggtggctggggcagcgcggctgtggggcagagaatgctgagataaacgccaccatcagaaaccaagagaaaggaaagggacaggtcctccggggagccttcatggggagccctggcatggccttcaggcctccgaggaacccagaggaggaaacgcatttttgtggtttcacgccacccagcgtgcggtgcattgtggcaggtgcaggccgctagtgccccccacccagtctctgtgtcctctgcacagtagggagctggggaaggtgtgtggctactaacgtgagcctgttaacgttgaaaatttccctctggcggctgggcagagtgggctgcaggggctgaagtaggcagtggtgacagtggcttccccaggcatcagcgccacaggaggagagacacagactgtggcttgcaagcagagctggcaggacttgctgaaagagttaatatgggaagtgagaggacacagaggccagggccgggagaccaggaggccgagagcggtagaacgtcacatcctggaggggcggggatttccccttttgttttgtttctgtataagatcataccatgtatattctggaattttacttttctaatttaacaccccgtgggtctccagttcttccacaagctgtttgaaaggccacagggcactgcgtggaatgcgtggtctctaataggttatgccagcccctctcgttgggcattgaaattgcctcagcagtttttttaacaattaccagtaatacttccctgaacatcattgcacatacattctgaagcgctcacgctttgttcctgtggacatctctgcctgattggaagcttgcgttgcacattcagcccacgcctccatggctggtcctggactgggtgaggacaccatgagaaacagctagacttgggatgtctgtgttgacagggccatgggtgagaacagagagtttctcaagcgacatgccaggaagagctggcttccccgcacaagcagtgctaccaagggtccatttgttactgagtcattcattcagcagactcgttgagaacatgtgtggtaggcacgtgctgggcactgaaaataaacagacaaacacaacatgacccacgcacccagcctgagcccaggaggctcctggtcccgtcctggaacagccggtgactcaaagctcaaatatcatccccacctggacagtctgcaaatgactttccttcttccctcatcccctttcccatcctcactctcttccaagtatctgattgcacgcatgtgcacatgtgtgagtaggggagaggctgtgtgttttcataagcgaatcctgattttctgacaaaagagacatgaaacaaatatgttaacaagtaatgttgctccctctcatgagggggtcactggctgcccttatagaaggccttggaaagaattacttcatgcattcctgttcattggcggtctttggcctttgagagtggaactctgcatcttcttgtccctcctggatgaatacaggacacttaaacatttaaaggggggacacagagatgggcaggactgtgagagtccccctgaaaagcgagatttcatagaagtattgaattttaccaaaagtttcagaagtccaattcattattagatttctataaatataaatatttatatgatatttcttgcgttgaattcagtatgtgctcaagttaagtgtgatttgaaaaatgaccaagtctcctaaggtgaagtttgtgtgtgaacaggagggccggggtcgctgggttccaggcgcagccatgagacacctgctctgcacccagctcttcttttgttttgctcaccgagaaaaagaagactcgggaaccacagaactaacacagaagtaagttagaaaattactcacgtattcgcccactgtgtgccaacagagtcttgatctattgcccaggctggagtgcagtggcacggtctcagctcttactgcagcctctgcctcccaggttcaagcagttcttgtgcctcaaccccccaagtagctgggactacaggcacatgccgccacgcccagctaatttttgtatttttagtagagacggggttttgccatgttgcccaggctggtctcgaactcctggcctcaggtgatctgcctgcctcagcctcccagagtgccaggattacaagagtgagccaccacgcccagcccaggatgctttcttttcatgggtctttgtcctttggagggccttgacctcacgcagcaggggaggatgctggcccacaccaaggcaccaagattttacccacctctgtgtgtggtcgcacgtcctcctcatggccacgctgggatggaggtggactctgagcacagacaagggacccatggcccagagcccagagtcacccgcagcccccctgcgctgctgctgcccgcatggggtacccttaagtcccacatccaagctccctccaccccacactctcccttggatttgcgcctgttctttctctggctgtgcacctggcagtgctgagaggagagcctggtgggcacttccaccctgatcaaattcagtcattaaccccactgaaacctgacaaggcctgtgtgcagctcactgtggaggggtcactgctgtcctaccacttttttttttttctggaagtttgcatgtcctacactatctataaatatgtaactttttttccaaagaacttaaaatgaaagaatatgagaaaacccctaaataatacatacatggtatagattgatgcataaaacagtcagcccctggactccatggctctgtggaatgggcggtttagtattcctttttctggcaactcacttagggcttttacaggtgcaatgagctttggtgaaaatagccaatgggcacctcgtatcttgtgccccaaatattcctatttagcacagtgtattctggatgcctgagtgactgcaaaccctcctcctgtgtaactttgttactgtttttcctgtctcaggaaagatgctcattttgtctcctgactgtggcagttgggggtcttgagaccattcctgagtttagaccttcccaggggagatcagtgaccacagatgtgcctcggtgaatttcacaaacccagcttagcgtgacccaagtttccagctttaccgaactttgtcattgttattaaaaagatgattttagtgtgctgattagaaactgggatccacattcaacataagcacaaactttttttcccagtgggccaaagctcatttctgatcattaaaagctaatcctgaaaattagctggagcatggttcaagcatacgttgtaatctgttaaaagcaaaaataataatttcaagcagtgttctgcgtctgtgtggaaacagctggtctaccccaaagagcatcaggaggctataccctcctcccacaattccaaataaaatatatggagacagcacagcatccggaagaactggcattggtaaattattgcctccaaagaatattagttagcaaacatactttgaaagccatcttcacaatcataaattcaatagtacttctttcagtcacaactgaatgccagttggggcagcctttcgagttgttaagcagtttagtagcaaatgtgacatatagtgtgtgtgccacagtaagatttcaaattgtcattaatttgtaaaatttaggagaagaaatgatatattgtgacgagataatagttttctctgtatgtactccaagctatcaaatacttctagcctttaacttggcagtgttactcttggcattttattctatggaaacaactgaaatgaatggaagaaaaaataatattcctgttcaagatgcttattagagtgtatttgatagactttgttttctaggaaagctttagacttttagaaaaattgaggagatattataggttattcccataggcttcccaccacttccccctgacaagtttcccatgttttttgtgtgtgtgtgtgttttggtttttgtttgtttgtttttgtgacagggtctcactctgtcacccaggctggagtgcaatggtgcaatcttggctcttgcaacctccgcctcccagactcaagcgattcttgcccctcagcctcccaaatagctgggactacaggagtgtgccaccggctaattttttttatttttggtagaaacgttgtttcaccatgttgcccaggctggtctcaaactcctgacctcaaatgatccacccacctcagcctcccaaagtgctgggattacaggtgtgagccaccatgcccaccctctcccctgttaatttacctctttcattagtatggtacatttcttagagttcatgagtcaatattgatatgtttttattaaagtccacactttatttgcatctctttagctttaacctcatgccgtgtctctgttccaggatccaaatcctattccattgtcatgcctccttagccttctcttggctgggacattttctcagacttttcctgtctttgatgaccttgaaggtcttgaggcatgctgggccaggtgtatgataggaatccctctactggaatttgtgcaatgcttttctcaggtttcatcttgagttacaagttttgtggagaaggaccacagggtgaagtgctatttccatcctatcctgtcaagggtatataccatcaactttatttatggctgctgatgttgaccttgatcctttgacttgaggtagtgtctgtcaagttattctgctgtaaagtcattgtgcccctccacagcccatactgaacttttggaaggaagtcactgtgcacttaaggagttgggcgttagaccccctgtccttgagggtggggtgtctatgtaaattttttagaattcttttgcaggggagatctgtttctctcccccatttatgactatattcagttgtctatttgtattcatgtggacttgtgaatatttattttgtattctaggctgctatccaatactgctgtggcccagattattccacccgtggctcctgggggctcctctggctgctcccacaccctttgccctacaccccatctctgtggggtttcttttgtttgagcactttccttcctttctgtcagtacaaggtgcattttgtatctttcctgccacaatcttagaatcggctgtttcccaaagagctctggttccttttactggagaatggtattagaaaccagtgtcttggagctaggcgtgctcgttgcttctggggtgccatttcttggttctcttggccaacagagtaaagaacgaaatgtgtgtatactaacctgcatatgcatatatatctacaaatatttctatatgtaaccatctgtatctatatttaacagatttcatattcttactggcataaaattggaaataactaagtgttttaacatgaggaatggctacaactatgttaatactacctccatgatgcaactgttataagggacaggttggaaaactgtggaaacataatactttacattaaaaagtagtattttttattgtagagtctccaacaaaggtctctgttggagttacgcttacaatgtgatagttgtgtgtgtgtacggatatgaactttaaaggaaaaatggaaaaggtagataagccatggcttattcatattaaactaacataaaattaactttgcttctgccataatgttagtcttccagtgagttcttgctgaaacctgaatgaagttgatgtatttaattttaaatgaaagaaatgagacactttttattccgttgttgtgttagccctgcagtgctttttcaggccctcccagattaataatgaccttgtttactcattgacagtaaccaaagagcctgctaaaaaagttgtgaagttaaggtcaaagcagttttatgggaggaaatctgtgagtgtttaaaggaaggatttccataatagcaagaagagcccaaagttgggaattcttcttttgcttttccactctgatctttgtattaatgcttgattgactgaataaatgccatgtatcttatggttttcatgatgatttctcaagccacacgtcaggatacttttgggaatttccagagaagtccttaaatggaaaagctaaaattatctctagtagatattttcaccagtcttcagttcagatggcttacatataagaggagcatgattgactggataaccctgaagtgtatcatttcacccgctgtagttgtcagaactcaactacaaagatggcagatcaaatacttcaagaagggtggttgtttgccattgtggaggctggtggtccagcgatcacagcccctcaattacggccctgcgtgagagcacaagcagcagtcattacataattatacctctgattagttggttgaactggccattgcctttgaaatatgataacacaatttggagttttattaaaaaacaatttttttggaatttttgaaaaagattttgtgtttaagaaaaaagaaccaaagggcctgcaatatattctgttagaggagattaaaaagaagaaagggatgagggaaaaaaagagatgaatgtttcccattatcactcatttctgtctcaggagggctaaggtggcccctgctcaccagccttcccctctcggcatcaccagcccccagcctgctatccgcttcacagagcagcgagccagtccttggagaggggacgtgagaaggggcagaagtcaggggacctgaggctgctccccggcaccagtgctgctcaacacacacaattgtgtgaccaccactgaacaaatctcacaagaaagaggtgcattttactccacacgtcatttggttttgaaaaactaatttgaacctcatttttttctaagtgagaatttggtttgctgtgtgtgtgttttcaatttggattgccaagtattcagtcctaacatatgttatggttggagtgcatataacactgtgcagccgaataactagacctagaaaataaaactgatcacggtaaagttattttccaggcaggggatgcctcatgatactggctggggcccaaccacacccaaggcctcgtcggtttctgttctcatgctgttgtcatatacccagaagtaggggaagcccaggagccatggagcctcagtgtcagttccctgacaagccatcctccaaaaaagcctttcctttgcaaaatgaacaggtactccgtgaaaacagggagagaaatttctgtttttcaccgatgcatttctcacgttcatctgacaatgtgcaaaacaaaaagtctacattagaaatttatcatgaagttatactctacttcaactcacttcttttcagtccctgtgaaaacttaatactcttggtgttgtactgaaatacccagtggatttggggtgcacctgtacccttgatctccacttctgcgtgtttctaggccaaagggaaaaccaactctctacctaattggaacttctggttttattgcatatcctggaggtcttgcttcgtttttattttcccgggttgatggtctttcccatgtgcacctacgttagcccactatgtagaacgccttggcagttttcacagagtaagaggttgaaggaagccaccaatgtgaaaatcatatttgctgtaaagaaagaaccattgtgagttgttggaaaccagattaaaattccataattggagattgatgacttttatttcatgagttttacttagttaggtgttttatcttctgtgttttgtggctccaaattacgaagactgttggccttgcaagaaactgatcacggcaaagttattttccttactgaacacgtgtcctatatatttgcttggcctcgggttttgtttaatcccttcaaaggccctttgaactgatgtttcaacatgactccttctctgtgagctctccgctaggaagcggccatcatgtcaagccccttcacagctaaagtagtgagttcacatagtcgaagaatcttctgggttgcatcttatgaaaaaaagaaatccactgcctttttataagagaacagaacatttacaccgtcttgttgagcaaatgaacgttcaaatggccagcacaaaagaaatccccaatctctaacctcacaatgaaatcgccacggacaaaagatcacgggataccgggagcactaaactggaagtgacacaaaaccacagcagaatccgctcacacctgccgaggttcctgggggatgatctttgtgtaaaggatcctggtgccgcagtcagcctgaaacactccaaggagcagagacgctcccctctgcaacagtgacatttatactgatggcgtctttttaaataaattaatacatgtctgatgtggacagagtagtgctgtctgacaaggtgatcatttgacttttcttagaggtacaaatttacgctcccttctatgaatagagagggctatttgtttcattcaaagacaagacattgttagaaatgagtggcacacctcttcaacccatccccttcctccatggaggtaaaaagatcctattagttctcataattgattctgagggctgcagcgtgcctcatttagccgtccctgctcggttcacgccaaggatgtaattcatgcacacttggacgtccaacatggctgacgcgccttggacacacagcctcggcgctgcatcattttttaatcagctatctgaggaatatttatctgatcaacaaagagtgttgtcaggaggagaccagaggtgacattaataagcctgtggtttcctggtacaatgatggaggaagagtttggaataaaaccctgctcgtttgagcatgccagcagactaaagaatatttttattctgcttacaaagagccagtcaaaagagtctcagtttgaagtgttcagttaagtttaagtctcagtgataagttttcaggcattcacatgtgttagtaaaaaaaaaaaaaacaaaaaacttttagagaaacaaattaacaaattttatttcaaaataaaaatttaagttcctcatgtcgcaggaacccagatgaaaagctgtagcttctaaaaatagggagaggtgtaataattgggagctgttaacgctaaatgattccagctactctaacttagtagaaagacgtagtaagctgcacactttccccttctgtctgtctttgaaaagatcgtgactgtctgttagtaattacaaggagctgagtatattatgccaggcctcgtttggtcatccagacacaagatttgctgtttataacgatcagatgccttaagaaatgttctgtgaattaaagtttctatcacactttcttttctaagtgcatcactgtttgtgcaccacatgagaccctcatgagtggagtgacacccatcccatctgccaacctgaagacgcagaaagtccatacatagccagtgtagacatcagcacactttgtccacgttaggatcgtggtaccagaaggtgccacagtgatctctctttgtaattcaaagactgcctcatgaattcagtttgctaacgccttcggtgttcctcaacaggagggctctgtgtgtgttttccggaaaattaataccattgttatattacacaaggataaataaacattttgtcttagagtttgggagtgagtctctctgcattgtcttaacctgagtttttcaaagttttgatccttttaatccttagaaaatacactaaaaaagtacaaaaaattagtcgggcgtggtggcgggcactcgtggtcccagctactcgggcggctgaggcaggagaatggcttgaacctgggaggtggagcttgcagtgagctgagatggcgccactgcactccagcctgggctaacagtgcaagactccatctcaaaaaaatgaaaaaagaaaatacattccagccagcatgatgatgagttttccatgtgtgttttaaattcccagcagtcggtggtgattcccttgtttgacctcttgctgtgatacccgcatgtagcacccttgtgtttcacctgagttcacggttcacgttttggcaccattgtggggacagtgctgtcctcccacgagtggcattctctcccaggcccactgactgttctgcctacccagattagagctcagaaagttccatttaatttgcagactaaagtgagaagagatcagtctcgttgtctacactggagctgacagtcagtttgtaccacatctgaaattatacttgtgggatttcatgtccattgagattcgcgtatgtgtttttaaacatgtaagacagtgctgagacatcctgccgcatacatagctatgggaggcattgtgaaactctgtttaccaaagagacttttgcttacgcagcaagcaaaatagcagaatggaaaacactaacggaatgctcacaccctgctgcctttttgtttaataacaggtgaaattttgatactagaataatagattttgtgagaaataacattagtaacaaaatcaaaataagttagcctgtgtttaagaggaagaaactgtattcctgaaagtagaacaggaattttactaaaaattttaattaaaataaagacccggaaagttttagtctattgctagtccccctgaagtccccgagaatcgccttttattccaaaggcctgagaccagagggaggctgccagtggtgggcagtggctgggtggcaccaaacatcagctcggagcctcctggttccatttggcacagtgtctccgtagcccctcaaagtgattccaggcagcagcatccgacataacccaaggtgttattgatgataataggattgtattttcttgttgagaagcttctaaacaagggaacttagagcaatcaatgcccccggagaccgatgcacatatcaggaccttggtatcagctagaaaacatccatttgtttaaggggaagaaacaggcacgacattttgcacattaaaatggattatttcatcaataggttaatagaaagccgggctgcaagttcacttcctgcttatacatcctgtggtaatgggagagcagagtgtgaaaaatggaaggcataaagcgggcgaggaaagaggctttctgcactcgggcacccctcccctcccgaggggtgcccagcctccattctgcctatttatatgtaaatattgctgcaagaggtaagttgtactcttgaggagtgcagccttctcatggctacctctttctggaacttgcgaaatactgtcccagacaccagagctgcagcagttaaaaattaagcccatgcctaattctgcatcatcatgcctggggcccctggtacatacccatcaagcatttctaaagcaaacatttgagacccgggacagatttggtttccttcgttcctcatgcatggtatttgtaccggtgggtacctgaagatccttttcccaggtttggagttacctgagacagatacttaggtaggaccttatagatagtgaagaaacctgaaggtatagacataaagaagtcttcacttgtgaaaaattaaatgtagacccgtatcctttaacaccgcagatgcctgctagtttagaggttgtttcttactaaattattattattattattattattattctcttgagatggaatctctcactgtcgcccaggctggagtgcagtggtacgatctcagctcactgcaacctccgcctccagagtagctgggattataggcgtgccccaccatgcacagctaatttttgtatttttagtagagacggtgttttgccatgttggccaggctggtttcgaacttctgtcctcaagtgatccgcccacctcagcctcccaaagtgctgggattacagacgtgaggacctggcctatttgttgattttcacactgcaaaggaattgttagatgtgtttagttataacaagttaatatcactttaaatcaagaagcaactaaatcacagctagtttttacttgtgaataatgtaaaatttgcatcctaaatatacagtgctttatcgcagaattgtatttgcttccttaaaggctcaggtttctcgcgtatgttttgtgttgtctctacaaagaaatccagtgtagttagaagcacttgagattcatttctgcaacataactcatcccaggcgcctagtcatcaccctgggtcattttctggccaccagaacttggtgcacacgccgaacctacaaccacagcctcagctgtagtgttcgaaatggagaattttggctcaaacactacagcaggcaagaagagttaacctgtcgtaagtcaggaacacgttggggttgattagggagctgaccgttggccagctcatgctttgggaaccagagggccagcctggctgcctgctttgcgggcttaagacctgcctctggaagggtaagggcctgcccgtccagataagtgctgctcacctgcattaaacaaacggccacacagagcccagtgggagcctgcactggtttctcttcctgcctgtggcagttgagagagacagacggtcctgtgagaccccttcttcagaaggtgaatgacagtgaccgccactaaacattccattccacctgcctgcacggcagtccaagccctctagccctgtgacctggggctgtgcctttgcttgcatttgcctgaagagttgagccaccctgtttaactcttgggtttttataaaatgtctcctgaagggcggagagaatgcctcaagtcgatgtcttccctgccacagatgtcagcatttctgagttgatagttgggagggtaagggcctggtggggtggagaatgtgtctctggagggtgggggccccatctcagtgagccagccaggcactgcacacagcctgagtggtgggcctgctgcgcccttgttaaattggttctcttccgaacccagcgtcccactgtcggtgacttggcgttttgtcctttctcctgagaacctgaggtggcatttgctcttctggttcctaggagctccatttagagccgtaactcccccgagtgtcaaagagaatagactcctccctccaggacagcagaatggcactagggggttttgctgctgtaggtattgcctgaatcaaaatctgtctcgggaagacaacttcacttttaacagctcttggttttaaaacctaccttctccaacacataggcatgaactgctcataaccagggtctcttgatttgacatgctcctaatatttggccgaatcaaagggcttgtggcgactggcatcatagctccttcaaagggtgtcatcatttcccaaggcagaggccagtttttgtgctgttttgagtagccacgtgtgaaacccagcagggcgaagcagacttctgcgcgtgggtagttctttgacgttagatgcaatcctgatgaccctgctccacctctgcccttcctgagttcctctgttcaccgcaggggagttggagggctcagcccagggagctccatggcacccacccgcttcgcgcagacagctcggaggcaacgtcacgtgctactttgacctttttttttctccccttttcatttgttttcttttcctttttgttttctctctttttcccctctcccctttctgctctcgggatgcagccaaacgcaaagcatggaaactaaaccgtgttggtagcctgcgaaatatatacagcagcagcaccaacactgaaggtaacgcctccgcacctccacccgcccacacctccacctgcctcttcccctctcatcccctgcccgccccttcctttccaacacaggcatggaaatgcaatttgcccaaagccgcatgctcccttattgtgtttgcagagtcattcctgtggtcttttcatctttttgtttgtgtgttttattttaccattcgtgttcctttcagcttacttaaattttgacctttcccttcagtcgtagagtagtgatgtttaaattacttcagaaacctattttctcctcttttttcttttcctttatacatgtgggcactcagtgtaatatttcccaagttattacagtttttaaaagtgttagtatcaggtgtaatgatctgtagccaaatacaatagtgtgccgtgacatttaagtaacagtcttaatttgttttgtggaagcattctccataatgctctctgcagctctaatccacaggcaggcaggcccgggccatttgcatgggctgctatttgcttgtaaagtcagtattttgttgtgtttctaaaggtcgtctggtgccaaagttcacaaattgacttgcgttgcttttttcaccgaagacagccgtcattgcttttgtataatagcagattgaatttttcccccaccttcatttgaacaacataattataaattgcctttttttttatgattacaaatgtcaagggtcggaattactttgatgccaggcaagggaaaaccaccaccatcagcccaagcgcacataagggaggcgggggcatcgggcgtgtgatgcaaagcaggtcacaatccagcgatcttggtataatagggggacattttttttcacttaagtgcaagccaaatgggtcaagtaatcgcaagctcgtgccctaacactaattgacttatttggggattattataactgtaatatttttcttaatgtcactgttttctgggctgttgattttagcgattgccaagcaatggcattaaatctcttgtaaattttaaattgcacgttatttctgtaaacaagtccctctcttcacatcctggtcattaacctttgccgatttatatcaccatcctctttttttctttctttcacaattactcctgtcttgccgctgaacgccctgctctcagccaggaaaaaaaagaaaaagaaatctggaaaacaaatctacattttcactatggcttgttaaagagccattttttaatcataattttttttttcatttctcaagggaaaattgttgtctgttaagataccagtggagcttggcctcattggtatcttctttcaaagcactcaagaaataaccaaatgaaagagggaaaagaatagaagttaagaaacggtcattcattatcatttttgttgcattttaaagggtattagtatactcttttcaccgttttttaaatgtttttcaacttagcgtgcatatcatttctcctccctgtgtccttatcaaatatgttgggtttgctttttttttttttttttttgtatgcatgtgggtttgtcgcaacaaatttgtttattgacttccagcctttaaaaaaaaattgtgaggtctggtttcaaatgcagtgtatagaaaattgggggacagcaaggggacatacctccttagccttgagggcaaatggttccctgagacttgctgatgggccttcctggagacactggtgggtgacacgggacccagtagaaccaggagtgaggatttgcagcagtgcgaacttctcagccttagcttctcaggtaatacacagcatctgctctgcccagcacctcggaggggtggagagcgtgaattcctctctgaaatctgtcagtactggatagcactgcaaacatggggtccctctgtcagtagctatgaaaggcattcctggggatactaaatagtgactgcatatccaattgtccctcacaatttctttcatttttctcagttatagtaagtttctgtttggtgttcaaggtcatgtatgaattttcaattaaaagacagcattcttcatttactttgggtttattttaagattaacatgtgtacacatacaatctcatttcatacggtttttaataatgtattacagaattcaggccagacgcagtggctcatacctgtaatcccagcactttgagaggctgagacgggtgggtcacctgaggtcaggagtttgagaccagcctggccaacacggtgaaaccccatctctactaaaaataaaaaaaaaaattacccgagcatagtggcgagcacctgtaatcccagctactcaggaggctgaggcaggagaatcgcttgaacccaggaggcggaggttgcagtgagccaagatcactccactgcactgcagcctggacgacagagcgagactccatctcaaaaaaaaaaaaaaaatacattacagaatttataaaattatataaaataattgtcaaattcctttctgatttacagccttttgatgtatgaagttatcacatattcactgtctataaagtgacccttcatgaaaatttgtatcctgaacattttaacttttgttttaacctcacgtcgtgttacactaaatatatccatccccaagtggagtatcttttaaagtggtccacttgagtgatttactcaaaggcacccaaaaaacaccacccaagtaaggtggacactggagtttcctgtgtctagagggagaacttgagcttcaggaataagaggagaccacccactaggagctgggagtggactcagctgttctgggactttcctcaggatcctggtttaggagagacagacagagccaaggtttgagtctaaggatctctctgaagccctttttcttttatgtcctctctcttccggcctctggaccacattatctcatttaatcttcacactccccctgccaggtaggtatcatgttatggatggaaaattgggattctgataactcaagtgattttctgcagaacaagctagcatgttccagaggcaggacgtgtgcccagatctcttgactgtgggacctgctcacagatccacgtggaaggagtttgtggatggaagtcaggagtggataaaaacaaacaaaacttacaagggaaacgcacagacaagattaaaaaacaaaaatattttatcttttgtctgtccattgtggctaacactgaaactgagatagaaactttggatatatatgattgcactaatgtacaaacttttgttgctttttaacaattaactttctcaagatgggtgaaattgagttttcttcagccagaatgcagctgtaactttaacatctcaggaacctgtgaatggaagggtgtcttaatggtatgatcctccaattaacagctgtctcccaacccaagggagaataagatctaaataccagatgactgaggctagactcaccaatgttcaactgaaagtaaatgtattggagaaagaacaaagaggaccaagtggcagaagagtggacgttgtgcaggaggaaactcgggagggaggcctcttcgctgcaccgcagggcagaattgcacaacacctggacccatctccaggcctcacctgccccatgcagctaaacagatgacattatcatccgctgtgagttgggtgaacacatgggctctttcaagagcatttaagctctctgtttttgcagaagaaaagtacttccagtacctaaatagataaaggagagaggtgttaggaaacaagggggcatttcttgggatgccaagcccattccctggcagcagaatgaatacttaagataggcctcttcaaataggtgatgacacttgcatccaggtgttagccagattcagtactggcctaaagtcccaattcgagcccgtctatgagggcccgtttctgtggatttagagctcgccccagcaacaggcctgggaaacctctgctttgggtacttccgttcaccacagtgggccagatcgctggaacccagtctccccgacactgcgattccaagcataggcattgccatggggaaacagcaaacctcctcttggaaatttcatcacagatacagcttcgcgcctcaggcctgcagtcagacccgcacctgccttctccactgaacagcccagatggtcactgttcctctgagcagatgtgagcaggcctaacttgttggccattccctccaacactcgttttcttggtcacagttctgagacttccaactcattcacagttaaacaaattacaggcccacatctgagaatgatggtcttgctgagtgtgaggtaggcctgcctccttgttcccgactctcaggtccctgctgggatgcgccattgcctgcgctgggtgctggggcaatggagagggtaagggtgcacccgcccactgccctcagggagcttactgtcagtctaggaggctgcacaaaggatctcatgcagaaggagggaagaggccctggatgctctgggggctttgtggagagcagaactacatttgatttaggggtcaggacaggtatcatggcctgcgggatgtgacaggaaccacagtgaccgcatcctcagtgctgagaaatttccaacatcctgtcgtgcacccctagcagagggagatcttttcctccttgttttataaaagaagaaaccgagcctgggagaagggcaggcatcagccccaggagctctcaggaagacggggctggaattccaggtggaggcagcagcctgcacctggacggggcttagtacagagcctgcagcgcccttaggcttgagtgtgaggtgtgtgccgaggattcttttgggaccagtaccagtggaggggactagatgatccacagatctgcagacagctgtcatcatcatctccagcagaggaagaaggcagccctgcctgacaatctgtgacccattgtgttgtgtgtttcctgaaggactcactgcagtgtctgatcaaggcccccgccaaatgccccggcagtctccccagtgccccgtgtgggtccccactgtgagaggctgccttccagaacctgctctctgcagtgagcattctccaggctcagatgggttctctttcacactgaatcactgctcttgtttgtatgaggcaggcatgggcgccagactcaagcccagatcttaactcaggtggtcttggttcagtcccacatccccacttcatagctctaaccttgggttcttgatgtgtcttctctgtacctcagtttccccacctataaactggggtgatgacacccactgcacagggttgtggggaggagtcagcaagctaacatacctagagatgtggaacatggcccctgcattgctccttgcctaggaccagtaagccccagtactcaagcacccagattctctctgttttcaaagaaaattgcagtgtttgaacgttgtttatgtagccaggaacagagatttgaaaagacgtgttgcccatgaagcataggggggaatttagaaatgaaacttaacctgttatctagacttttaaacctaccctcctgcttccatttgctgtcatctgagaagaatcgtcagttgtagaaatttggctaaaagcgtgagctgtggagtcacacacgcctgggtctcatcccctctctgccacttcccagctgtgtggcttgggatgctttcctgggtctgtccttcctctctgttcttttcttcctcgcatgcagacaataaaacctaccttgaagggtaattgaagaagaaatgaagtgaagcctgtgaagtgcttcccacagagctgggcacatagggaagctggccgccgtggctgctattaaattgctatacagacttatttaatagaaaaatgacccaaagactccatggagaatatctgtggactattcagtaggcctttttaatgtatcggtacagagcagagctggccaaagccacccctcctcagtgatgagcagcaccaactaagaactaatgcaggtaggccgggcacagtggctcacacctataatcccagcactttgggaggtcaaggtgggtggatcacttgaggtcagacattcgagaccagcctggtcaacgtggtgaaaccccatctctactaaaaatacaaaaattagctgggcatggtggtgcgtgcctgtaatcccagctacttcagaggctgacacacaagaatctcttgaaccagggaggcagaggttgcagtgagccaagatcgtgccactacactccaacctgggcgacagagcaagattctgtctcaaaaaaaaaaaaaaaaaaactaatacagataacttcagatttaggaaacccttgcatggggaataactagaattgacgttttgggaagagaagattgctcatttttctagccccctccttttgaaaggatgacagtcttgggtatcaatcacctcagcgctgagcagcacctaggagaggaagccctcaccgtggacagtggagggtgccgctgaagattcctggtaagcccgggtctcctgatggccatgctggactcttgcagaggaacccgccctaggcctgcccaacatggccgtgctcacttattcctataattaggagtccgaggggacctctgcaaagtggggagtgtgtcaggatgagtaacaaacagttaccgcttagtaacaagataaatcaccgcacgtgcctatcgttgctttgtctttctaaactgaatgtttgggcctggagctttcacagggtatctgggacagagaaagtacaagggagatagcaacactcacccctgctgtatcgcaagatgttttcaatttgcggtcagataactatttttttttccccaagagctttgttttggagtcttttcttaatttaagacaggcacgggccagacatggtgactcacacctctaatcccatcactttgggaggctgaggtgggcaggttgcgtgagttaaggagttcgagaccagcctgggcaatatggtgaaaccccttctctacaaaaaatacaaaaattagccaggtgtggtggcgcatgcctgtagtcccagctactcgggaggctgaggtgggagaagcgcttgagcccaggaggtggaggttgcagtgagccgagatgaagccactgcactccagtctgggcgacagagaccctgtctcaaaaaaaaaaaaaaaaaaaaaaaaggcacatatggcaccctacagctctggaagccaaagctttcaaatggagtttctttacacgtggtccttgaactgctatcccagctctttataatgtgtttgaaaaataaaaatgtcctttgtatgtcatgagaaccttcccgtggtaatatttagtagttaaacattcctaagctcgtaattgacctgtggggatttgcttcttcacagaattaatcacactgttctaaattaagccacaggacaacacctctgttggactctcttggctagacaaagatgttgaccaaattcagagtttccaaaaataattagctgagaaccgtgaactgcgtgtgtttataatgatcttttgtttttgtttaaaattaataacttctcaagtatactaagtatatccataggtttcttggttctgtacaaccctggtccatattctccaggcttgcctacagtctttgtcttttatttttggacagagagtctcactctgttgcccaggctggagtgcagtggcacagtctccgctcactgcagcctccacctccagggttcaagtgattttcatgcctcggcctcctgagtagctgggattataggcacccgccaccacgcccaactgctttttgtatttttggtagagatggaattttgccatgttgcgcaggctgctcccgaactcctcacctcaagggatccgcccccaccccaggcctctgaaactgttaggattacaggcttgagctaccgcacccggtcagcaggctttctttcacatcagtcttttcctacaaaaatgggagaaaatttgaaaataaaaactgactttctaatactgtgttttggctgacatcttagtgtgtgagctttttgtcataattgggtaaaatatctaagccacacgcctatttaatagatggttttaaaacagaaatattggaggattttacaaagtgtatgaggaaaaatagcattaaagcccgggtgtgtgcgtgacattgccacacattgcctcttagggtcatggtagagggagaaagaccacaaggtagcgagtatattccgtctgagtttccgaccccgttgcattgacagtggctacctggagaactgtgtgaagaggaattctggggctgcaccagcctcttcaggaacagttaggaatgtctgtttttaaaagaaaaggagagagagcttccctttgtcatcccgggtccagcctggcacctcccttgcagataaagctgagatcagaaagatgaagtgggctgctcatgggcaccagtccgtcgatggcaggatgggaagtaggttccaggagagagaaccccaaagttggagctccagttcagacagaaactgggagaacccatagcgaaaactcacttgttaataggggaaaaagaaaaagggcttggcggaaggtaagcatcggtggtaatgtgttcaccacggctttgtggtgtgtcctaaaacagaagtcccaactctttcaccaaggtcaggagtggagaagatggttattttctgcccaggccttggctgttgtattgtcccgtcttttcggtggtgctgtctggaggcctctgggcttggtagatcctgcactctttgtacagcaaacatgcccgtcccccaggctgagcatgtcatctctgcaccgttgcgatatcccatttcattttcatcacaggttgctcattaaatgtgtcacaaaggatgcttagccttgtggacagaacactggatgggcctcaggagcctggatttcaggctatagggcaccctgggagaacctcctctctccccaggacccagattctcatccggtcattgaagaacttggagtaagtgacttctgcatcctccttgagcccttttctattcagaagagaaacatctcggcattgcacctgcacccatcagtagtttgtggttggttgttttttttttttgtttttttttttttttggagacagtctcactttgtcacccaggctggagtgcagtggtgtgatcttggctcactacaacctccgcctcccgggttcaagcagttctcctgcctcagcctcccaagtagctgggactacaggcacacaccaccacgcccagctaatttttttaatttatattttagtagagatggggtttcaccatgttgcccaggctggtctcaaactcttgagctcaggcaatccacccaccttggcctcccaaagtgttaggattataggcattagccactgcgcccggccccatcaacagctttgagccatttctcatcgtagctcggggcacagatccaggtcctcttggcctttgcaagagcacagtgcagttgtccttttccccagaccctttccctgagacctgtgtgtgcctctgtgcctccctccttccctcccctcgcacccacttctcccccatgcatccttgtcagatgcctcctgttgaaagcaacttccaaatgtgaaacggttttcagctgcttttagccctttaaccctttgtctgctagaattccgcaaaaaaataattgatgacggattggcccattaacctttaagaaaaaaaaagtttgacagcccggattcatgtaatgaggagggattccttgtgaaatcagtctgatggctgagtttcttgcccctaaggaggcaaaattagccccatggggccttgtctgcatagaaactggacacaattagtgtaatatccggtgttattaatgtcgtttggaataattgggcaggttgatttcgacaggttcatggtgctaaaatactattatagtggacctttccacagctaactgttaaacacagaaaactgtttaaatccctgtgagcccaatcacaaaactttattaaacagctaagccctggaatgtcacactgggaaacagtacaccgtctgttacttcaggctttggggtgtggtggcatcttgatttttcaggaacagggggattaattttgctgtctgtgtgtgtatctgaaacttcaacatgcttttaatagatataccatcaggagcttctacaacctgaaatctgtttttacagtgaatgaaatagaagccactgcaattgtcacaaataggtagtttgtattagtgaaatgacaccactaaaagtgaaagctccgaacagggcatcctcacaggcacatgctcgttctgcacgtttgaagtgagggtggcagtggagagtaatgctcggctctgtctctgactgatgggcctcacgctgccaattactgttttgatcatttttaatctagttgctcataagtaaaatgtcatcaccgtgtcacttcgtaatgtgctgcagcccttcggggccatcggtgatttgaataaggctctatcatctgctaaaaattcttctttgaaccttaggaggagcatgttcctgttctctccacacagaagaagggaaattgggtccaaaaatctattcactgtttacataatgagcgtaaatggtcactgcaatgccaccgaagtgtaaacacggattaaacacggattaaatcttgagatttgctaggtgttgacctaataaagtcaccagagcagcacataggagatcaccaccaggatagatcttctctactggattagtcagaactaggtttagtaacaccagaaatccagttttaaaaaaaggagacgctgggcgtggtggctcacacctgtaatcccagctactcaggaggctgaggcaggagaatcacttgaaccccggaggcagaggttgcagtgagctgagatggtgccactgcactccagcctgagcgacagagggagactccttctcgggtgggtggatggatggatggatggatggatggatggatggatgtcttatgtaacgaactgtaggacaggcaggagcttcagggacctcagaggcaccaggctccctgccacctcccatccctggcttcactctgctgggcagcagcattcatacctgtccacagggagtggcctgataacagaagttttccttcccatggagagggcagaggcacctgcacctgcacctgtgggccatgtcctgacaggtcccagataagaggggaaggcactctatggacacaactcagatgtgaaaccctggaagacacttgatcatgtgcccccaccaggactgatcagagtggccagggacatcacgtgctccagttggccaacatagatggggccatccctgctccctgtgctggccagggagccagacacccggcaggtggcacgtggaaggcccagaggaccaccacctctgtgtaccatgtcccccagcatttaccagactgacctgattgtgtgactggacatcagttagaaagaagtatgacacgccgggcacggttgctcatgcctgtaatccccgcactttgggaggctgaggcaggcacatcacctgaggccagaagttcgagaccagcctggccaacatggcgaaacctcagctctactaaaaatacaaaaattagctgggcgtggtggcaggcgcctgcaatcccagctactctggaggctgaggcaggagaatcacttgaacctgggagggggaggttgcagtgagctgagatcatgccattgcactccagcctgggcaacagagcgagactccatctcagaaaaaaataaaaattaaaagaaggacagtaagacaaactgttgagggatttctggggaagctagtttcaaaaggcccaaccatcttgttctcttggcatgaggaataggagaagataacggaaagccactaggagacccttccagcccctatgccgtctttgattcccaaggagagctcctttttttaaatgttaatttgtttttaggaaatggaggaagagtactgccactttaagagaggaaaatgattacaagcaaaaatggctgtaaagtcctggcgttgtgcctgacagaatttggagcccagtggtattattttctatgtttattactccatgcagtagatttgttatggataaacagatttcttcctggaagttgtaacatgactatgcagttgctctataatccttgtacttattttttttaatcttgggaggcagagaaaagtcatatggcagatataaattagatctgaaactctacgtgtgggtattcacctattaccctccctcaaaataaaaaatgaagccacctaaagacaggatcctgggaaacacatgggcctagcatagctggattccactcggcagtgttggtgtagagtggccttaattaggctctgtgctcagatgttaatccttcctcaggaagcaaggtccagctgctcggacccttgtcgtaaatttcagggcctgaaaatccaaaagaagacacagggtagtcctcccgccggtgcccacctctgcgctgagcatgtagggttccatctcccgcctctgccctgcctcccccagggcagactgagcctctcccctccaggtgtcccagatgtttgcatcacagttcagccctggtccccatcagcacagcctgcctgggagaggccagcccagggtcagcagcgccattgcctcttgatttgggagctgatgctggaccccgcattgacgagacagagggggccatcttgtgcttctccagggctaggatgaaccatctggtcaaaacagaacagaaaccccaaagagctgttcatcggcgtctcactacatggtgaactgctactcacagggaaaagcgtggcgtttagacctgccctgtgatcacagggcctttgtgcatgctacatacacgtcagagacagaccatacccaaggatcacagagatggcacagcttcctgcccaccacactatcacagagctgttggtcccggggattgcgattcgtgtctttatttcttcattatttgtatagtcctgtgcttttccaggtttagagttattgcacgggactccccctcaagaaaagaatatcttaagtgagtctggggttgcagttggtccttaggatgtgaagcttagctgtgctttccacggtcagcagggtctgtcatggggctgaccttcccaatccatgcctttacctgaagctggtgcccatcagcctgggtcacagggtgtcttgcatctgtttcctctttactctgttgggccttgttggtgtttcatggtaattagccaattagcctgggtttcattctccgggagaggagacctgaacctgagcaggccaccctcaggctctggttaatccgtcacctccaggcaaagtgtaaagccttctctttgccacctcttctgagtggctgcggataccaagtggtcctttatgttcttacttttagggaagtatttagctcattcacaagtctttgtatctctactttgctacctcagagatagaaatatatgtctattatttgtgaaggcatgcttaaatacgatttttgtttgctagtgtacattttgcaattaatatttttgtattcatcttatatcttgcccatttgccaactgctgttatgatttttaataatttgtaggtgatttggggttttctatgaagacagtcatataccatgtgaatgtctttatcttcctttccaatctctcggtctttcattcccttatttttgacttaatacactgggtagcagggatggaaaaaagcagttacagtgggtgtccttgtcttgagcatcctgtaactgagtgttcaaaggtatgtttctgacatctcacccttaggattagtgacattgtggggtttagggatagattatctctgtccaaggtaatggagtcctcttctattcctcgttggctaaggagttttaatcatgcttctttctcttattgattttttttctttcttctggttgagaaattggacattctacttattttcttgcagaggtttaccacatggacttaatttacttaccaacatgtgaagtgagtccttacctctcccagtagagcagtacaaggccctatgacatcgtaactcccatgtcctcaccgctactctcacgttctccagcattttgacctttcccatggtagacattgtcattagcagtcatagtcggtattgtttttatttagttttttttttttgtttacatatttatcagttcatttgctcaccaacctgtctttcacaaacctgccttctaggatcttcctgaaatacatccttttttctttttttttttgagatgaagtctttccttgtcacccaggctggagtgcagtggcgtgatctcggctcactgcaacctccgcctcccaggttcaagtgattctcctgcctcagcctcctgagtagctggtattacaggtgcgtgccaccacacccagccatttttttttttttttcggtattttagtagagatggggttttgccatgttggccaggcaggtcttgaactcctgacctcagatgatccacctgcctcggcctcccaaagtgttgggatcacaggtgtgagccactgtgcctggccctgaagtatatcatttagtaatttccctagtggacgtctattggtaataagcacttttgggtgtttttgcagaaaaatatattttgttctttccttctttttctttttcttttctctttccctttcttttctcttcctttcttttcttctctgctcttttctgttttttctttcatagggtctcactctttcacccaggctagagtacattggtgtggtcacagctcactgcagcctccatctcccaggctcaagtgagcctcccacctcagcctcccaagtagctgggactacaggtgcaagccaccatgcctggctaattttcaaattttttgtagagatgaggtctcactgtgttgcccagaccagtcttgaactcctgggctcaagtgattctgccacctcacatcccaaagtgctgagttggcagacatgatcccttgcacctggcctgtgtttcactcttgttcttgagagagagtttatctgaatctcaagtctacactgttattttctcttgaggatatcattccactatctggcgactctcactgttactcttaagaagtctgtgatcgtcttgatatttgtttaagagcaatctgtctctagagacggggtctcaccatgttgaccaggctggtcttgaactcctgacaccttaggtgacccaccagcctcagcctcccaaagtgctgggattacaggcgtgagccaccatgcccagcctgtatcagtaatactttggatctaaatctgctgtcttgtttgcagtgtgttgggtgatctctggttttgagttcagatgtagttggtctccgtccatgggaagctttcctgtagagaagataccagaagccaagggagctctgagacctggggcctcccggctcctttccttgcaggattgccaggtgctggaccctgggtttatgtttcctatcttaggaccttatctgttgtgctaccaaaggtgtttgcccctcagggtagccttcacttttgcaggtttttagcactttaggctcacaattctagtttcacctcgtgtatttgatttggggaaggagaaggagggtcctcttgagatcatgcctcactgtggactgctgtgttgtgatgcagtcagcttggaggggaagccaggccccaggaacaagggagaaatgcttaagtgttggagaggagagcgacagcacaaacttcttacacagtaaactcagcgaagtgttaaaggtgggccagaaccaatttcacagtcaggcaagggctgaaagtagaaggaagtggaagggtacagattggcagatattgctaagcagggctgtgactgatgagatgaaagtgggaagagggagagggaggaatccaggtgattttgagattttatgattagaatagcattgtaatcattaacagaaatacagaaccccaagaggagcatttgaaaatgctagcaaatctatgtgatgcatgttaaatttgatatgaggacaaagtttttgagaaacatccacaggcattttaaaatccaaaactgattagatatatgaattggagatatatgtatgagaactgtacatgtctgtaggaagtgactctctaagcttcggaaggaaaggaacccctaagaaggagggaggaggaaggaggaacattaactaaacttgaagtttgccttcactaaaggccacatgcagaggaaccagggaggagaaagagaagcagtgatcagaaagctcgaaagagaactatagttgcacagtgagaagatggcaggcacgccacgggcacccctccttgccctggggtagacattgctagctgatcgcagatccttctccaggagcctggagccagccttggagatctcaacacaggattctctgcagctgctcaaagctgccttcattgagaacacaaatgcaagatagttctcagctatcttgcatcactcccataggatctcagagttgcaagggccctcccaatcatgtgtgagacgctgaattcccaccagtctcctctgaaagggccacattcaagggcctgaaacccccagggagcagaacccacaagccccatctctggatagttgtgagggggacagaatcttccacttgcagggtctccatcatttttttctgtcctgggttgactccagggcacccagaacaggtgtcatccctcttccatcagacagaagttccctgtgctcagagtccccagtgagcagtccctggcattgggctctctctgtggtgcctgctggccaccaccctgagtgatagagacaggaccacctccccaccattgtgggtgacacactcacagccttcactttcactgggagcctcgttctgggcctgccgttcactgcagtccttcagccttttcatatttgtagttgggaagcaaaatcttctcccaaacctcacctgctgttggggtccaagagaaggaattctagtcatgcatttgaccatttgagttgtcagttcagctaagagatcctcctctttttagaccttggggatggggataaaaccctagtttatctgctatcccccaaaactctttgctttcacaatttggtaagcagactttatatgtctttatccaagtcattgataaaacattgaatattgaatgaggcaagacagaggtaatagttccatggttgaccactgcagaccttctgctagtttatgctgcttagtaccccttagctgtgaatccatataactctattcacatctctttcattcaccctgataaaagccttgctcacatctgggtgagtcttcagggtgatcaagcatctcagaagactaagggggaaaatattgcaagatggtggtgcccatcagcaacgtcaggtgctccagaaagaggggggtcagtgagaaagaagactaagcacagcccatggcccctggctgttccttgatctgtaatcttacagagtgaggtttcaatcaggtggatgatggggaagcattattagaaaagagagggtggtaaagagctggatgcacgcgtgcacgtgtctgctttgcagattgtgtgagtgaaggatgaagaaaagaggtgatgatctctctcaaggatggagtgagatcaggaagtgagtgcaggaggtctgtagaagggggacatgaagtttgcaagagagtgaggaaaccatgccaaatccaggtccgcaagaaggtatgaggggaccaggtaaaggatgcagagagacgggaggaaaggaccaggagctgaaaggagagacagaaatgttgagtgacatagaagatactagacaagggaactttcttctgtccagtatacggagaagacaggtggtgggatagatttttaaagtgagtgatcggccaggtgcagtgacttatgcctgtaatcccagcatttggggaggccaacgtgggcggatcacctgaggtcaggagttcaagaccagcctggccaacatggtgaaaccctgtctccactaaaaatacaaaattagccggatatggtggcacatacctgtaatcccatcttctcgggaggctgaggcaggagaatcgcttgaacttgggaggcggaggttgcagtgagctgagatcatgccattgcactccagcctggacgacaggagcgaaactctgtctcaaaaaataaataaatagagtgagtgatgaagccatagaacagccactgtagggagcacatttagaaattagctcgaaatgggttctgatgttcctgtgaacacttacatgtatttgttcccctaagtagagtttgcatgcataggtaaaatttgtttacataattaatcgggcagagccaaactgcgctttagcaatttaatttgcaagttttgtctttgcatgagatactgagagtattacagtgcaagataccagatagcagctactgcgttgggatgaggcaaaaaatagagacgttcccttggagcttcattcagatttccattgtttttatcactttgtgttcagtcatctgcctgagtgtgtgcccgtcctcaccacgtagacacgtttagagggcacaggcttctcctgcatgctggaatcccttccacccagcccagtgcctagcacgttggggagggcagctgaggaccacagtgaccgagccctgcacccatacagtgtaatacaagctcagctcttagccttagttccagtgactgtagctcatgactggctagagccagacatttgagcaggaaagctttacaggggaccagttgtgcagaaatttaaccgggaagctaatggttgtaatttttttcactagaagatccaataaatgctgatcagagggagctttgatacatgcatttgaatttcacagattaaacaaagtgtgagcctgtcgagttgatctcataatgaaaaattgtcacatcccacctatgaattaccaagttttccttatgatctaactgtgagttatgtagttttttcataccttacctatctgttcactaggagagttttgcataaaatacatgaattggggcactatcctatgagaatctgtatggaaaaggttgtaaatcatagtactaggacttaaaagcccatggatcaagaagctggaccaagacccacagatgcaatggctcagccagtacttgcacgatatcattgtaagtcagccatggtgaaacctatgtgaaagttacagttacaatgattttttttttttttaatgaaatctccaagtccctgagtgtttaaggtcgttgttgaaggcatgacctgcagacaccctgacccccaccttcctcccccacccctctttccacagcaggtggagtgtttcattctgcataaatacacaggtggcgggggtggggtggtcatttgttctccaaattcaagagcccagtagattgggataaaattcctgagcaaccagaccctcccatcctgacctcttgtcaccagctctccagaaatcgggaaccagggtgactgagagcacaaaggacacccccataccgtgtgggccagctgagggcttcctccaaagactcttctctcccctcccactccagcccgtatcggtccctttcaaggacagggtgggtctcagtgccgacaccccaagcggggctaaccagccagggcctcaggcccgacctccactcagcacgtgcatcacagcactttcctgcagcccccagaatatgcccagggcacagtggctgtcagcacctagggagtcacagaccactgaggggctggtggaggccatgggccctctctggctgggtgctgtccccacacccctgggagtggggcttgggagcatcactgggctgctcaggtggaagggatctctcagccacaaagagggctgcatatccacccagccagaaaggagtggggaaagggtgagtggggtggcacgtcctcacgtcccaggctgcaggcgcattgtgaggaagggcctgggagagccagtctaggtgaggtcagtaagccgtgcttggaagctgggctagagggaccaagagtctggaagatcagaggtccgtgcagtagacatgagccagcccaatggccacgggctggtgacagagataagtaaagtggttggcaggcaggtaggtgaaagtcagtactaataatagttgctcgccaggggattataatgcagctagttcacaggccagggcccggaaacattgagtcaaatgagatgttgtgtctgaaaacctagttgaagatttcttaatgagggtctggtgcagtggctcacacttgtcactcagcactttgggaggccaaggagtgaggatcacttgagatcaggagtttgagaccagcctagggagacaccatctctacaaaaaatgtctaacaattggccaggtgtgatggtacacacctgtagtccgagctactcaggaggcgaaggcaggctcgcttgagcctgggaggtggaagatataatgagctgtgattgcaccatggcactccagcttggacaacaaagtgggactccatctcaaaaacagttcttcgtggttgtatgcaattagttatgctttttgccagtggtgcctcctcctttggcggggacttgggggccgggagtagggacaggaataatgaacagaggccgacgtggatctgtggagtgtctcctatggaccaggtcccaagtccgcatgggtctgtacacttcatggaactagcagaaaagcattagacagtcggtgcccttttccttcattttatgggttagaaaaaatgaacctcaggggagtccaggaacttgcccaaagacttagatgtggcaggtggggtcgcagggtatacccccaagttcctctcttcccattgcagacatggccccagagtagctaccaagtctggggcctgtctcagctgagatcctcctaaggcacgcgggatcccatgcactctccctgtctgaaaacgtgggaattgatgcctctcccacggtaacaggtcctctgccataaaagaacagaaccttcccgcgttcctctatccatggagtgtctgtggatctacgcgagtgcttagatagaaattaaccctgcagccggagattagcggccctaacttaattttcgtcccacagataaggatggtcagccatgagttacatggttattctcctaagttgctttgtgtgtgcaccacacagagacgctgacatcactcgttgatttcatctggccttgtgccctgagccttgattgaaacctggctaagtcatgctggccttaggaaccacatctggactgttgggaggtgcatggattcaaatctccgccgccgtggttgtccagtgccgtgcgcctcaccggtccatgcaggggcagctgaacccagaggcgcttctgtgacagagggcccgcagggggactgctgtctcataaaagctaaactcttcatcccacactctgtgtttcagaacaagaagaaaattttgagtttatcattgtgtccctcactggccaaacatggcactttgaagccacgacgtatgaggagcgggacgcctgggtccaagccatcgagagccagatcctggccagcctgcagtcgtgcgagagcagcaagaacaaggtgaggcccctggctgcccaaaaccaaggctggggctgctcagggggagtgcgggccccaagtaatgccccagggaggagaaaatagaggaccagtgtgaatgacaggacctagctattctttatgagcagaaagctcaataactaaaacgatcagaagcactttgtgtctataccatcatacatgagtattccagcctgaccgtgcttccctggcaggagagccaaggttaaatcttcagtctgtcagccaatcccagagggaatcttttggactcttgtggcttctgggtccacatttatttttgttttggacagaatacactcagaaaaaaagagagacggacttaaaagatgcactgttcaagtaaatgcccagaattcaaatcgacatcaagttggaaaaccgtctcttgttagggacataaatgaaaagtagatgggtctgtatgagcgtgcagggagtttgggaagataaagtttctattatctaaactgataaagcctggtatgtgttttattcaataattagaggtggtggtgcagctcttttagaatttgtccagcaggttttctggttctcaccagaaaacgccacccccaaatgtttctatattaaaaaaataatgagaggcaatttgttttttgtagttacttagctagaaaaggaaaaatattttaacctgtatttttttttcctttggagagagtctatctctgtcacctaggctggagtacagtggcacaatcttagctcactgcaacctccaagctcaagcaatcctcccacctcagcctcctgagttgctgggactacaggcctggcttgcttgcttatttatttgtatatttatttatgtaatatatattatttgtggaggtggggtttcatcacgttgcccaggctggtctcaaactcttgggctcaagcgatccacctgcctcagacacccagagtcctgggattacaggcatgagctaccacgcctggcttaacctgtgttctctaggctactgcccagtgatgttccttctacaaaagtcctttttcccatcaaggattgcttcagtttcattattttaatgtttgtttgtctttaacctctttgctgggacgtcttagacttttggagagcattttgatatttcagactatgatcaactagaaactaagagaaaggatgttacccaccgacctgcagtttcatttgtaaccatttaaagaaatttctgcctatgatttatgtgcagctttgtcactaaaaagagagtctgtctttcagaaagatgaagtgtcttattttattaccctctttaaccagggtaaaccagaccacagtcattattattataatgtaatttgcttccctttttaaaagatgttttatactcaaggtggggagaaccactgcctttcattccatacaccctggctttactgggtcacgtccacatgcatccatgatgtgcctcctgaaacgagcacagggtgctttggggccacctcaatgggaagcaacagcacacagcatcctccaagcgtgggcagctcattctgagaaggaaggcagggaggcaggctgtgttaccgaacagagaggcacaggttcctgccttcatggagaaatcacagtctttcacggcagactctgagcccctgccacctcgacctaattcaggaagatctgggatggtggcagcctttcccattccacaccttgccaggctcctcctgactcgtgtctcagctcatgcacacaccagccttagaatgctgccctcggccctcactaggcgcctgttctccagggaattgctcccttgggaggaggacgcgttgagcaaccaaaggtggccgactcagagctggtcatcgtgggcattggttgaacaggtgtgagggcataaaacatggaaatactgtccacaaggagtagcgggaggcaaaaatacaggcccagttgaccaccagctttatagtattttacctgccagtggataattgagagctgatacaggtataggcatagctagacagacagacaaaccaaccaaccacagaaatgatacaggtacacagagagacagaggcacatccctttgtatgtgtgtgtgtgtgtgtgtgtgtgtgtgtgatcacacacttgcattccagatgccagtgtaaactgtttaaacatattttgaatacttgggtatctaaccaaagggaattaaaattcaataacgcatgatgctaattagacagtagtgattaatacattataatttattatgtagcaagtaatatattatttcacatcaatttgatgagatgtttcaatttatgaagaattcttacgcaaaaatcaagcttattgtaactgtcctctgaaattgatcaatttttgctttaaccataatattaaatgcatacttaataaataagcctcaaaaacactacatatcagccagacacgatggttcacgcctgtactcctagtgctttgggaggctaaggtgggaggatcacttgaggcaaggagttcgagaccagcctggccaacatagggagaccattgtctctacaaaaaaatttttaaatagccaggtgcatggttcacacctgtagttccagctactcaggaggctgaggtgggaggaccacttgagcccaggagatggaggctgcagtgagctatgattgcactactccagcctgggcaacagagcaagaccctctctctaggtggggaaaaaggtacatatccagtacatatcctttcacttagaacttctacttccaggaatctattcttagtaaataatcatgagtgtgtaccaagacttagcaatcatatgttcttacagcatcgtttatgatagagaaaaattggaagcaacttaaatgtccatcaaagagaacttgataagtaggtcttcactaagtggaatgctatgcagccatttaaaatgatgatgtcagagagtatgtgacagcagtgagcaatgaacaagtttcgttaggctggaaagggcaggtttctatgcagcaatatgtattacgctggctttttaaagtacatatgtgtatgtagatgtgcttaaacaacaggctaaaagaacagacatcaaaatgttaataatgcttaactatggatggccgtatgattgtttattaattttatgttctttttcccctctctgtattttctaaacttgcttcaatgagcatgtatgtttttaaatcctttttaaagaagaccatagagccaggtgtggtggctcacacctgtaatctcaacactataggaggctaaggcaggaggatcacttgagcccacgagttcaaggctgcagtgagctatgatcacaccactgcaccccagcctcagccacagagcgagacactggctcaaaaaataataataataaataaataaataaaaataaagcaagccatcaagtgtaaggttaagaatcagcactcccagctatactcgtgtttctccctgcccccaccctggcgagtggctttgtcactgtggcaaccgagggtcttcagatgacatgtgcatctcccagggtgacgtgtggtatgaatggggttttctgacaaggaaccatgagatatgtcttacattgctgatgaagccctaaccctgggcttataaacggattatttctttctcattcttcttaccaagtagacatgtggctactgcccagaaggttacccatttaccttctccaggttaccatggtccatgcgtattcacagatgatccagaactctcctctttgctcatttctggcagagtccgtctcagctgatgagttaaaatgtgacatttcctccctccccccgccccatgcatgatgatttcttcttcagttatgctctttcccaaagacatcaaaacaagagtgattgtttagaaattaccctcgtcctacatttgctcccaatctgtttgatctttccctgatgttatcagtgatgtgcgtttctcccggggtgcttacgccttgtatttgtgtcttcctccgtgcccagtcccggctgacgagccagagcgaggccatggccctgcagtcgatccggaacatgcgcgggaactcccactgtgtggactgcgagacccagagtaagtgtgtgcggtggtagcaggggctggcgctgtgtagctggagaccacatggtcccactaggcccgggttgcaggggactcacatctgtcctgtttggcagataagagttaactgcttttaggaaattgagatattttgtttggattttaccttaacagagtgccttccacacaagcctcacccctggctgcagggtgcgtttctgtgagtctttccttgccttaggcatccgatgagcagcagtcatacctgaggtgcaaaggattcaaccccacacccacagcctgtgccaaatctaggaagcccaggaattcaagacgagcctgggcaacacagggagaacccgtctctacagaaaattaaaaattaactaggcgtggcagctggcttactttttgcttaatcagtgatcacttgttgattttttttttttttcataaaaatagaatataattggttcattcctgcctagagattcttgggtattgtttttttaaattcacaatcatatgttctgggttttgccatcaaatgatgtcttgtttttttttggtcttaaatccattacccactaaagcctctgattgaactgatagaagttgtaattactgctttgtgccatcgagtaccccagttttatttcatgatttccgttgtctaatccatactattactttccctttgaaaaagtcattttgttgttcataatcttgagagtagggacttattttcatggttgcagtcccagcccagagacagtattggagacattcagtaaatttcttcccttcagattttttttgttaagtagtgttttgaagagaaggaagttcagttcaaacaaggtaagaggtgctggtaccaggctgggtgctgcccaggagtcaaacgtgcatggcgtggtgggtcctgccatcctgaagcctgaaatgcactggacaaggcaccaacctgctgaccatggagctaagcgctggggagagccatcgggggcatgcggcggtcttgccacccatgcaggagctgtcgtgtcagcagggctctggagatgggcagggtttgtacagggaaggggccgaaggaatcactgtgagcaaagggagtggcttgaggagagcttctctgggtggttgtaggattagagatgctttttgggctggaaaaccagtagaagctagttggagtgtgagtgccaagtgaaactttttccagctttgttcttcatttgtaagcagagagacatcattggagttttagagcaggaaggagatggaccctgagctccacttggggagatggatctggccagaccattttgaacatactggaatagaggcaaagcagggaggaggccagccagggtcggcttggccgggaagggagacaggagcccaggactgctccagacaaaagggaaaggaagcgccccctccaagagtccactcagcagcatagcaggcaggggagagatcaaaagtctgtctgcggcctctctggaagcctgtcctgcgggtgagggaaggggttcttctccaggtatcttgaggttcttctttaaagtacctccttatgtttgaatgtttaagttttactttcaaatgtgtggtgaaatgaagttcgaagagagaagcagttatttgaagtgtgtttctatcaaaaagttttaaaagtaagagcttttttaaaagcacgaatctgagaaatattagaacatccattaaggaaaatgcctgcagttgtttccaccgtgcgtctgaaggtcgctttaaaaggaaagccatccgtggcttgcggggaccatgatacctggcaaatcggaggtcgcaggtcctgtctgagatgagcttgtgcatgtgagtgcggatggggggtgggaaagggaggccagtgcaggggaggtgtgggccagtttgttctgagcaagaccacctgagcagatggacagggacaaagggaaaaggcagagtttgacaattcaggagaaagaggcgataccaagcacgcatttgctaaatgtgtggtctgtgtcagcccggtgccaaaccctcccatgcgctgtcttttcattctgcaaccctagtagttggtgcccctgtgggccccacttaaaggggaggaattgaggagcctgaagggtcaagtcatttgtctgaggtcacagaaatagcaagtcccaaagcaggattcaaacccatctgttgtccagcctgctgtattttctcaagaatggaaaggctcagaagatgtagcacattggcaaggatttgttaagtaaaaatacccaattttggttaaagtaccgggataggtacagtgcccacactgatgatgaactgtaaacacctccatggggcctttcgacaatgtatataaaaagcttttgaagagtggatgcccttgactccagctgtatactccaggaactaaaccaatgggattgagtaaggcgggtgcagagatctgtctttccagatgttcatcacagtgctttacatggcaaaaaatcagaagcatcccaaatgtctaacaattgaagagcagttcatggtgatgtcttgtctttgctacctttaaaaatcatggaaaaagacttaattgagcctgggcacggtggctcacgcctgtaatcccagcactttgggaggccaaggtgggcggatcacctgaggtcaggagttcgagaccagcctggccagcgtggtgaaaccccatctctactaaaaatacaaaaattagccgggcatggtggcatatgcctgtaatcccggctacttgggaggctgaggcaggacttgaactcgagaggcggagtttgcagtgagccaagatcacgtcattgcactccatcctgggcgacagagtgagatttcgtctcaagggaaaaaaaaaaagtggggggggtgcttaattgagataaagaaacttcataatgtgttgtaaaatgaaaaaggggtatgacaatgagtctagatgaacctaacgagtatttacaggtatttagaggggaaagatctgtaaggctgcactctggaaggttagcaccagttgtgtctgagtggtagggtcttttgaggcttggggattttcatgcagcgtggaatttggaattgtggtaacagctccctgacccccagttcttgcagagaatgctctagaccgccaggagccccctctgtctgctcactgggcacatcccagagcactgtttccagagtggacgctgagcctctggagctttgggggtgcctgtctataaagggattctgagagccagtgaatttgggaaactcttaacaacgtccgactcccaggaagttgcagccttcggacacctgtgcttccggggagtactgctctgaagctacctgttcagcatggcccaacccagcatgtcccaggcccatcggacagtggggcctttgtttagggtgcctgttgcctgccttctgccaggaacatgccaaggaaagtccacacctgagggcccctgagaatcctagggcttgggaccctcagtggctctcaccagcaggtctgaccttcatggacaggccctgagaggcagctcaccgtttctgctgctttctctctgcccatccatgtcgcccatgaagccctggttggagctgaccgtgcgctggtccctcccaccctgctgcgtggacctcacaggtgcccctctctcctgggcctttctcatgtctagaatcctgccttatttccctttgtgaaccccaggcctgcacacaagaggggactggcacccaccactaccaccagatagctcaccacaacctacagtaggagcacatccaggctctcatctttagcttggcccacaaatagaacctccggtcccgcaacgtcgggtctccttcccattgtcgcctcttagtccttccctgacctccaggtttgaaatcacacacacacacacacacacatccctactccctgctgttctgccctgggggcttcctggctctggtgtatcctagaattttcttagctcttttctggtttgggcgggggcaggggcgggttgagatggggtctcgccctatagcccaggatggagtgcagcagaaagggtaggctgcctctcggggcctgtccatgattgcagcagtgcaatcatggctcactgcagccttgaactcttaggctccagcaatcctcccacctcagactcctgagcagctgtgactacatgtgcgtgccaccacgccgacctgattttttaaattttttgtagagaggtagtctcactatgctgcccaggctggtcttaaactcctggccttcggcgatcctcccccattgacctcccaaagtgctgggattataggcaggagccactgtgctgggcctagttttttttattttttcctgcttggtctgtcctcatagaatctacgtcctgcatttctgtgggcagggatttttctccgttttgttcactgctgtatccccagaagccagtgtgttaatattggttgaatacgtgaaggaacagatgtaattacagccaacacctaacactgtacttcccgtggggcagtcactgctctaagtgcctcgtagcttttaatccttctgacagccccttgaggatgggaattattagcctcatttctctggaggggagctgaggcccggagagcaagaggcttgcagaggacaaaggtggaaaggcagtgctagcaggtggcacgcacacaggtgtgagggcctggagagcaggcagggccgccctggggctgtgggaccagcggggcctgaagccaggtggaggggcaggagacagtgcagaggtctgagtccgtgccaggaggctgggatcagccacaggccgaggttctccacccaggccgagacacagcgaagtgtcccagttgggccttaaggcatctttcaaggaaattgcagtggtgatgcttagataccaacccttgccgatgagtcattctctgctggagcggaggcaaggttctcccctcagtcagccccagccttacctgtctctaagcagagggtggtgagcatggggccctggaacactgtgcccccgccccctgcaacattttgggtttcagagaattcggagtccggcacaggaatgtgtcccacgcatgaatgtcgtccttcagatctggacctgacagcctgggagctgctggggggaggtaggagggggtgcaccacggtctgaacgaggggccagcatgagtggcttctgtatctgcaacccacagcggcatggagggcggtggggtgggcataggaaccaaatcggaggttctggtaagagcttaggcaagtggctatggggatccagatgtgagtggagacagtgtgtcagagcactccccacagcactcggtgatgggctggatgctgggacataagggagcaggagaggtgctaggttttgagcggtggtgtgacatgatcagagatgccgtgttcagtggggccctggctgctgtgtgaagaggtctgcagggaagtgacgggcaaggccgcagacaggagccccttgcaccccagttgcgatgctggtgaggacgcccatgggagcataagttcgagaagaaagcgttggacttatgagaggttgagaaccttgtgattggctgtgggaatgatggaagaattaaggtggacccctggggtcccagcttgaatagctgggacaggagggacctggcagaagaatgcatttgcagagtggatgttgactaggagattctcccaactgaaatgtacgtggtcgttgcgtatataataattcaggagccaggaagaggtgttagtgcctgagtggtgattgaagtgtgggttgggttggcctgaataagactacacagtcagaagagatgaccccacaggagccctgaggtcagggaggaagagctgggaaagagatcacaacggagcaaccaggaaagtggggaaaaaatccagagaggtcgttgaccaaaaaggtatcagaagttagcactggcccagcacagtggctcatgcctgtaatcccaacactttgggaggcccaggcaggaggattgcttgagcccagtggttgaagcctgggcaacatagcaagaccccatctgtgcaaaaaatgtaagaagttagccaggcatggtgatgtgcacctgtagtcccagctactcgagaagctgaggcaggaggatcactggagcctaggagtttgaggctgcagtgagcagtgattgtgccaccacaagagaccctatctcaaaaaaagagtagtactcagtgttgtgaggaggggtggggcagtggccagcccacaagaggccgagtgaaacgttggccacaggggtcttttgggtttcgccctggaacaggctagtgactttggttgtgctgcgtccatggtcaggaggtagaggcctggttgtcagtgatccggaggtgcagaagcagagggagccagtggggaggtgggctgtgcagacacaaagggagaggcacaggcgaggaggggtccacgccagctgtgtgccatgcctccaccctccacagccccaggccagggcctcctctgtgtccccgctgccctcttccttctcgtgccacctgtgcattggttctgactgcgcttttcagcgttgagtctctgcatttctctgttctcttctgcttgggtttttttcatttgatgcataggtttccccttcccagtcagaacctctctgaggtcacagacctctcttctcacatttcttttttttttttttttttttttgaggagtctcgttctgtcacccaggctggagtgcagtggcaggatctccactcactgcaacctctgcctcctgagttcaagcgattctccagcctcagcctctcaaggagctgggattacaggtgccctccaccatacccaactaatttttttgtaatgttagtagagacagggtttcaccatgttggtcatgctggtctcgaactcctgacctcaggtgatcctcccatctcggcctcccaaagtgctgggattacaggcatgagccaccaccgcacccagcctcttctcacatttcttgtggtatctatcactgccttcttgcatatgtagtagatgttaaataaaggactggctttctgatttctgatcaactggcgtaaggctattgctggttacttgccatttataaaacaaaggatgtctccccagtgagtcaaatgtgacctaagctacttggtcttttgttgactcttcaggtgtgtccagagtaagcattgcctattcccaggtgagtaagccgtatttacttaacagtggtgaaagccagtgactatcaaggtcaaccctatctctgcacatcagctgtagattctagcgtgaagtcaacccgggcctgagttcttggtcttctgatgatgccagccagtttcacgcagtgagtgctccagttctggggtcccagtgctgctgtctgaatccatttcttgtcctgcacaatccttgcactagtccttggtctagtttcacagcccaaagcctgtcaccattcattctgcaagtcagcgttggttgcgctgcgtgataacctcaccaaagggccctgcccaccaacttgcctgcagtgcagttgcttcagtagctatagttaaataagatcactgaaaacgatatttcttcactgtagtgtacctctctctcatctttgaaatttgcaagcatgcccgttgtgtacctactggaaactttgatgtgccagtggctgcagaggtagcaatgaaggaatgaccagagtcacggtgtcacccagctgcccctcagcaccacttctccttccctctcagcagcagctgtccacagtggatgccgagtcacacgtgctttttcccacacaggtcagccctctcaaggtgaatgctgctgtgacatatgggaaagtgcatcttttctatccaaaccaacgctgtcaattatttattgtgcgggaaattccaaggctttggcttcagccaaatgtgttctgaagctactaccaacggccagtcatttgggacacctgaaacaggactgagcactggctagggagcattttttctcgccatggatgtggttctgtcgttgtgaagtttgactgattcgtcgccttgtgtttctaagaacggttggaatgatgcatgatggtctgattgcgtttagcgttctgttcctcttcccgtagatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaaggtaggaactttggaagatgcctggctcccgacacgtttgccaacagttaggcaactggaagtgatcataatgacagccacggttgggaaggccctgataacctgtaggaattcgggaattccgattcatccggcataggaatgtctgtgtttaaagttggtcttgagcagacgtggataattcacactccttaattttttatgtttgtttttaggcctggggatttctctcccccctcttagaaatgtattaagcttctaaccttatgaatatattactttaattaatacatttctaataggcataagctgtgccgttaacactaattatgaatttttgatcctttaattttgttattcttatagcttggataagcatctgctctgtcgatcccccccccgcaccatcacacaaaagttatttttatggtaacaaaatctattttattttctaaaatatatctcaacacatttagtcaaccaagttcagcataatgtatgatgtaactcctcattaatgttaattgttatccagtgtaaaaaacgcatttattttgaggccatttagtttctcatttttcatttacagctattataaactgtttttgagtacacatgcatatttaatgttcctaaggggtgataaaatggagtgtcttctgagaaggcgtatggcatggaggcagaatagagcatttcatctccgtacttgtctaaagcaagtggcttccagggttgctcattttcacccacaataggaagtgggaggttgaggtttgctgtccgtgtttgcctctcaggtgtctgaagagatgaagggagaggagaggtctcccatcactggtactttttaggttcctctgatttgttttgctgctgatcagataaaatgaaagttcaagtggtaatctgtggttacgccacagaaaccggtttctactgcagagcagtaagaacgtgagaagcgttcgtggacttcagttcattaacactgaaaaatgaatttgtggtgccacctttggctcactggagagaatgaagctggtgtgttactcatctggctctccgtatgagggattctttggtagtggggaggacaggaaaggtgcaaagaacatatttgtttaaaattgcatggttttgatacgcgacctctttatgagttatgctctatagtgtagacaggggtaagtttcttacaaaccgaagaaattatgcactttaaaaagtatttatcttgatttgtttaatgctaccatagaaatcagctgggtcatcaactgtgaacaagcttaaaagatgaattcatgttttaatatctattttttcacagataatgataacattggaggaaacttgggtctgaaaatgaaaaatgattggaaattagattgagcttaatatatgaatgcagaaaacattgaaataagctggaaaaatctatgcatcttactgtttatatgtaaaagaagcacattcactatttttaatatcatgaattattagaaaagtttgtttatccatccattaaaatttagaaaccatttggaattattcgaagcaaagatacgggttcatgttttacctgataaatgttttataatttcatcttcattcataaatgaagattgtgtgtgcacaggtattttgtagttctaatttgcatccttgaattaagttcttgagtgcagagccctgtcttttttccagtgttacatacatcacatcattatattttagagacctattgcagagacttgcttactcccaagtgcagtggttgcagttaagtcccatcttttctttagtcacactggctttcctaaagagcaggccgagttgtaattcctctccaagactgtggtgttggtgatgtggttctgtgctgttgctgaaggtaactgtggaatttctaagttccctttgcacctaagaagataaacacatacgagaactgaatatttctttgtgcctgtagtaattttcctggggagttttgttttcagtgaaaatcagcaaataatcattgcacactttctcgtagaaaagcaacggtgagtgatgattgcagttccctggtgattggtgaaggctctcagggctgcctgaggatgccagggctcgggagggtgcattctgggaggtgtcactggagaaatggcatctgagctggactctgaaatagggggtgattcccagggccagggccaggggaccaggtgggaaggcgggctggagggtgggagtggcctcggtggatgcaggctcggccgggcctgtggggaggtgtgcctgtcggcgagtacagcaccgtggacgggagcctcccatgaatgaggaggagcaggaatgggggaggcccaaagagcagaagcaggaagggcctctgagccagggctggcaccttaaaagcgaccctgggggcaggggagaggggaagggtttgtctattcatgggttctgtctgtcccacctgttcccaagaggactaaaggcagccagcaaggtctgtgtcccttcccgctggaaggccagggtcctggtggagcatgcgggaagccttaactacactgtccaaagcaaaacacacccagcccgataacagagtagaaattcagactcccaccaccttcaccacctcctgcacgtcccctcaatagaaaatggaaaagtgaaagtcggggctggaatctccgcaagccggtctgtccatgacgtgagaagattctgcctttcgaagccacccccgctccctctgccccactccgcccctcctggtctctctgcagaacctacgattgttagtagaaacagctggaaggttcttttaatgtggccctgaggtaataccaaaaagaaatattttaataaatttttctctctatcaaaggaaaagccaagtgcaatatatttggtgtaattctttgaaaaagggcccagctgttttcccaaggagctctggtccattccatcttgtgcagaagattcattctgacagtggaatataattagaaatgcgtcgttcagcctgcccccacccccaaacacacaaacacacacagattcaagaccatggggaagtagaacacagcagatcttcctccaaagagaccgccgcacactggagtcacctattcgtgcggccagttaggacagcaggcgccctggacagccggcctctgctgtgtccctgcacccctgattagggcagcttcggacggcttataattggttccagttaatctctgccgccctgagaactgccgttcaaacttgagcagcatcatgatcaatggaagctgacggcggctgaagcagtattgacttcccattcctaaacaggggaatcattagtcaagaaaagcatcttttaattactcccaggaagaaaaaaaaaatctttttggatggattctgcaacaactgccattttttcccagtgcattcgatattaaatttattgtcgcaggaggggagaggatgccctttgtccccctctgtaatgggggtttaatttggaaaaagaagcacgttagaaaacagagcaatgctacaacaattaactacatctggggtagcatcagaattcccctctctaattgctattgataccatttaagcacacacttaaaatatcgattttaagtggggatgttgaagtggtggtgaagtagtaacagtggacagaactaactaggttttaggggtttaagaagggagccgtcagctgtgtgtaggacaggacttcgtaacacccggcttgtgcgtgtgtgcggtaccataacgtagcgtgttgtagggcgtcgagcagctgggccgggggccaccagccaggcggggctctgggttccagtgttagaggtacatggtgttactgtaaggagaagttgccaagctccttggtgaccctttcaaaggcaagagtaataagctcagaggtgaagatgttaaaacagtcgtgcgaacgtctcctgcatgaatgaatgattgaacgagtaaatgagtgaaagcgggaactcgtcatcatggaacacatgtcaggtgctcttgctacttcggggccttggaattcctcatgtgagtgaaaccggggctttgacgtttgcagcaccagcaaagccgtctcagtaaacccgtccacgcacatcctctctccctcgcggtacagcagtgtttccggggctgcacggcagcgccctggcccgttgttctttattgttgtccccattgcacttaaaaacatttgggattggctgcagtgcaagtgatttcctagcaggacggagcagagccctctggcgccacattcctcttggcagaagcctcgctctgcgtggcactgcatctccccatctttgtgtcctggtgtcaaagcatttggcccccaaggccctgcagggactcgctgctatttgcatttcagtgcaggtagcctgtttacttggcggcttaggagcctgctgatttgggccaggaaatcaaaggaacctggaagtggagaatagtgttttcaattccgtgaaagagctcttgagaggcgctttaagcgcaactgaaatcacccattacctctttgatgccacttggaagggaaccgagtttgctgatttagtacgtattcttttcccttttttagcatcctttttctttttcttccccccattatttgtaagttcacctctgtgcctaaactcccttcttgtctttaacctataaaaagatgtcgccttcgataggaagatttggggccagacatcagaaatccacgtgggagagactggccgtacacttccagatggaacaagtctgcccagtgatgtgagttccatctctttttgattctggaactccactttcatcttatttatgcacatggagatattgataaaggggaaatgtatccaaactgaaaataattggatccctacagctaactctgagatattaaaagcagtaccacttggctgtgtctttgtcttgttaggtttgatcataagatcacaatgtagtaatctcgggctcaaatttctggcataaagatgcactgttccaaatgtggcctcagggaacacgactgcccacacagccccaggattgtctcatcttattatttttcaacagttcttggcctgctgaggtcaatgttttgtctcttttgagtgttcctctatgcttgacaccttttcctattttctttcttaaaaaaaaaaaaaaaaaaagggagggggagaaaggagaaaaaaaataaaaaaaggactttgccgcgatgaccagagtccatctgcagttgggtggcatctgctccccacatgtcactttcctcattaacaagcaattgaattaattaaatgctactcagaacacgcataacaagctaccggcagtgtccaaattagcactgataatcaaggatgatttcctttattatcctgctaagtggtgtgcagactctgatctccctgtctgccctcatctatttacatacccccagctcctgcctttggaagcggaggttatcttacctagttaatttgccacgatcaccgagcatggcggattgatgccctgcccctgccgccactgccgggcccgggccccctccccggctgccctcccccagccccagcctttgtatctcaagctcactgataaattaaaggccacccctgtggtctctcaagtgagtaatagaggcagaaatttcattttgcaactggctgatttaatgatccaaagggtaattaatggcctgattatcttaatgttaaatatgtccggcagcaattactgtgacctcccgcttgtcaaggtccgggctgtgctcttctttcaattaagttctctggggcttaatggtatgaataaactcctctgattctatcatcccggatgcagagggttcagggagctgggggctcgtttggagttttaatcagcctgtcttctactccggcgatcagagttaacaattatagcaaggacagtttaactttcttcttcgccgtgcagacccccctacatgtacacacatgcacacttttgtgtgtggctttatgtgccttgttttcatgtgtttctttcagtgctctcagggagaattctgtttgtggaggaagctgctgtgctctgtgagcctcgtctcttccaatataaattatcatgtgaacgctgtggtttttctatttgacaggcttaattaattggcaggagcccccgaaaatgacagtaccactaattgcaactcaaagtgaatttctgtcaccgcggcgtgcttgtcagtgggcctgccctggccccagccgcagagcgggtccaccctcccagtttccccgtccaggcagggactgtgccctgctcaagccacgacagtggcagccttctccgaggagccgtgggtttgcaggcacaccgtctgctggcaggagtgacatttactaccaataaagtttatacatcctcggctatgcaaacgcaacagctgctcagggacctcagcccttacttaagatattttagcaacttctcttagcaagccaacttggaatcagactgagagaaccataactcacttagccacccttcatgactggatggtcctcattagcacactgctaaatatgcttcagtttactagagctcagggcccggatcagaaatattctgctataaatattaagccaattaggaaaatgtacaaatgagaagtacgttaacactgcctttaaaataatacctacagattacagttgacaacagatagagcaatgcatctagtgaacctccaccagggagcttggtgggaatccaggcaagctctccataaagactggctctaattataagaaaggtgattctaagaagattctccatgaggttaagtataatgggatctgctttttcaaggataactatacttgcatttgcctttgaaccagacagacagaatggtgctctcggtttatcatgccgcctgccacacaggaaccccagttatttgtttgatcctgcaagaaaccagtgtgtgcttggagccggctttgctaccgcagagctgtctagggttgaaaatccttatcatttacgttctgaaatacggccgtcgtgacaattaaggagtttctgatgcttaagaatttttactgcccctggcagatgagaaggcaagtcatcagcaggcagcaactggcttccaggtgccctgaccacgttcaagcctgtgtctacttgtgggagtgtatgaaggaatggaatgggaagattaacctttttaggcttgaattatataacatgggccaataaatatggcctctattttgattcctccagcagtcaagcattttccaaagggccctgtctttcagtcgtgttttgcttattttgcaccagagactctctgtcttctagtgaacttttctctttcttcttcttaatgaagaggagggagacaaaaacatggccggagcacacagcgccctgtgtgcttggattatccccattcccagacgtgtgccagggtcacatgggagcgcaggtcagactgcaggcaccaagatctgactccagatgccgctctgcagtcctgctgctgctcctgttccttttctgccaaatccacgtcagtagcggcattgggagaaccgccatgtttagcagcaccactcccactcgcccctggtcagtttctatctcagtagccatcgtgtgtcaaacttactaaatgagtagtgcaaacatattatgtaactacagtgtctttccacttcacagcagcttcacttatagtaatataagtaatcataaagcctcttccattttagtttacattcatttagctgacctgacttttttggtggcgtctctctctgtcgcccaggctagagtgcagtggtgcaatctcggctcactgcaacctctgtctcctaggttcaagtgattctcctacctcaacctcccaggtatctgggattacaggcacgtgccaacacacccaattaatttttgtatttttagtagagacagggtttcaacgtgttagccaggctggtctcaaactcctgacctcaggtgatttgcctgccttggccccccaaagtgctgggattacaggcatgagccactgtgcctggccaaaactcgaccttacaagtcacacagccatgattctaaagtcttaattctcttccatcagtgctaatcctaagagcttccacagaaaacagcactgagaactgtaaaatgttgagatccacccacacaagtgcagggttagagcccccccctcaacccccgtgtttcacgtaaccacatcctgctcatgtccctgacccaacactgcgttttgggaatataaagcctgtattgcagagacctcacaatcatatttattatctgcatggtacaatatggagccatgtctcaggccatagagttcctggttctggtttcatggccagcatcttctgccattttaattttaaaaacagggtaattcctcatttctaagaagagactagtcatttttccacccacttaattatgtagagttagtgctaaaagaaaataatatttatgaagtttcctgggcttcctttttatccagaagatacaatcagctttgaggcctgggtcatgcatactagcagtgagagggacaggtggtccatgccctccccgggggttgtggagggcctgctgatatagaagatgtggcccatgtttattttgctttgtatgtatataatggtttattgcagcatcagtatcacatggaaaggtatattcttgagccccacccaagcctacccagtcagcatccctagggggtagggtccagtggtgtgttttaactctctaggtaattcttatgcacattaaagtttgagacactctggtctgcactaagtagtaaaaataaaagtccacaatcttgcctgtgaactcactgtgttaatccaagtccctggacttcattcctcacttctttagacccaggtcttctgttttcttcctttaccagactgttgtctggcttagcatatccagtatatcccagcagatgttacagccagagagcatctacaagaggattagactctgtgatcaggtggcactgaatgcaaggaaggcaaggttggttcgacacgcaaaaatcaatcaatgtgatataccacattaatacagtaaagagagaagaaaacataatcttttcaagggatacagaaaatacatttgacaaaaccacgtgccctttcatggtaacaaacactcagcaaactagaaataaaaggaaacttgctgaacctgataaaggacatctctaaaaaacccacagctaacattgtactttatggtgaaatactgcaggcttttcccctaagatcacaaacaagacaagaatgtcaccagatctgttcagcattatactggaggttcaagccagggaattaggcaagaagaagaaaccaaaagcatccagatttgaaaagaagtaaaactacctccatttccagatgacataatcttttatgtggaaaatcctaaggaacccataagaaacatgttaagcaaaattgaaggatacaagatcaatgtgcaaaactcttagctggccatggtggcacagttctgtagtcccagctactcaagaggctcaggcaggaggattgcttgagcccaggatttcaaggctgcagtgggccacaatcgcaccaccactttccagcctggggaacagagcaagactctgactcttaaaaaatcaaaaaggccaggtgcagtggctcataccttaaatcccaatgttttgggaggctgaggctggaggattacttgaagctaggagttcaagaccagcctgggcaaaataacaagaccgtatctttaaaaaaaaaaaaaattctattgtatttctttctgtacactagcagtggacaatcaaaataaaattaaggacagttccatttacaaatagcatcaaaaagagtaatatacttagaaataaattacctgtacactgaaaactacaaagcatcatcgaaagaaattaaagaagacctaagtaaatgaaaagacatcatgttcacggattggaatatggcagtactcttcaaatcgatgtacagagtcggcaaaatcactttcagaatctcagctgcctgtttttttcccagaaatttgacagctaatcctaaaattcatatggcacagtaagagaccgtcaaatatcaaaacggtcttgaaaaaagaatgaagaagttggagatctcacactttctgatttcagaatttactgcaaaagcatggtgatccaagcctgtgtgatattggtgtaaaaatagacacacacgtcaatgaagcggaatcgagagtccagaaatgagccccttcatcggtgggcagttgatttccaaaaaagatgccaagacatcttccccatcaatggggaaggaatagtctttttaggaagtggtgctgggacaactggatatccacttgtgaaagaatgaagttagactcttatctaatgctatatataaaaattaactccaacacctgtaatcctagcactttgggaggctgaggcgggtggacacttgaggtcaggagttcaagaccagcctggccaacatggtgaaaccccgtctctcctaaaaatagaaaaattagctgggcatggtggcatgcacctgtaacgccagctacttgggaggctgaggtagaataatcacttgaacccaagagttggaggttgcagtgagccgagatcgcaccactgcactccagcctgggtgacagagcaagacttcgtctcaaaacacacacacacacacaaattaattccagattgatcaaagccttgagtgcaaaaactgaaactataaaacttttagaagaaaatacggggtaaatctttgtgactttagattaggcagtggtttcttagatatgatacctaaagtgcaagcaataaaagaaaaaatagataaattgaatattagccaaattaaaaattttagtgcttcaaagggcagtgtcagaaaagtaaaaatgcacagaatgggtgaaaacatttgaaaattaaatatccagtagggatctggtatccagaatatataaagaacggttacaggtgggcatgatggctcatgcctgtaaccctagcactttgggaggccaaggtgggaggatcactggagcccaggagtttgacaccagtctggacagcatagggataccccatctctataaaaaataaaaaacattagccaggtatggtgacgtgcacctgtggtcataggtaagctactcaggcggctgaggcaggaggattgcttgagcctaggaggtcaaggctgcagtgagccgtgatcgcaccactgcactccagcctgggccgcagagtgagaccccatctcaaaaaaataaaaatttaaattaaaaaaaagaatacttaaaactcaacaatagaaggtagattgtccaatttaaacatgggcaaagagctgggcatggaggctcatgcccgtaatcccagcatgtggggaggctgaggcaggaggatcacttgaggccagcatctcaagacctgcctgatcaacatagtgagaccccacctctacaaaaacttttaaaaattagctgggcacagtggggcacacctgtagtcccagctacctgggaggctgaggtgggaggacctcttgagcccaggagtttgaggttgcagtgagccgttatcacgtcactccactctagcctggataacagaacaagacctcgtctgaaaaataaaataagtaaaaaataaaaatgggctaagactctaaatagacatttctccagaaaatataaaaatggccagtaaatacatgaaaagatgcctaatgtcattactttttagggaaatgcagatcacccttgagcccccaccgcacgtgctcttggacggtcgtggcaagtgttggtgaggaacgtggagacactggtgcagccacttgggaagatagtctggcacttcctcgaaaagttaaacctagagttaccgtatgacccagccattcctcccccaggtctatacctaagataaatgaaaacacttgtccacacaaaaatgtacacctgagtgttcacagcaacatcattcataatagccaaaaagtgaaagtaacccaggtgtccctctgtggatgaatgggtgaacaaaacatggtctgtccgtacaccagaacgtgattctgccatgggaaggagtgaagtgtggatacaggttgtaacgtgggtgaacctcgaagacatgatgctaaaggaaaggaagcaggcacagaaggccacaccgtgtaccattccatctgtctgatggcgaaaacaggcacctccatagtaatgcaaagtagattcctgcttgccaggtgcaggggagggaggggcagtggcgtatacggagtgattgcctaatgagtacgaaacttcttttggagacaacgaaaatgatctggatttacatagtagtgatggttgtacatccttgcaaatatactaaaaaccactgagttgtacacttttaaagtgtgaattttatggtatataaattatgtcaattttgaaaaaaaaaaaaaaggaatttccaaaggaaaacagatgagccagggcgttccacaaagagcagctggagcaaaggtgcaggcgtacaggaacgcatgctgggtggcgggggcctgggtgcgggccgagggctggcgtggctgcccctcctcaggcctggggagtagagctctgagcaggatgtgcactgcagccaaattcctgccctgcggacggcccacaggggagcgagagcaggtggaaggtggtgcctatgtccaggggagcaagtgagcctgaatcagcgatcatcaccaccagatactgggagtccctgggagagatcaggcacttgacaagccctgcctcttggaatccgcacagcaaaccaatgccattctttccttttcctgggctaggaaactcaggcctgtgtctccctgagcctgtgaatgcaggacgggccagaacccaccccagatctgacctccctagaggaagccatggccagaggggaggggagggaggcagagccaggctggtatgggattctaggagcatactcaggactcgtattttgttgttgttgttgttgttgttgttacttttcatttattttcatgtattttttttagaaacagaatctcactctatcacacaggcttgaatgcagtggcatgatcatagcttactgcaaccccagactcccaggctcaagcaatcctacctagtcagcctcccaagtagctgggactacagccacatgcctccacactcagctattttgtttgtttgtttgtttgtttttgtttgtttgtttgagatggaatctcactctgtcacccaggctggagtgcagtggagcaatcttggctcactgcaacctccacctcctgggttcaagcaaattctctgcctcagcctcccaagtagctgggattacaggctcccgccaccttacccagctaatgtttgtatttttagtagagatggggtttcaccatcttggccaggctggtcttgaactcctgacctcatgatccacccaccttggcctcccagagtgctgggattacaagtatgagccaccgtgcctggccatcagctatttttttaagagatgggggtctcactatgttgcccaggcagggatcctggcctccagtgatcctcctgccttggcctcccaaagcgctgggattacaggggtgaggcactgcgccccgctgtactcaggacttttattttttttgagccagagtcttgctcttttgcccaggctacagtgcagtggcacaatctcagctcactgcaacctccacctcccaggttcaagtgattctcctgcctcagcctcccacctgggattacaggtacccgccaccattaatggctaatttttgtatatttagtagagacggggtttcaccatgttggccaagctggtcttgaacttctgacccccaagtgatccactggcctcgacctcccaaagtgctgggattacaggcatgagccaccaggaatggtggctcttaaccaaagtgaatgtggggtgtgggaaagacaagcatccatgttgatgtttagttttctttcttgggccattgggaggatgatgaggcctttaaacaacaagcaaaacacacaaaaggtaattccagttgtaaaatcttgacgagattattttcatgttaagaaaggtaaaagttgcacacatttgtgctggtgatttcgacaagattaattgattgatttctaggctggccacccagtgtagcagaggcccagcctcacctttgcagtcttggctttgtgactgggtcactgggctttagaggcaaactgtccgaggccagtgggacaaagcaagccactcctggctgcagagatctgacttcacagaattacttgaggcccagaaagggagaacagcagtgacaataccattaaagcttcaaataattaaatgtcatttataactgatacaaaatttcatcaaccaggggtctggaagatgaacattatctggagcacacatcactcaattttagggacccactcatataaaaagcatctctgatgtacgtgatctaatacaaatgaccctggaggatacatacataatcatgatgacttacctataagtctctcctcaaggacctcgaagagctgccacaatgtcttcatgctgatccttgccatcttaatgaaattaggagataactgtttaaaatcagagaagatgacacccagacaggaaaagtgacttgcctataattaacccagtgacttggaccaagccagaattagcctgtgaacctgtcacccagagactcctgagagaagccaacagcgtggcttaggagcatggagttatggctgcaaatgcctctagtagctttcagcctcaaatgctaaagcccaggacactcctacacgtgaaaatttgctctgccgtggctcgcgcctgtaatcccagcactttggggaggccgaggtgggtggatcacttgaggttgggagtttgagacctgcctggccaacatgttgaaatcctgtctgtactaaaaaaaaaatacaaaaattggccaggcatagtggcacacatctgtaatcccagctactcaggaggctgaggcaggagactcacttgaactcgggaggcggaggttgcagtgagctgagatcgtgccactgcactgcattctggacaacagagcgggactccgtcttaaaactaaataaataacaaaatgccagtagcactcctgctgaggagcatggaaagagccctccaaaaattaaacccacactgctgcagagggacccaggatcagctcccaccagctgattgctggtatcctttaaacagcacgtgaaaagacctggaagagcctcgcacccttcctcggagaattctttgggggtgtggaaggaatgaactgagaaagaggaatatgttttcattctaaattgccaaactatacctttctaaacacataaaatgaaaacaagaataatcacctgttctgtaatattccagaggagccatagtagatactcaataaatatttgagagattgtgttactttttcattgttttctttccaaaaactaaagttagggtcatgatatatgactgataaaaaaaggaagtggaagtaagtggccaggcaaaggctccatggagcatcagcctgactgatactgctggagaggtgaggcagatacagacagacagcagcttatcggaggccggaaggcttacgtgctgccttcatcacgggcttcgtcaaaacctctgggtttcaacacagcattggaaaaggctctgttcctgacgttcccacttgtggttttgaaattgccaagccaagggaagttcaataacttattcgcacacaggggcacgtccattggctttgagttaggagtgtcggtggtggtgtcttcagctcctcgggcccctattgttgctgcctgcttgtgactctgcattcgactggatgcattttatttctgaaatacactcgccccgtgggcggttttcatctggctgtgaagcagccatcaaagaaagctcccctaaatgttctgttcgcaggcagcctagaaaccttttctgacatgttgctaacactccatcaggctctctctggaataggaacagtgttcggccagcctgtggacagttgggtgattatcgaaagggaggcccacaggggctgcagagcttagaaaaaggaacgcttttaaatgtgcatatttacaacaaaatcctgcttcctaaggcaagcgagtggggtcccattgttgccggaacacatcatctccatcatccttttaaaaatggggctcttctgacagctgcctcctgctgggttgtggagctctgtggcacccagttgggcttcagggcaaatgaagccttaggacccaccatctagcactgctttcagcaaagccttccagagtccttccttctgtccagcagcttccttatcagatgggaaaatccttgcatcattaaacgtgacaagtcactgtgcttgtccccagctgttgtgctgagattctagggagtagctgtctgatggccagggtggcactgtggtcggcatgtgtcagcaacatcagagtcactactcgtggccctcagtgggatgtgccctcagtaatggcttgcccatgtgtcctgaaaacccttcttccattgcttgtcccactagggccaccctgcccaagctctggaggggacactcactgtgcaaatccgtttactgacacatgggcctcaggaagccctgatttgcaggctgcagtgaatgcacaaattactagaattttggtttttgttttttattgtttttgtttttgttttttgagacagagtctcactctgtcgccctagctggtgcagtggcacaatctcagttcactgcaacctctgcctcctggactcaagtgattctcctgcctcagcctcctgagtagttgggactacagacacctgccaccacgcccagttcattttcgtatttttagtagagatggggtttcgccatgttggccagactggtgtcaaattcctgagctcaattgatccacccgcgtcggcctcccaaagtgctgggattacaggcgcgggacactgtgcccagccaaattactagaattttgaatacctcattcttaaggtcccagtatcatgccattcttttgagattgttgagataaatcatgaactcttaaaatggttggattatccagagcaagtggtatattattcttttagctttttaaaaaatttatattggggtataatttgcatactgcattacacacattttgagtatacaatcaattcagttggttttgataactgcataggtctatcaataatattcctatcaccccaggaacttcccctgtcccccctcctgtttattctccctgttcagaagcagccatgaatctgacatctgtcaggataggttagttttgcctcttagaaaattcatggaaatggaattatatggtatatacgtttttgtgcctggctactatcactcaaaaatgtaattgaaaagaattgtttatctaccaatgatacattttccccatgtaagggaatatctgaaaatgtcttcttcaccaaccaattttttttttttttatcactgagacctaagagtttactgtaagtcagatgtactctgtgtagatctgcttctggagttggggttcagagttccaactcaggtcagactggcagcatccaacctggtctttaccactggcttgctgtgtgacccgggctggatgttcaccctcactgtgcctcagtttcccattctgccaagtgaggggtaagtgtagtacctgcctcatcaggatgatttcaagaattaaatgaacaatatatataacacaatgctgaacacctaatcttctcaatagagggctaagttctaaatagaagtcatctattagtttttttaaggaaaaatcactacgcttttaaaggagaaaaacttgtaagagtgagacactctgagcaagttcagaaacatcgttaaaaattataatgaaaaatactatgtctacctgtcatatttgctataatgctaaatcaggtgggcaggacaagtcttcagtatctacagaaatgcctagtattgagctagcccatttgagaaagtaaagatgtttctggaaagacaatctgattattttcttaggaagtagtgtgaaataatctatgttactatgcgctagatgatgtggccaagactgggagtaacacgtattggaagaagagaatggggtcctgtcttttctctgttctggggaagaaacctcatctcttaacagacgttccgcacatcctttccagtatgccgtgttcacgtgaggtgagacgaggaagagcgagtgtttttcacaagagtctcatggaatccaaagagtaatgaccgttcctggatgttttgcatcatgttccaaatcatagccaccgggctgtcagggtcagccatccgtcctgtgctatctcatctggcaaagagaaggacatgttgtgtatgttcctgtaagacagagtggctcttactaaaatcaaataattggctgggtgtggtggctcacacctgtaatcccagcactttgggaagccaaggcaggcagattgcctgaagtcagaagtttgagaccagcccggccaacatggtgaaaccccatctctgctaaaaatacgaaatttagctgggcgttgtggcatgtgcctgtaatcccagctactcggaggctgaggcaggagaattgcttgaatccaggaggcagaggttgtagtgagccaagatcacgccactacactccagcctgggcaacagagcaagactccatctcaaaaaaacaaaaaatcaaatagctagcgcagatcactgtgaaacatctgatggtaaaaaacaaaggtcgttttgttccataatataataacccttcctgttggccaactccctctcctctcctctggcactgctggtaagagtgaaagttggggaaaccttcctggaaggaacttggcaatatgtgtcaatagcctttaaaatgatatgctttttgacctagcagttcttctcttaacatttatcctaggccgggcgcggtggctcacgcctgtaatcccagcactttcggaggccgaggcgggcggatcacgaggtcaggagatcgagaccatcctggctaacacggtgaaaccccgtctctactaaaaatacaaaaaattagccgggcgtggtggcgggcgcctgtagtcccagctactcaggaggctgaggcaggagaatggcgtgaacccgagaggcagagcttgcagtgagccaagatcgcgccactgcactccagcctgggcgacagcgagactccgtctcaaaaaaaaaaaaaaaaaaaaaaaatttatcctaaaaactgaaggatgtaggctaggcatggtggttcacgcctgtaatcctagcactttgggaggccaaggcaggcggatcatgaggtcaggagatcgagaccatcctggtcaacatggtgaaaccccgtctctactaaaaatacaaaaattagctgggcatggtggtgcatgcctgtaatccaaactgctcgggaggctgaggcagaagaatcacttgaacccgcgaggtgaaggttgcagtgagccgagatcacgctagtgcgctccagcctgggcaacagcgtgagactccatcttaaaaaaaaaaaaagaaagaaattttaaataaagcaaaaattcaaaataggcaattaaataaattattactttagtatgcaagtaatgcatatagttacattatataaaatacatgattttgtcgtgtacacgtgacaatgcaatgtaaatatacatacgttatgatgtataattgaatatatatcataaaatcttacatttcatataatgtaatgaattatatataatgtataaattttacatggtaagtatatgcattatttatacatatgagcatagcacatgatataaacagtgcaactttgtttttctttcgatacagaggctccctctgtcacccagtctggagtgcagtggcacaacctcggctcactgcaacctctgcctcccaggttcaagtgattctcctgcctcagcctcccaaatagctgggattacaggcacacgccaccacgcctggctaacttttgtatttttagtagagacggggtttcaccatgttggccaggctggtcttgaacgcctgacctcaagtgatctgcccacctcagcctcccaaagtgctgggattaccggagtgagccactgcacctggaaatgtgatgatgcaggtgaaaatgtgattacatggggagatagttatggtattctgttaaaatattgtgtaccccaaattgttaattgtgacactttctctaggggatagggttctgatttattcttatttattgcttatctttattttctaattttctgccattttaaaaatttggttagatttttaataagctatctatgacatcagagccgtagagggccgggaatgtgtcattgacatgaatggcatggcttgcctttcacccagtgtgacagtggtggctgacgccacccaagggcacactggtccactgtcagtggcgcctagagccctggcatctgctggctgtggcgctgtatgagagcattcgtgttaggagtaccactggggtgtgacccccacattgctcccgaaagctgtgcagccatgacccgcaccctccccagactcagtttcctcctctggaagtggacctgctagttctccttttgttcccagtttgctcttggtttggatttggcatcagggcgagtggttaggggcagcgtccggacaccatgctcacctacccagatgaatgagaaagagcagcattgaaatcctcaggctaattctgaaggactcttagcagctgaggagcatctataaagttatgagttcctctgaagttttagtgaaattacggggctactctgtggcctaccacttccacccctaggcgtatccacaagagaaatgaaacctgcgttcacacagaaacttgcacataaatgttcatggcagcatcgttcctattagctacacagtggaaacaaactaaaatgtctatccaccaatgaatgcataaacaaaatatggtgtatccacacaatggaatattgttcagccacagaaaagactaaagcattgatgtatactacaacgtaaatgcaccttcaacattatgaagccagtcacaaaagacttcataccgtgtaattacatgaaatggccagaataggccaatccatacggacagaaagtggattggggtggccctgggccggggcaggggcggggaggcatcagggggatgggcagtgcttgctcatgggagtgggacttctttttggggtgatcaaaatgtccccaaattggttgtcatggtggttccatgactctgaaaaatgctaaaaccattgaatggtgcatttggagatgagtgaatcgtagggtatgtgaattacatctcagcaaagctgttagaaaaaagaaaagatatgccacattttaagtggtgggaaaaatcaaagagagcatgttctgagttttaaacaaagctagaggagatcatgtttctgagaccgttaaggaagcccacggctttgccggcatggagtgagaagatgggaaccacctgcccagtcgggcttggagggcagcgctggttcatttctttgacatcagtggccttagccccgaataatcctttttagaaaatcaaagaagcactcaggctaaatatgcaggatttttgaagtgtccaacagattttatttgagaccataaaaggggtttgtgaactgtctgggacagtcatggaccaagtctgagcccacctggcctgcagatggcttcctgctgagcacctcggtggtcccagccactcctggaaggattggttctagcacagagaacagagcccacccaagggactgtgaggacctggcttggggtggcagggcctgaccccaaggatacatacaatctggaacatttatttgttcaacagccactctcccagaaccacactggggccatgcgatctacagacccttatgtgtgctgtgtgtgcagaggggactcacggtaaacagttcagccagtgtttgtgaatctgcagtgcgatgcaggaagacctgcctgatctgcggtggactggccaggaccagcctaggaaagccatttgggctgatctgtctgaaagagctgaattaaaagtgagagttttaataacagaaatgaagaaggaaaaaaatggccagcagcataggagtgctccccagtgttgctggggagtttcgctgctgctcagcccctgttcagggtcttctggaagctcccagcagcctcctgagacagacaggttggagcaccacagctgcctgcggctggcacacagagtcgtaatttttcttggttttaaaaaccaatccagatcttggaattatccaccgttgtggtaaacttaaaattgtccaaagacaccggatgactctccttcaaatggtgtccctggcccatctctaggagagaactaaactttttttaaaaaaactcacatatcctgtggtttttcaattctcaaaaaaagcttttgtctctcctgtctgttctctccaaaagtagtcttcgttgtgggtttttttttttttttttttttttagagataaggtcaccgggcacagtggctcacgcctataatcccaggactttgggaggccaaggcagacagatcacaaggccaagagatcgagaccatcttggccaacatggtgaaactccatctctactaaaaatacaaaaaattagctgggcgcggtggtgcgcgcctgtagtcccagctactctggaggctgaggcaggagaatcgcttgaacccgggaggcagagcttgcagtgagtgagccaagatcgcaccgctgcactccagcccggcgacagagcaagactctgtctcaaaaaaaaaaaaagagatagggtctcaccctcttgcccagagtggagtacagtggtgtgatcatggctcactgcagccttaaactcctgggctcaagggctcctcctgcctcagctgcctgagtagtcaggactacaggtatgagctaccatgcccagctaaatttaatttaatttatttatttatgtaggtaggtgagtatagacaggatctcactttgttagccaggttggctcaaattcctgacttcaagtgatcctgccgccttggcctcccaaagtgctaggattacaggagtgaggcactgcatctagcccaaaaatagtcttttcttacattttcccctctaatgtcttacctgccataccactgtctgctgtccagctgaactataccaggagccatatgtgttgttttaaattttctagtagctgcatgttaaaaagtcaaaagaacctgatggaagtaattttaataatgtagttaacccagtgtatgtaacatgtcaattcagcatagcaagcaatgtaaaaaagcattcaggagatatttatattctttttttttttttcctagacagtctcgctgtgtctccaggctggagtgcagtggtgcaatctcagctcactgcaacttccgcctcccagattcgagcgattctcctgccttggtcccccgagtagctgggattacaggcgcacgccaccacgcctggctaatttttgtattttttagtagagacggggtttctccatattggccaggctggtctcgaactcctgacctcgtgaaccacccgcctcggcctcccaaagtgctgggattacagatgtgagccaccgtgcctggcctatattcttcttttattctgagcctttgacacatcagtaggttatttcacacagcacatctccattaggactagccacgtttcaagcatctgatggccacatgtggcccatgtttggcaatcatgggtctagatagcttatcaggacaggagttacatttgccctatcagcttgcaaaacatgctgcaaaacagcttgcaaaacagctggggactggagatattggattataccatcttggtgttgcgccagtcaggagtaattgttgtaagttaggctttgacaaggaccttgtaatgatgctcacatagaagataatttataaatacctataacataacctgagaatggcgattaagtaacctggtcttaactccagggcccaccacagcaactttgagcttagatgccacttaaccttttgtaacttgtaacttcattggtggtgggggtacaggcaggtcagcttgttcacatgggctgcaaacatggctttaccccaccgtctcccgtggccttctcaacacactttagaatctgcaggagacctgcagccccccaccagacccccagaatcacactatgctggttggcctgggcatgcccctccccccaagcatttccgctgcacatcccagctcaagaaccaccctctgggtgccaaggtctcctccaggagcacaggttctcacctggggctgatctgccccctggggacatttggaaatgcctggagacatcctggattgtcccagcgtggtggggggctggggagcccctgctagctgtagagatccagtgacagtttgcatgagaggtttctccattgcataccagctgactctgaggagcagcttgacgcggtaggggccctagtgagaaaccttgccttcctggaccatttgggccacaagtcagcataagtgacttctcctaacatcagtaccctctgcaagggagaggctaaacaagaagacccccggggagcccctgctagcttgggaagtgtgtgattctctccactccctccccatagaatcaactgtaaaagctttagccatttctttgggacgactttggatcagcatataaagatactgggtgttctgtgcacactctgcactctgggaagttaatgagcagtttttatctggcatggcacaggctgttcttaatttttacaagcttaagctcagcaatttcaagttcattctaaacattgaaagagtccatttgctcttacgagataatagtctccataaaacctaacatctacatacagtaggtatttctgaaccacactcaaccaaaataaatgtgtaaaaatgttacgaaacatttattgaattagacaatgaccaaaaatttcttcagtgcaaagcacactcagatttggtttttatttccatttcctgttttcttttacttaaaagtctatagaattaacataaaggttgagttctcagtgaaagaaaccaggctgggcatggtggctcatgcctgtaattccagcaatttgagaggctgaagcatgcgcatcagttgagctcatgagttcaagaccagcctggaccgcatggcaaaaccccatctctacaaaaaatacagaaattagccaggcatggttgcacgcgtgtagtcctagctactcaggaggctgaggtggaagggtggtttgagcccgagaggtggaggttgcagtgagccaagatcactccactgcactccagcttagacgatagagacagaccttctctcaaaaagaaaaaagcgagacacaaaagatctataagtgattgattcggtttacatggcgtctcagaaaaggccagtctgtagagatagaaggagaagcggttgcgtcggtgtggaaaggaaaatttcaggtgggcatgaggaatctttcaggggtggcagaaacgttctaaaccagattctggtgatggttgcgcgctgggttttttttactagaaatcactgaagtgtatccctaaaaacaggtagattttatgatatgtaaattataccttaatacagctgttggggaaaaaagaagacttggtactgcccatccccacccccaagggctcccagtttattaagaaaactaaggaaaacataagacagatgaatgggggatgaagccgcaaagggtccccgctgctgcccccttggacatcgtaatagtgaactgtgttctggccttgggtgaggatcaaggaagctgggcccagatctttttccttggttttcaaagccttccaggtaaatatgggacctgccagggtctttcagcactggaaatagccgacatgcccctcagtggcctccaggggaagccccccaggagctttgaggagctgctttctcctccgctgctttgaggagcttatagccccttcaagctcttcccaaacctcacaggcctttctgcgtccctgacagaggtctcaagaggagcctttgacaaacagcagtgagagctgattgctgcccagtgtcatcaagatgccgccattgattctagctttggaatctgtggccaaataggtgactcaatctgaaatttatttggagaaggcagacaaacattcagaggaagcagcagaagttccattagagcaaacctccgcagggagtgagagcaggggccatgctgcagaggaggccggggcagcgtgggtcacccaggcggaggcggtgccgccccctcacatggaccaggggtctgggggcagctctgctcctcaccaaggcccaagacccgtgctgtcataacagtcctccttcagagacacccctcaatcagatctaggaattgaaagtcagattggtttcacaagagaatattgtggagttttttaaagtcttgaggcggggcgccgtggctcatgcctgtaatcccagcactttgagaggccaaagtgggtggatcacttgaggtcaggagttcgagaccagcctggccaacatggtgaacccccatctactacaaatacaaaaattagccaggcatggtggcatgagcccataatcccagctacttgggaggctgaggcagaattgcttgaaccctggaggcagaggttacagtgagtcgagaccacaccattgtactccagcctgggtgacagagtgagactccatctcaaaaaaaaataaagtcttgagaatgttcacttcctgacggctttgcacatggcccataacaagctgtcctgaccttctcagtgtgtgacccaggacaccgtggaatctgggaaagccatgatttccacagtatactcctagaaattttaatctcagagaatgatgatagatgtttctggaaaatgagttgtgtttgagaactggattaaacaaaattacagaggcttctttgtggcacttaataatttcccaaaccactaaagagggaagccccagcgctatgagcatacctggcaacagaccacttcctagagaaatgcctccagtgagccagggctacattttgggaagtgactgtatcctacagagtagaaaaatagtcccagcacagggtctcatgcctgtaatcccagcactttgggaggccaaggtgggcagattgcttgagcctaggagttcaagaccagccagggcaacatggcaaaaccctgtcactacagaaaatacccaaaaaaaaaaagccaggcatggtggtgcatgtctgtgtcccagctactccagaggctgaggcgggaggatcgcttgagtctgggaggaggaggttgcagtaagctatgattgtgcccctgcactccagcctgggcaacatagtgagaccctgtctcaaagaaaaaaagagtagaaaaaaaaaaaaaaaaatatatatatatatatattcatattccaacccccgagagataatcagttaatgtttgacatattacatgtagtcttcctctgcaacatttgtgaaaagaaacagtgctttaaagaatttaagagccttttttgggctaaaactatatcatgaacatcttctcatgtccttatgtatgtctctttttttttttttttgagacagtttcgctctgttgcccaggctggagtgcagtggcgcgatctcagctcactgcaacctccgcctcccatgttcaagtgattgtcctgcctcagcctcccgagtagctgggattacaggtgcgtgccaccacggccagctaatttttgtatttttagtagagacggggtttcatcatattggtcaggcttgtctcaaattcctaacctcaggtgatccacccaccttggcctcccaaagtgctgggattacaggcatgagccaccacccccagccatgtatgtcttttaaagcgttatttttagtggtgtcacaataatccgtccatggttgagccgtcattacatagtcatcccccttggacatgggtttgcaatgaaatattgaaataccgctgggttgagcacatttgtgaatacagcttatggggcttatgattaattcatttctaaggatgagtttctagaaggagccaaatgaggtcaaaggctgtggactttttcaggtattgatccaacatcactgtgctgctctccagaagggtggtgccctctgtgtacatctgttctttctcaccttgcgtctcccctgggtcactgccagcctcacagcgatagggctctgcttcaattgggtctttgctctgctcacagccatgctgtatccatcagggttctccagagaaacaaccaatttgtgtgtgtgtgtgtgtgtgtgtgtgtgtgtgtgtgtaatctgaagtgtgtagggcaggccagctggtgtgtgtgtgcatgtgtgtaatctgaagtgtgtagggcaggccagccgggggtgtgtgtgtgtgtgtgtgtatatgtatgtgtgtgtgtcacatctgaagtgtgtagtgcaggccggcgttctggaaactcgggcagaagttaatgctgcatgcttgatgtaggatttcatcatcacgaaacctgttttttgctctttgggctctcacctgatgggatgaggcccacctgctttctcaaggataattgcctttgtttggagtccatggactataagtgacatctacaaaaggccttcacagcaatgcataggttgtgtgtgatgaaatcactggccgccgtggcctggccaggttgacatgtgaaactgatcatgagtcatcctgctatgactttaattgcctggagaattccttcccagcaaaagccgcacgctgcttctcccagaggggtggggtgcattttattgggcacttttgcctttgaaaacgtaatctccctagataagtattaccactgaaccacctgctgagcagcgtgctagcatttcttgactccagatgggtttcacacacgtctgtcccctacctggctcctgtggctgggtgctagatgggaccatgggacccaagtccaccctctggccccttctccctgtaggattcctaagcttgagccagactggtcgttctgccaggttggttgcccaccctcctacccctgcagcggccccatcccacgtggttaagtgggtggccacacccactgcctttcctttctcacttccagctctgttcttcattccagcagaaggtccagcctcacacagtgacccagtgggcttgaacagtgaggttccagtcccgtccctttagcctcatccctcatgggggaagatacctgatgccggggctggggtgtaggaggtggttgaaacagcctgatctacacccctgcctggtgggttagggctccgatgccacaccaggcctggcatctagacagagagttccacagagtcccctctgcctgctatgtgccaggcactgtactagcaccacacctgccctcaggaaactcacagcatgaaggagagagagacaccaaaaattgcttgatactgtgacccatgctggccaggcacggtggcttacacctgtaatcccagcactttgggaggccaagcgggagagtttcttgaggccaggagttcgagaccagcctaggcagcatagtgagactctgtctctacaaaaaaagaaaatttaaaaaaaaaaaaaaaaaaacaggcatggtggcatgtgcctgtggtcccagctactcagaaggctgagttgggaggatcgcttgagcccaggaatttaaggctgcagtgagctgtgatcgtgccactgcattccagcctgggtgacagagacctcgtctcaaaaaaaaaaaattatatatatatacacacacacacacacatacatacacacacacatatacatatacatacatacatatatatatagtgatccatgcaaaatctgcagcaggggtaggcagacaggaggaagtgggttgcagggtcaaggcaagcctcagagaaaaaaacctgagactgagtggccctgacaggcagttggtgggacagggaagggggtggtacagacggagggaacccccatgcaaaggtataaaagaggaccccccaatatgctaacatgtattccactgttgctgaagactaacactcaaggcactggttaccagggaatgagaacttgtgttgagtttgagattttacttacctggcaagttggccttccagtttcacggagctggtctaagatatgagacttcagggtcagagacaaagaaaaatccgttattcacagcaatagcagtagccagagtattagcatttgggtcatttcccaggtcccagtgcccatagctgtgatgtagtcagggccccatggcatccgcacacatcaagggctgcattgcaggagaggaaccctaagcttaggaaccaaatcttctacagtgggcacaaagcacatttgccctgtgctctggagggagatgctatctccatcatccaaggctgtttcctgtgcatgttcttggaaagatagttgggaaaaaaggcaggcagagcctctgctggaaagacacagggaaaggagagagaagaattgttacccggcaaagatcagactgcctcctccaccaagtctctggtctagattctgtgagtccagaaacctccatctcagtctaggagggacagctaggaggaaataaggacgtcagtttgcaaccagacaagtttagaggcctgtggaattcccaggccaagggaagagttgttacggagactctatggccaagagggacagatcacactagacatcaagctcaatggatgccaccaagggcagccacctgctgtatcttgtacacgtttcatccatccagcttttagcctctcaatccttctcttcctaatagggtaggtataagattcccattgctgctgtaacaaattaccacccacttagtggtttaaagtaacacggaagtattccattacagttctggaggtcagaagtccaagctgggtctgcatggtttcattccttctagaggctgtgagagagtccatgcccctgtctgttccagcttctagaagctgctactcatcttggtggccttgcatcccctctgacctgtttctgtcctcacatcttctgactctgattctcctatttatatgaccctcttataaggacccttgtatattgggcccacctggataatccaagatactctcccctctcaagggccttgtcttaaccgtatctgcagttaggttgccatgtaaggtcacatagtcacaggtcctggggattaggacgttgacatctttgggagccatttcccttctaccacattattctgacctctgtagatactgtggcccatgtcatcaaacccccatgacagtcacagccctgcctatttctttccatccagacaggtggtgcctgtgggtacatctcagcgtagggtgcagacagagttgtctgttggaaggaaaaccacatcgaatcgggaagggagggtcctggctagagtaaggacagtgggcaggaggccggggtcctgtcctgccacaacactgaccacctagaacctcaactttcttctttaaaaataaaaagagagtaactacacttgccatactgaccccccaggttgtatggaagctcagtggagaaaatggccggggtgcgtgtctgaaccgcgctgcatttggacggacactttgtgtgtcacatgttagtagctgcagtgtgtcctccacccgactgagagtctgtgtatcaagataggggtaaatcctttctgaccacttgcagacagaagtcacgcctcgtggtccaaagccaccaagtcattacttttcaaagcttttccagtagagacacatgactccttccttaaaacaacttacagtgaaaatatgtggatggttgaaaaagtaatgtttccagtctgctgaaagttctgtgggttttttttttttttttgcagggcaattatctgtataaaatactttttttcttttaagtagaatcctattgctaatgaaaccatattttgaacatgaaaattgttacaaagaagaaaaaatgtcattatccagaaaagctgcaatagctcatgcatttgatggtctaaatagaacatttttcttctcagggggatgaaagcggtcccctcctattagcctatgaaattattttagaattgggttttaatccctggaacgagaaagggggatggaaccctaacataggttccatgcatgggaagtcaaacctgaaatttagagacaggaaatatagcacgcctagtcactaatccaaaaggaatgtgaaaaaagagttgttttaatgttggaaaaaggcagcatgaaaggtaaggcttccttcctgccgtttcctctggtgcccttttctttcccccgatcacatttgctagatgtccatttctgtaagttttccctctagaacaaacctatcatttttcaccacgggatatttacagcttcaatcagtgccaaattcaattggcttctgatctcatcgctggaagttatagatgcagatattatttgcactgcggttaattatggagcaatcaaaccttggcttttccactgtaatttcctctgccagctaatttaattaatcacccccagctcagctcttccagctgcgaccagcagggtcattaattaggcatgtggtgggagctcacccaccaggtcctgctacggggccgctgcccatttgatctctcagggagggagagcttttcctaagcatcgatcccctccagaaaggaagatggttcccaaaaggcctatcaggggcaaacagctcacctgcagtggtgattggtttacaaaattcacctagttaaagaaaagagggccaggtgcaacggctcacgcctgtaatcccaacactttgggaggccaagacgggtggatcacctgaggccaggagtttgagaccagcctggccaacatggcgaaaccctgtctctactaaaaatacaaaaattagcctggcgcggtggcaggcacctatgatcccagctacttgggaggctgaggcaggagaattgcttgaaacctggaggtggaggttgcagtgagccgagattgcacccattgcactccagcctggaggacaagagcaaaactccatcagccgggcacaatggctcacgcctgtaatcccagcactctgggaggccgaggtggccggatcacctgaggtcaggaattcaagaccagcctgaccaacatggagaaaccctgtctctactaaaaatacaaaattaggcaggcgtggtggtgcacgcctgtaatcccagctacttaggaggctgaggcaggagaatcacttgaacctgggaggcataggttgcagtgagccgagatcacgccattgcactccagcctaggcaacgagcgaaattccatctcaaaaaaaaagaaaaagaaaagaggcctcgccttccatttagactggctcatgaacttgccaaagaaagggctgttgtcagtcgccgaggcttcggtctcaggtttttcaggtcagtgtgtgcctaataatgcagatgtcatgtgatgagctcggtttgttgcaaggaagcgtcgtcctcctcacgggctctttacgttgacattgtggctttggaggctgatattttctctaaaggaaagattaaaggattgttttcattttattataaggaagagacatttttggtataagcccatcaaagttggtgcctaaatgctgcaactgattcttctattattttgaagagcctgtttattttccagcagttaccagcttaactaagacattgtcactggaattccgtataaatgtgtgcatgctcacacccatgcctacattagaaagagaagtaccccaaatttgggaggctttcttatgatcattcttaaatagtttattgtcttataataatgtgggcttttttgttttacttaatatataggaagatttttttttaataccttaaaaatactgcacattaagtctgtttttttacagaaggataaatggatgaacaggtgttttaggagccacaataaaccatcgcagagcaaggagtgcctcttctgagatcccattcgatgctctgccctcaattaaatgaatccgagataaatgggcatgtgcgtgtgtatgcacacacacgtgcacacatacacacacaggcacacatatgcacacaccaaggttctagatgagaaggaacagagggatccagctcagtaattaaaggaataataaggactcattgtgtggcaggtggaagaaaaggtgcaggaggaagactcacaaagtctggaggattggcgctctctgttcagccgggcaggaaggcaggaagcacccctgtcataaaacccctacagcctgtaaacaccaaagttccctcctgtcttggagtggggctgggaggccccggtggggaacagctgtaatgatggttcgctttagttgtgccttcctgaagggcgggggggggtctctgcggccaccttaaacttaaacaagtgtattcagtcttgacggccagccccgtgacctgccagcatattaacatttaaatgcacagtacattcattcatttcatgctgtaaggatcattctggaacgaatgataagtagtggtttttccctgacattcgtactctacttttggaagtgtgggagattgttgagcatttttaaatagccataatgcaaggggcttctgtgtatttctagttcttaaagaaaatgcaggatgcaaacaaaaaattaattttcagacattttctttcaggaaaacctctgtttggatataaatcattgaaaccttgaaacaaatctgtcattctattcacaactcaaatatcaattttaagaatttttgccgggcacggtagctcatgcctgtaatcccaggactttgggaggctgaagcaggcagatcatttgaggtcaggagttcaaaaccagcctggccaacatggtgaaaccacgtctctgctaataatacaaaaaattagccaggcatggtggtgggcgcctgtagtcccagctattcgggaggctgaggtgggagaatcacttgaacccgggaggcagaggttgcgttgagccaagatcatgccattgcactgtaatctgggcaaaagagcgagactccatctcaaaaaaataaaataaaataagattttttaggccgggcacggtggctcacgcctgtaatcccagcactttgggaggccaaggtggatggatcacaagctcaggagttcaagaccagcctggccaacatagtgaaaccctgtctctactaaaaatacacaaaaaattagccgggtgtggtggtgtgcgcctgtaatcccagctactcaggaggctgaggcaggagaatcacgtgaacccgggaggcggaggtcgcagtgagccaagattgtgccactgcactccagcctgggcgacagaacgagactccgtctcaaaaaaaaaaaaaaaaaaaaaaaaatttttatttacccaattctgtgactgcctgaactggccaggacaaatagagaaggggtggtaggggggcagtgttagattctttctggagcactagggtgcaaatcagaagcgtcctttgttgctgcagctctccccagccgcctggaggatctgtttgggaggggagcactctctaaggctagttttgttcttgctcagatgatcaaatctctaatgcatctctagtaccaacctcacttcccagcctgagtttccatttgtccccagtttccccacacaaagagcaacaaacactgttccagctggtaggaccagcccatggatcccagaggcccagcatgctcagggctccttcttttttctcatttctctcctccccatctccagacagcctttaccgttcataaaaagaaatgcaggcctaaagaggactgggggctggaagagggttaggctgagtcccattgcccagggcatgaccagggaccatgtggtggcccccaggggcatcatgtggttttccaggccaaggagctgcctggctccatgggccgcctcaggatgtggcccagccggcttcctttgtgaaggcaagccccacacaaggagcaggactcctggaggggacaatggctgtccatcagtgatagcaaattccagcgtccaggccgtgggttcatctggctgccaggctgggctgatggcagcaacgctgaccacactcgtcatttctctgctgttatcacagcctgggagcgggacaggatctgttccattgactgcatttttaaagctgccctgatcttcctttttgccctaatcttccttttcctactgcccttttcccccctcctcctgcttagagataccagctctgacagtccgaatgtaagaaataattggattctaaattctaattcatctgtaaagtattcggtgattaaattagcctaatagatattatttcttacatgactgcgtaattttatcctgattggatctcagtggtactaacgtgccccccaatttactattgacttgaaattctcagaaggcgagacataactctctgtcttcttcagtctgttttcccaggttaaaagttaaactgatttatgctaaaggaagatcaccttactgctcaagtgtagttgcacagtgtatattgttctttaagaagagcagtacaaggaaaatattattttatgtaattttaaatcctctttttcctctttttctattcagaaactaaaagaaatactgcccatttaaagtctttggacagcaatttgattgcaggtaacatagtttctcttttaaatagctggaagtctcatccaaacaaaactaaccgtcactcagcatagagctgataagtgttgtggatacattccaaaaaattttcaacattcttaggataaaattttagctgggcgtctttagccatttttaatagagccgcttaaattcttggtcaggaatgagatagaaagggaacgaagtcatggaccccagagatacacaggagggcactggccagcacttattcatcggccttatttctttctttctttgcataaatttaatttcttcaagtatgtgcctctcccctcccccacccccctgccctacctccctccctccaaaaatctgcaaataaaattccccgctccctccctggttgagtagctggaagcagctggtgggttttgtgtggctactgaacagtgggggaaaaaagttttggcaaacactcgggaaacccaggacagaggaggtaggtaaactcaggaaactgttttcatgagtaaatgaaggaaacaaaggcctcgcagcaggagcagaagggacacacactccctctgaatagctccctaaaaacagagctgaaaaggaagaaggcccatttgcttctgggaatccaataaattgtttcaggaagtgaaagtctgtccaggctaatggagctgtgattgacaggccttctcattatggagcccatcaggggacagggcattccagtgttatttaggggtcgaggtgggaatgagaggaagccagagcccggggtgggggcgggagcgggggctagctgtgggtgttcattgaaagagtccaggtccccgacagccctgctccaaggacagacaacctcgtcttgcaggatcatttaccttttatattatgacctagccacttctcatggctctaccacaccatcttcccgagagagcctgtgcccgccccacagtcccggctgaaatggcaaatgcggtgtaggactgtggtgcacactgcccatgacgggctacttggacggctcatgcccacctctgactagtttgatgttctgaatcaggccccttggttaagcgtgataacatgatcacctggtgttttaaagcttttctctgtttccatgtggtgccgtgaatagtctcataagccatgtaagtggccttattggttaagtgacaaccggggacatacccattttctttgtccatgaagcaccaaataagaagttggcgtccattaaactagattgattatttaatatcacaaggcttttgaatgggctatggggaggaatagaccagaggtctttgccaggaggagacgttacagcaggtcctctctggttgggacctgcttaaagatgtgtaaagaccttgaacatcagcatctggcacagccaggggagggacagggaggacgagagacctgcttggtatccttggccccggggtccaggttattcagtttgttgatggctatctggcaggactccctcctgagcaagaaagaccctcagtctccacgatggttatttccagaaaagtggggaccttcaccaatgtgcctttcattgtgaaccttacccagctgggctccaggacacctaggcacatccccgtctctgggtccccagccttatcatgtgtctgagtgtcctcagacagtggaatccttccttcaccttactgagagaggccagcgctgttttcattttggaattggcaaaaggcaagttttctcctacaatgctttgaaagggtttaatgcacactgaagaaacagccagatagctccagctctgctggaaagggcaaagacccattaagcatctggagtttgggtcctgggttgtcacactctgtaatgaccatcttggagggtaagacacttggcagtgggcatgtgaattggctggcatttccagagtcatccttactgttgggctattgggtgatagctagtgggtgatagctattacatgaagaagatgcctctgtgaacttaaatgttggttcagtgactcacaggctccaggcagattcatagatgctttcatgtttactgatgcattttgtattcttaagcttcaggaagtagtgttaattatttatctgggtttaactacactttaatttttgtaaactaagtccagagcggtctacatagtaaaaccatagattctcttttgtttgatttctgtgaattgcagcagtttatgccacaattgtagccctgtccccattgtcacgaatctatgtatccttctgcttctattcactgtgttccagaacctatcacggtgcactgcaatacctcattcctcacgagtgctcagttggtatttcttgaaagaatagttgcttaacagggcattcgatcatgatggtgatcgtcataaagacacacggggctgaaatcaaattcaaagaactcacttctaccaaaagagaaagaactggtttgtataatatgtttcaaagtacagaaggtagaaggtacatcaccaccgtccatcacgtgaaggagtagaaaaagtgggatgccacagttgcggcagagaatatccaaaaggaaagggtccaagtcagaccgctcacgtgggtggcagcgtccaagtccagtttgtacatttctgcatggatgaggtcttttcaaagcacatacagttgtgtgatttttatttccccaagaaaaaataaaaagttaaagtcagtctagtcaattgctttaacacaaagagcaaactgacacacagtttccctgggcattgctacatattccttgctcttccgtaaaggacacatgtgtctctgtgcctctcagtctcccagttgcaaagatgccatcccaggtcaagctgaggtccttgcaaatgaactgcatgctggagataaagcgcctactaggctgccgggtactggcagaagagagtgagcgtagcaactgggaggtggcctgatggcctgcgcctgttgccgttgatgagacccaaagtctggaacgaatctggttccatatagagttcatgctcaccccgaagtccttctttggcactggagaacaaagaagagtttgcacagaagaaaagggaggttgtttaaccagaaaggccctctgcaaatttctgattcctgtacagtcagcattaatatgctgcttttcagacatccaaatgggggattgaactgtgagagtgcaggcaataaagagtgcatttgtggaatgataacctgactggcatccctgcctcttgaatggctgacgaggtctaattggcatgtaacgccctataaatttattagcatgcctcatttctcattggtggactttctactgttaaccaccaagaaatgaccaattttcaggagttagtcactcaagtcgtacttataactaggttggaaaaaaaaaaactcacactgctcctattataaatcaaccttatgcctgtacagcagctccctggctgcaaatgaatccatcggatacagaagttttgaggtgagtggagttgcagggaggagcacgtgtttaccaggaaacccactgctctcctcaccttgccctgcgcgcctgagcccttcacagagaccggccgtgtcctcacccctctgtcaccattgtgggctccagctgcacaggctggggatgggctgggtagaaatggcagttttgtggtcgttcgcacccaggactttgatgttcctactgatatattcaaccctcaggcgtaccatgcaaagaggacatagccaccctcttatttcaagagcatgatagaaatattcagaagcagacataattatttcaattacttctctctggtttttgagacgcacactcaagagtcacaaattagaaaataatattcacatgtttcttctaattggtaacagattagaggcattttatctttttaaataatttccaaatgtgccccaaagagactgtgaagggagggaacagaggcatggaaaagcaaacgggctttgccaagcgagtgagaggcgggggtcggagggaggccttcctcctgcagcgtgtttccagttgttcggatttttgtgttattttcatcacttttggatattgaaagctagcagggagggggtcttcctggttatacggcccagcttgcaaacataatccttccttgtttttcttttgttggtggtggttgtgtttgttttgttttttgttttgttttgtttttttgagacagagtttggttcttgttgcccagcctggagtgcagtggcacgatcttggctcactgcaacccccgcctcccaggttcaagcgattctcatgcctcagcctcctgagtagctgggattacaggcatgcgccaccatacccggctaattttgcatttttagtagggatgaggtttcaccatgttggccaggctggtgtcgacctcctgacctcaggtgatctgcccacctcggcctcccgaagtgctgggttgacaggcgtgtgccaccgcaccggccgtaatcgttcctggtaagcacatttctgaacacatcaatccgctgcctgcatgccctgtccttggccacgtgttttctacacacgtgcatgcgtgtttgcatatctgcacgcatttttatgtccagtgtacttccaaaaacagatttgagtcatctatgcctgtctctctgtgcagcaactttggaggggtgaagacggaggtcgctgctagtccaggtcgcctggggccctgccctctgacacagggtatttcaagttcctctaaatcctgagggtctcaactgttcctttttcataatggaatttggttttatcaaatactgtttttaacatttagttgcctctgctctggaaaacagttttacagtttcttataaaactaaacgtgcaccttccttatgacccagcaggtgcactattaggcacttatcctagagaaagaaaaacctaggccgggcgcggtggctcactcctgtaatcccagcactttgggaggctgaggcaggcagatagcttgagccacgagagttcaagacctgcctgggcaacatagcaagattccgtctctacaaaaaaatacaaaaattagccgagtgtggtggcgtgcaccttagtcccagctactcaggagactgaggcaggaggatggcttgagcctgggaggcagaggttacagtaagctgggatcatgccactgaactccagcctgggcaacagagcaaggctctgcataaataagtaaataataaaacttaggtttacacaaaaacctgtatgtgaatgttcttagtggcgttgttcgtaagagcccaaaaccagaaacaacccagatgcccttcagtgggtgaaaaagtaaacaagctgtagaccatccacactgtggaaaactacttggcagtgaaaaggaatgaattcttaatacacaacaacaacttaggcgaatctacagggaattacattgagtgaaaaaaagcctgtcccaaaagattacgtgctgtaggattccatttatgtatcactgttgatattacagaattacggagctagagaacaggttagtggttgtccagggttagggatggagagggtgggtgaggttttagaaaggcaacaagagagacccttgactggtgctagatacaggaacgtacatgtgaccaaattgcattgaaccaattccatggacacataaatacaaatgaccacaaggaaaatcggaaatgtggacaagccaggtgggttgtatccatatcctatggtgataacatactacagtttttcaagatactgcctttgaggggaaaccaggtaaggggtacatgagatctctctgtattatttctttttcttttttgtttgttttgttttgtttgtgacagagtctcgctctgtcacccaggctggagtgtagtggtgcagtctcgtctcactgcaacctccgcctcccgggttcaagcaattctcctgcctcagcctcccgagtaagctgggattacaggtgtccgccaccgtgcccagctaatttttgtatttttattagagacggggtttcaccgtgttagccaggatggtctcgatctcctgacctcatgatccacccgccttggcctcccaaagtgctgggattacaggcgtgagccaccgcgcccggccgtattatttctttaaactccatgtgaatacacaattatttcaaaaaagcttactaaaaagtttaaaacaatcaagcaaaataaaaggtggcttcccttaaaagaatcagggctccttggagaaatggctcattccagatctggttgagaagtagggaatggccctggagcatcctgctgtgccagaaagaaagcacagagctaccagggaccagggcagatgccgcagacagaaacaggagcggctccaggcctcccactggccaaatctggaacaattgaagcatctaaaagaatagtgttggtggcagtttatgtgacacatttaatttttaaacatgggtccacgacgatactccagaaaggcagtgggggagaagctcttctttataaaaaatgccaaccagtaaacagagaggatgagggaactggaaaatctctatcccgcaaccaaaaacgtgatattttaattggttcagtcaaggatcatcaactgaagctgcacccctgggggagaggaacaaaatattccgcctcaaggtgtcagcccagggaaactgaagctgcacccctgggaggggaggaacaagatattccacctcaaggtgtcagcccagggatcacttggtcattgtaaagggggaagggacctggacagagacctggtggctcctgctttagccacagactcagacagactcggtagtggaacaactcacagtctgtgcctcctgctggtgatgcaagggagacgtggcacctctgtagtaatattttgacccaaatggaatcggacaaacacaattgggggcattttccaatagaaatagcttgaaatcctcaaaataccaatgtaaagaaagaccaaaaagaagagtagggtttggaagggactctcacatgggaggaggtataagaggatgaccaaaggcaacatatatcctggattgggagagaaattcagccctagaacgtatttttggataatttggtgaaaactgaatatggaccacatatcagtggctgcctgccagtcataatcatgaaaaacacaatcccaaacaccataatcccaagtattgaaatctctcaagtctgaaatccccaaaatcacaatcccaaaaaatcaaaatcccaaaaatataatcctggaaaagatcatttgaaaaattacttaaaaggtattttttgacatttttaaagggggtttctctgagaaacatataaaaacacaacagaacactttttagagcacttttcacaaataggcaatgataacctatatttttgcaagcataaaccccaggtgtactaacaacagtcatatggctgtaacaggtacaagcagactgtattcataggtcagaaatatataaatgcatgtcactgtggttgctaattatgggcactcagctgtataacacctgaaatacagtgacgaacaacttcagtcttttgacaagactgatcaaaagctgtgatggagccagtgtgtggcacacaaccatagtcccagctactcagaaggccacgtcaggaggattgctcgagcccaggatttccaggtcagcctgggcaacataatgagactctatatctttaaaaaaaaaaaaaaattgcaaatacgatgggtcaccatggcctatgaagttgccaaaagagctgagaattttttttttttttttagacagggtctctgtggctcaggctggagtgcatggctcaatcacggcccactgcaacctccacctcccgggatcaagcgatcctcccacttcagcctcctgagtagctgcaaatacaggcacagactaccacgaccatctagtttttgtattttttgtagagaccaggcttcaccgtgttgttcaggctggtcttgatctcctggattcaagcgatcctcccatcttgacctcccaaagcgctggaattacaggcatgagcactgcgcccagtgagagctggagaaattttatctttcacaaacgcagatgttcatttattgaagaaatttcatgaaatttgtggactgtatgtaagtgcatacagaatgaatttccacatacccaaaacaatgaaaaagcctggcacagaagatgggaaaattgatctgggcaacagtggctcatgcctgtaatcctaaaactttcagaggccaaggcaggtggatcacttgagtccaggagttcgagaccagcctaggcatcacagcaagagaccccatctctacaaaaaaaaaaaaaaaaaaaaaaaaaattagcctggtgcagcggcgcatgcctgtggtcccagctactcttgaggatgagatgggaggatcacttgagcccgggaggtccaggctgcagtgagccctgatcaagccattgtactttagccttggtgagagtgagacactgtctcaaaaaagttgtgggggcagggcaggcgtggtggttgacgcctgtaattccaacacttcgggaggccaaggcgggtggattgcttgagctcaggagttcgagaccagcctgggaactgtggtgaaaccccgtctctacaaaaaagttaaaaattagccaggcgtggttgcatgcacctgtggtcccagctactcgggaggctgaggtgggaggatcactggagcccaggaagtcaaggctgcagtgagccatgatcatgccactgcattccagcctggttgacagagttagaccttgtcttggctgggcacagtggctcacgtgtgtaatcccagcacttttggaggctgaggctggaggatcacttgagcacaggagtttgagaccagcgtgggcaacatagtgagatgccatctctataaaataaaaaaagattaaaaaataggaaaaaaagactctctaaaaaaatacaagaaaaagggaaaatctaacaggaaattctcatgttggtagatattgacataggcagtgcttacagtgttgtggtaatgtactttgatggagtcaagtttgcaaaaaatgcataaaactaattagaataatgctgacaatgtaaaattgtgggaaaaaacttttaaaaattttgacatatgaagaagtatattagttcagggctagattatggatagttgcacagagatagtccctaagagctggccaacttccacgatcattatatttttgagttttgcatcatggcgcatagctgcttttttccttttaggatgtgcctctccatagagaagaagttcacattccttttctgtgtgacgctgctcttttagaaattcttccgtgattcagggttcgccaacatgagttatttcccattaaatttccccagcttctgtgccatgcttctttattgttttgggtacttggaaatccattctgcattcgctcaggtacagacctcagatttggtggaagcaatactgatgatggaaccgcagtactatgtatcttaccctaccatgtgcatagctgtttttcatccagtaggtaacttcactggcttcttcacacaaatgtggctcttctcattaaaagctcctggaatgtcagccaggcacagtggctcacgcctgtaatcccagcacttcgggaggccaaggcgggggaatccctgaggttagaagttcgagaccagcctggccaacatagtgaaacacccatctctactaaaaatacaaaaattagctgggcatggtggtgtgcacccataatcccaactacttgggaagctgaggcaagagaatcccttgaacctgagaggcagaggttgcagtgagccaagatcgcaccactgcactccagccttggggacagagtgagcctccatctcaaaaaaaaaaaagcttctggaatgtcatcagttagatggaatgccagtgcagacaaatgatgcagttttattttttatttattttttatttttttgggacagagtctcgctcttgtcacccaggctggagtgcagtggcatgatctcatctcactgcaacctctgcctccccggttcaagtgattcttctgcctcggcctcctgagtagctgggattacaggtgcccaccaccacacccagctaattttttgtattttattttagtagaaatggagtttcaccgtgttggccaggctggtctcgagctcccaacctcaagtgattcaccccggcctcccaaagtgctgggattacaggcgtgagccaccctgccgggccaaatgatgcacttttaaactgaagtttcatccttgccgtatcacgtggccaatccattcatctgacttttttaccaaatgcattgagctgaatggaaaaaacaaactttattggtaatatcctgaaattcactttcagaagccttgatggcaccaattccaaatctgtccttatggtttgggattcaagtgaaacctatttcctcctgcaaagtccatcaaatcttaaataagtttttatagtaaagtgctttacttttttcagcatttgggattatggtgtttggaattgtgtctttcaggattatgatccaaacccatgataggtaaaaatgtattaattttaagttctttggctataataatgtgggtcttcaaaatgtgggcttgcaacttgagagactcacacagtggcgtctgtctgagggagcaaaggagcaccagattctggattttttaactgtcatgaaatatacataatataaaatttgtcatcctaatctttttttttttttttttttttttttttttttgagatggagtcttgctctgtcgccaggctggagtgcagtggcgcgaccttggctcactgcaacctttgcctcctgggttcaagtgattcccctacctcagcctactgagtagctggaactacaggcatgtgccaccacacccagctaagtttttgtattttagtagagatggggtttcaccatgttggccaggctggtctcagccaggcgcagtgtctcacgcctgtaatgctggcactttgggaggccaaggtgggtggatcacgtggtcaggacatcttagccaattttaagtgggctgttcagtggtgctcagtacattgacattgctgcgcaaccatcacgaccatccatctccagaacttttccattaccccaaactgaaactttttacctattaaatacaaactcccacttcccctggcccccaccattctactctccttctctatgaaatgacgactcccgactcccggcacctcatgtgagtggaatcttatagtatgtgtcttttgtgcctgacttacttcactagcagagtgtcctcaaggctcatcatgtcgtagcagatattagaatttctgtccctgaatattagaatatgcagcctttaagaaggctgagtactattccatcgtgtggatagagcacattttgcttatctaaacttttgtcaatgaacacttctgtttcttccacattttagctattgtgaataatgctgctgtgaacgtggacatacaaatgtctatttcagtccctgctttcgattcttttgggtatatacctagaagtgggattgctggactatacactaattccacgctgaaccgtcataccggtttttcagattctgaacgttttattcatttaaaatattgttgggccaggtgcaggggctcacacctgtaatcccagcactttgggaggctgacagggaacacatgaggtcagttcaagaccagcctgagcaacatgatgaaacttcatctttgctaaaaataaaaaatcagccgggcatggtggtgcacgcctgtaatcccagctaccagggaggcagagacacgagaatcacttcaacccaggaggcagaggtcccagtgagccaagattgcaccactgcaatccagcctgggtgacacagcaacactctatagcaaaaataaattaaattaaaatgttggctgacttgatgaaatctttttttcctttttttttttttttttttagagaaacagggtcttgctctgttgcccaggctggagtgcagtgccacaaacataggtcactgccgcttcccgctgctgggctcaagcgatccccctgcgtcagcctccccagtagctgggactacaggcgtgcaccaccatacccagctaattttttttaatttttatagaaacagggtctcatattgaccaggctgatttcaaactcttggcttcgagtgatcttgccgtcttagcctccccaagtgctgggatgacaggtgtgagcccacctggccctaaaagccctttctaaaggcctccaaacatcctagtgcgtaaggactagatccttacttcctagagatgtaaggactagaggaaggaggctagtcctaggagcagactagccccacctccccagcgggggagccagcaggtaggctgctgggcaaggacttcactgcaaggagggacagggtgggccggggggacttcccagttatgtcaggtttcaaaatatatttggggaataaaaatagggtgcttggggccaggtgcggtggctcacgcctgtaatcccagcactttgggaggccgagggaggcggatcatgaggtcaggagattgagactatcctgactaacagggtgaaaccccatctctactaaaaaaatacaaaaaaattagctgggcgtggtggcgagcgcctgtagtcccagctgctcgggaggctgaggcaggagaatggcatgaacccaggaggaggaggttgcggtgagccgagatcacaccactgcactccagcctgggcgacagagcgagactccgcctcaaaaaaaaaaagaaaagaaatatggtgcttggttcttaattttgcagcattcaggacattaaataagtcatttgctgtcaccatcctttcaaaaaaaggacattttatcatagggaggccgtaacatcagaattgccctacagattcaaaactggctttctgagaacctcactatatggttttttattgtttctcagaggatttggtgatatctttgccaccaagtgacacttgaaagcagctgggctctccaggatcagctagagaatttgaggcccatttcaatttttatcaagaatttgaggctgggcgcagtggctcacacctgtaagcccagcactgtgggaggctgagacaggtggatcacctgaggtcaggagttcgagaccagcttaaccaatatggtgaaaccccgtctctactaaaaatacaaaaattacccaagcatggtggcatgtgcctgtaatcccagctacccaggaggctaagacaggagaattggttgaacccgggaggcagaggttccagtgagccgagatcaggccactgcactccagcctgagcaatagagcaagactccatctcaaaaaacaataaaaaagaatctcaagatggtaagagcagaaccgagcatgggccccttctgagcactgggcctttgcaaccgtagagatccacacccatgcagccagcgttggactaggagacccctgaggccccctccgtgcccctcttctaaggttcctttctcaccaagaagctcagcagagagttttgattttgcattatcaaagtcagtgacattgagcaagttaaactctgtgtcgatggtagaaaataaaacatctgaccagtttctgcctcctgatcccattagtgataggtttggtgattttaatgaaagaatttcacttagcttgttaaataataatgctttccttactctggagaattaatttatgtattcatgatgaatcattctcatcagcttcccagctacacagccaaacttaggggggaaaaacacctagtgggtgtatagatttgactctgatatttttattgtttttcaggttaagattagttgaggccggatgcagtggctcacacctgcaatcccagcactttgggtggccgaggtgggcagatcagttgagatcaggagttcaagatcagcctgcccaacatggtgaaacctcgtctctactaaaaatacaaaaaagattagccagacgtggtgtggtgcacacccattgtcccaactacttgggaggctgaggcaggagaatcgcttaagcccaggaagcggaggctgcagtgagccgagatcgtgtcactgcactccaccctgggcaacacagtaagattccctctcaagaaaaaaaaaaaaaaaaattagttgagaaagaaaacccaactgttgtgcatttgttggattttctctggaaacgccatccagtctgtaataaaatttcagttgtcattaccctggatggaattcatcttggctggagtgagtggcttcatgcagggcaaccccactgcaaagaatgtgagcatcagctaggctgacacaggggtccgcagacccaggcccctcattccatcagtttctttcagcatgtttccatgttttcatattttgaaaaaagtcaaaatccaaattgattttcaatgtgtttccctttggttattccccactcccatgcctgtcctctcttaaaatctctgttgttggtactgtttgtttttggctgttggaactgttgtgatcccccaccacaagcagattaaaaggtataccacattaagaagactccttattgttccaaagcaatggtcctatgtctttaaacaataatattaccacaggccgcagttcttaaagccacttggcagtttttattggaagcctacttggagttctctgcagctttttctgaatgtgtcgccgtgtcatagcctgcgaccttctctttctcaggtttgacagccacttagccagcaaatccctgagaagccaccggcctgaactgggccctctgcagtcactccggcctgtccccgcctcttccgtgtgagaagagccttggctgttcctctccctggtgtttaaagggcgtcggtgcacgtacagcgagggcttacatccactttacgggatccggagcggaggaaaagggccatttctcttcccttatctgtttatgatgcgatatgttccaaagccgatcacatcagccgctgttatggtgaacggaattcactgtgatggcggctgcaccagcagagccgccgtgggcttcatgccacgttacgcggagtctaggacggcctcaccccgctggctcgggctccctctcactgggtacacatttatcgggatttatgctttaaaacagtagttcacattttttctaatggtgaagtacagaaacttccattctgtgtgtgactagcatggcttagctatgtttctgtgcaaacatactcacacacagtttccaaatgaagtcacaaacttcccttataaaacttcctttgaggctgggcccggtggctcatgcctataatcccagcaatttgggaggctgaggcaggcagatctcttgaggccaggatttcgtgactagcctggccaacatggtgaaaccccgtctctactaaaaatacaaaaattaggccgggcgcggtggctcacgcctgtaatcccagcactttgggaggccaaggcgggcggatcacaaggtcaggagatcgagaccatcctggctaacacggtgaaaccctgtttctactaaaaatacaaaaaattagccgggcgtggtggcgggtgcctgtggtccgagccactcaggaggcagaggcaaggagaatggcgtgaacccgggaggcagagcttgcattgaggcgagatcatgccactgcactccagcctgggcgacagagcgagactccatctcaaaaaaaaaaaaaaaaaaaagttagctgggtgtggtggctcatgcctgtaatcccagctactcaggagactgaggcaggagaatcacttgaacccgggatgcagaggttgcagtgagctgagatcgcgtcattgcactccagcctgggcgacagagtgagagactgttaaaaaaaaaaaaaaaagaaagaaagaaagaaaacttcctttgagcagaataataaaggtgcctgtgttaaatgccgagtgggtaaaacacgtctgcaagtggagaatggcaggaaggggctcagagacacaatgagactttgtgagttaagggggtgtcactggcgatttttcctgtaaacgtcccgtgttttgttgtgttgttttacaacagattagaaaatggtggggaaatactaaaaataaaaatatgtccggctgcttctggaacattctggatgttttgcctttcgctaatagtgtaacttttttttcaaaagtcattgtcttaaaagacttcaaaattgctttctgttctcccaccgcaagcccccgccccacctcttggctctgcctatcccctcccctccggggtttctgcccaccccccacccccaggcctggcctcctgggtgccacatctccagggcccgacccattaatggcctgcattctgaccgtgactcccagaagactcagccccctgcacagcgcctcctccctgctccagacagcacatgtgtcgtggaggggtctccctcaccaaaaccagcacctctgtcccgttccatcctccggcctcacctccgcccactgcctcccagaaaaaggaaaaatctctacaccgaggtcactggtcagtcaccccgggtgccaagctctgctgtttctaaaggcatggtcccacccattggtcacaagccctgagcacccagtttggggcatgttagcccccaagggggcagctgggctggctggtcctcattttgttcacagcctgtgcagtctgaccctgctgggccactccccgccccccacctcagcacaggctccatctttttctcctgggccccttgtttgtttgtctttcttttttcttttcttttcttttcttttttttctttcttttctctttttcctttctttcctttctttctttcttttcttcttttttttccccctgagacagagtcttgctgtgttgtccagagccggagtgcaatggcgtggtctcggctcacagtaacctccacctcctgggttcaagcagttctcctgcctcagcctcccaagtagctgggattataggcacccaccaccacacctggctaaatttttgtatttagtagagttggggtttcaccatgttggtcaggctggtctcgaactcctgacctcgtggtctgccaacctcggcctcccaaagtgctgagattacaggcgtgagcgacatgcccagcctctcctgggccccttctaggcaccccgccatcctgtctggctcctgtccccaccctgccctgtgcgtttaccaagggctgacccaggcattgagccacatgcacaaccgccttacgtccttactatgtccctgagatgtggagggttttatcccctttttgcgggtagggaaattgaatattcaaacccaggcctgcagcaatgtgaaaccttaggtacttcccacttgcatttaggtggggggccttgggcagtgggtctgccccaggagccccgcaaggcgggaggcctgtgtaaaggcctgcaggaagaggctgagggcccgctccagcagccggggcgctggtagggccaggcctgttggctgctgtgagagatacgccaccaggccaggctgacatgggcagttccagtttcccaaggcagtccagcctccagcactccatcctgttccatccccagtgccctctgactgcacggggctgagaagtcccccagcggtgctcctagacaggtggagacctcaatcctgcagcctcatcaaatgactccccaacaggggtggatcctgcccctcgaccagcacctgtgctgtctgcccctcacaaaatccttgtcccttctcagattccttgggggcacagggctgtgagggtcaggaccaccatcagaatcccttacaaagccacagccctctggcctcttagagaatccaacttgggttacaaagacaagcgtgcacaggccaggcgcggtggctcatgcctgtaatgccagcactttgggaggccaaggtgggtggatcacaagggcaggaggtcaagtctagcctggccaacatggtgaaaccccgtctctaccaaaaatacaaaaattagctgggcatggtgatgcgtgcctgtaatcccagctactcgggaggctgaggcaggcaggagaatcgcttgaaccgggacccgggaggcggaggtagcagtgagcccaagttcatgccactgcactgcagcctgggctacagagcgagactctgtctcaaggaaaaaaaaaaggactagcgtgcacagagccctcgaggtaccagagcagagctgtggatgcccgtctaagcctgtgcccatagctctgactggatttcaccaactccactctggcaggttagcatcaggagagacactgtcctggctgctgggtgggaagataaagctgagttccttctgtctgtctcggtgagagaaggcacggccctcacccagggcagcagagatcagggctgactttccaagccagcaagacatgcattcaggctacctacaaggaaaagcagttagattcgagcaaagtggtgaattggtctgaatggaaaaatccaaaacatcccactttaagaaccctgcatgcacacagtcttgcgtcaacttcagttttaacacgatagccaggtaagggggaaagatgggcggagcgggggaccaaggacagagaggaagacaaaggctctgtgagctgtgcctgctgtaacaaaatacacaacagaaagtattcctcacacttctgaggaatgggaagtccaaggtcaaggtgttggctgattcatttctggtgaggggcctcttcctggcttatagacagatgcctcttgcagtgtcctcatgtggaggagagaggagaggggcatctctcgtgtctttttttttttttttttttttttgagacacagtctcgctctgtcacccaggctgcagtgcagtggcgtgaactcggctcactgcaacctccgcctcccgggttcacaccattctcccgcgttcacgccattctcccgcgttcacgccattctcccacctcagcctcccgagtagctgggactacaggcgcccgccaccatgcccggctgattttgtttttgtatttttagtagagacggggtttcaccatgttagccagggtggtctcgatctcctgacctcatgatccaccctcctcggcctcccaaagtgctgggattacaggcgtgagccatcgtgcccggcccctcttgtgcctcttcttataagagtgagaatcccattcatgggagtctactctcctgacctaatcacctcccagaggtcctgtcaccaaacaccatcacacagggggttagggcttcagcgactgactttccggagcacacacacaccagtgctcctgttgcccctcccagggacaccttgcattgcagcaaatcactgttttctggctgcccttggctggctggctggcagcctttggggccctaggcatcaggatgtctgctctgtttgtttgccaatttcaaagcacataccggaatcagtgtggctggagctggagaggaccttggttttagaactttgattgaagcctaaggaccgttggtccatctgcagagcagcagtgaccaagcctctcttggcctttcctagcatgtcatccaagcctgagtgggaagcggatgtccatatgcagctcaccagagccggcctaaggagggttgatgtgcaggcactgcggcagcgcacagggctcaggacccctgggcgggcacctgtgtgccacccgggctgtcgtgtgcgtgactcggctagcccctgccctctgtgtgatgggcaccacacttcttccagccttgtggcatcccaagtaggcagtgaaaagcttcgagaagggtgggctctgggggccatgctgggattccaggaacccgagaattcacgtaagccaattctttcattctgggctcccatgaatgcatttggagaaggtggctggagtcacgcacagccagctggtgggcagggctctctgcaggccatgggctcattttcccacctgcgtaagtcacggtgctggtggtagcaggatggggtctgcaggtctcgcaggagtaggtcaagaggaccaggcaaggtctggcttcctgatggggacccaggagagagaagccaagaacccctgctgcctccttacccaactgcatatcacagagtgtgctgggccccgtggaggtggctgcagtctacaagggggtggctgccctggcctatggtgcattttacagatgtgtcaacgtgggaagctgggccaaggccatcctgtgcggaggctcaatgagagagcaccctgggtagggtctggacctgctgtgtgggcctcttgctggcaggcagctctctgttcccgaggttgcagcagctgctttctgtcctctctttacccgttcccccccgccccacccccgccagcggattctcctgcggaacctcaaacttcagaggcagcaggccttgaatcattgagcctccagagggaaaactgaagcctgggagagggtggctgcccagggccccacagccaaccatgtccttgcccagagaggcctgggtccctcctcctctgtgctgggtgcttcctgagtgcttggcacatctagacaccaaacagacccttgggtctgagctgactgggttcactagctagcctcacgcatcctccctgccgggctgctgtgggctgctgtcctggtcccacatctcctttttgcgcgctttcatgattcctcagacagtctccataggttgcctcaagactctggaagaatgaggttgcatatgcactgtgacttgtatccaggaatattatcctactcaggctggtcaggtactcaacaggcagggagcgctagtggcagcaaagccacgagtgccccaagtctcaacccgaacctcaggcgaaggtttggggacaagactaagctcagctcccagtaactggccctccccttgcctcaatcccttctggaacaacacaggctgtgccagcctgcacagggcagtgcagaatcaggaaaacctggctggggccagagtacccgggcacatcctcgctctcctgggccgcctggggcctgcacctgccgggggatctgccagcccccatacctgcggccgggcacatttaactgtgacttgcagaagtaataagcctaatatggttgactttatttaattaataatgatcctcttctgttcctctgcgctcataaaacaccctgcaggttggcaaaaacactcataatattgatcagaagtcaggcgggatatttattttgtctttgccccactagcataaatccttgtccactgcctcctcctccccgcatgcgggatttacagtggccagcttcttaaaagcattcagtaattaaggaataaatatccattggcctttgtgggctgtgctccgtccctccgcctgaccccctagcaacgcagctcagggagaaggcatgcatgcaagggggaggcagctgtcagcgcccgctcgcagtgggccggggtcttcccctaccgagaaaggaagcccctctctcttcctcacgtattgttccagccccctcttccatgcctcccctcccagttcctgttttgcttgaggcaggaagcactctggaaattccttgctgctagccctcttttctctccttcctctgcccttcctctcctccttgtcagtttcaacaccaggcgggcgggtcccctccagtgtctgctcctcaccctgagggtgttcctccacgccagcccgctctgctacagaatctccttgaaaatcactgccaaactcctctcccacctgttggcgggggcagggcagctgtttccaaaggaaagactgtgacaagtggcgggcacacagacgcaaattcttcttttggccttttcgcactggaagagagagggggttccaataaaaatgagcacattagacttgacctggagtgcactttcgggaaggggtgttgctcagtgttttgtagacgtgctcagaaagccacatttgtgagatttgaaggctgaggatgaaaccaccaagagactgctttacagccccccagagcgccccagccctgccacacacagcggcccctgtgaggactgaggtggacgtctggctgcccgctctcttgtctgtgtcccgttcatctcccagaccccgccacaagacagtgctgaaaggcagtcagaagctttgtggttatttgcttaaaactttcttttctgggaatccaacccattaaccttattaccccttgacaatgtgctgacccttccctgccaggaccaaaacacagctgatggtggctgtgtgagacctcatctttgcagctctcaaatgcatgaggaacagagaatggggcattgcaggaagacagcatttctctctgaaggtagttgtgtgtaggtgtgactctccccgcgctctccaggtgtccccagaggtcttggtctatgctttgctcatcactgacaaggatttgccagtgcatagatgacagtgccaccagcagtgaccaagctcacctctgggactcagctgcctggtcagcctgaccccgccctgccgagcacctcattcccgggcagcacttctgttttgggtactggtatctatatgacttgccttttccttttagtgatctcctttctcttcattctaaaattccatgaattattattcatctttgtaattattataaatatttataataataaattatagatagttttgatagggaagaagaggaggaaggaaaaactgagatgatctagatccgtgcatcctctgtaatggcagaagtgttctcgatcagcagccttggaaatgtcctagtcagcggcagcgtcggtgctctggaccggcagccatgggaatgtcctagtcggcagcagtgtcggtgttctagaccggcagccgtgggaacgtcctagtcggcggcagcgtcggtgctctggaccggcagccgtggaaacgttctggatccgagcatcccagggtagcagctgccaaccacatacttatgtaaagcactggaaatgtgtctaaaggaactgtgtttttaatgttattttgtttcaattcacgtcaacacccacgggcagcttacagctgccccattggggggcacacctctagattcttcctctgaagcaaaccctacctaacccttcgtcagagaccagaaccaagtgttaagatggccaaagggagagcatgagaaaatgatgctgtggatccacctagactctcaaagcccagagagtctggttgtacagatgggaagatgtttcctaatttgggaggcatcagatccctgagcaagaggtcagacagtgccagggcagccagtctgtcgggtgtcccagctggggaccctgggcagtgttctgtatcactgaccttctcctctaagatgggggtaagaataggaccttcctcactaggtgttgttagaattaaaccaggtaattgtgtaaaaggttcagcctgggctgggtgcagtgactcacacctgtaatcccagcactttgggaggccaaggtgggaggattgcttgaggccaggagttcaagaccaacctgggcaaactggtgaacccactgcactccaacctgggcaacagagaaagaccctgtctctaaaagaaaagaaaaagacccccttctctacaaaaaaaaaaaaattgaaaattagctgggcgtggtgatgtgcacctgtagttccacctacttgggaggctgaggcaggaggatgacttgagcccgggagttccagactgcagtgagctatgattgcgccactgcactctagtctgggtgataaagccagaccctgtctcaaaaaataaaaaagcctcaagtcagtggttggcacattgcaaatacttgataagcattggctgtgaacattactgatacttttcctagtctgcataacagagtttgtctaatagtgactctacatttatataaatatatgtccatgatcaatcacctaaaacccaccatttggctcatgtagcattgtaaataaagatggagaaattatgcagaaaggcctttgtttattattgtcttagtcctctggggctgctataacaaaataccttaaatggggtaatttataaacaaaagaagtgtcttgctcacggttctggaggctggaaagtccaagatagaggcaccggcagattcggtgtctggttagggttcggtctctgcttcatggagaatacctcattgctacgtcctcacgtgatagaagaggcaaaccagccccctcgggcctcttttataagagcactaaatcccatttatgagggcagggccatcatcacctagtcacctcccaaaggctctacctcttaataacatcaccttggggagttaggatttcagcaaatggatttggggtgacacaaacacacagcagtgataaaagagcagactttgttgataaatccgtgcagggaaggcaccctcactgcagtgtttccagtcactgggatgagaaagggccgatcccagctgagcgtggtagtgcatgcctataggcccagctactcaggaggctgaggtgggaggattgcttgaatcccaacctggacaatatggcaagacccctatctctacaaaaaaaaaaattatgcaggcatggtggcacacgcctgtagttgcaactgctcaaggggctgaggtaggaggatcacttgagcccaaagcaatccagcctgctcaaacccagcctgggcagtatagcaagaccctgtcttaaaaaaaaaaagagagagaagaagactgggcactgtgtctcaacacttgtaatcccagcacaaagcaggtggatcacttgagtccaggagtttgagaccagcctgggcaacatggtgcaaccccgtctctacaaaaagtacaaaaaattagccaagcatggtggtatacacctgtattccaagctacttgggaggctgagttgagaggactgcttgagcccaggagttcgaggctgcagtgagccctggtcaagccactgcgctccagcctaggcaacagtgcgactctatctcaaaaaaaaaaaaaaaaaagaaagggtccatcccggtatcaggcaatgtgaagtgctgggaacacacagacctgcccatggcatcccccagtcacttgaggacagataaaccatcacagttggttgttgccttttgattggagtcatcggcagtgttgtcacgcgactggtcttgctcaggtgcattctccagtgggcactgcagtgacggctcccacgtggtcttccctcgggcttttaccccaggacctgtaacaccaagacagagcccggtgcagcctgcatgtgatgattcgcccccaccctgggtccttgccacagagattgaaataaaagctctctggaggccaggcgtggtggctcacacctgtaatcccagcactttgggaggccgaggaggacagatcacctgaggtccatagtttgagaccagcctggccaacatggcaaaagcccatctctactaaaaatacaaaaattagccggacgtggtggcacgtgcctgtaatcccagctattcaggaggctgaggcaggagaatcgcttgaacccaggaagtggaggttgcagtgagccaagattgtgccactgcactccaccctgggtggcacagcgacattccatctcgaaaaaaaaaaaggaaaacgaaagaaaagctctctctccccacaaccctgacttgcacattttcttctgtaaacataaatgcttctctccatcccccgttccctccctcctgatctgttcttcactctgccttggttctgtcgtcgctgggttggctgtcttgctgtctgtgcagcacctgctttctgttcacaggtgctgggagttgtatgacgctgggcaaactgggagcagcgtgggcatcccggcccaagctcaggggctcaggaggcaggaggcggcactcgcattcacacgcacacgcacagaacgctctcccgctctctcagtctggtccctgggcaggttgaaggcagctcagcatccatctttttccagagaagagaactttggccctgctaggttgctggccggccaccttatggccccaggcctgtcctgaaggcgggggccagattgggagcccccctgcttccgctctgcagccctgtctggctgaatggtgtaaaattccctaagtctttccttccttcttgctgtgtttcaaagaaggaaaagccgggtctgtcagttctaggctctccactgtttttccccttttgaaacttgcaataaaatctacctgtctcttctttcctgcagcctttcttttttcccacgatttcccaaaatacggccaccactctgccgtcacgtgtgcatcttgttccacattagatatggagtttgttttgtttgtttttgagacggagtctcgctcttttgcccaggctggagtgcagtggtgcaatctcaactcactgcaacctccgcctcccgggttcaagcaattctctgcctcagcccccccgagtagctgggattacaggcatccgccaccatgcccggctaatttttgtatttttagtagagatggggttttaccatgttggccaggctggtgtcgaactcctgacctcgtgatccacccacttcggcctcccaaagtgctgggattacagtcatgagccaccatgcccggctggagtttgttttttaaaatgtgtacatgcttgagggtgttaccaggaatgatcaataaagtcagttactgtcatccttaagcccacactaagtgctccggttacatggagattacaccttgccagctgagtcatgcagtggatttggcatggcaggcactaagtatgcgggtagcaggtggggagtgtccaagagaattgtctttgggatggacacagggaagccaccttggccaagtcaccacccctcaaggtcaggtgcggcaaagcccgtcaggcagcaatgctagagtgtctgtctccgagctggcagaccccgaaaaatccagagggttcacggctcctgcaacctacccagtgattcctatgtcctgtgctcagtgcctggctgtccctgtggatggcttcctgtcatggcccagagagaggtaaagagccacctttacctcttcttttaggcaggaagagaagcaaatataaaatacgatggcgcctgaaatgtaccttttctttttattttggggattgggtcagtgcctttcttctgatgagtcgcccattccctcattttccctcactctcctgcggctgatttatttaaaggtgtgtcagcaccacatcaaatgaggaactgggccccctcctttctgctgacggccggccgcgccaataattcattttttagctcattagctaacggaggctgtgaacggtgatcctcccggggattggaatgaggggaggtgatctactgccggctgcctgctcttgaactggccttccttggggaaaatgaaaggctcagccaagacaagccagggatcccagaagtagaattgcggcctccgagtgaccatttgagtctgtgtgctttgacatcatggcttcttagggcaaatgcctctagacggaatagtctcatcgagaagaagccattgtcagcgtgtcccttggtcatatgtgacttgcgtatggagacgctagtgagaaagatgaaggatgctatccagagtatgtgtcagctcaggctgccaaaataaagtattacacttgggtggcttaagtgcgggacattcacgtctcacagttctggaggctggaagtctggagtcagggtgcccgcagggttggttctggtgagacctctctccctggctgacagatggtgccttctccctgtgtcctgcctttcctccgggtgtgctcagagggagagagacatcaccagtgtctcgtcctcttatacgggcacctggcttattgaattagggctctatctttatagcatcatttaaccttaattctcttcctgaagaccccatctccacatacagcaacattgagggttaaagcttcagcatgtgaattttatgggatacgactcagcctctaacatccaagaagcccttaaacatctcaaggctatgggcaggagccaaccagatgttgctcctgcaactctgacagctatgaggtcatttaaaccagccagactccttcttaccccagagtctcaggatcctctgcaccctcgggggagctcacaagatgccagcaggcttggcaagacctctggccaagagcatcccccctaccatgctgagcatgaggagttgcgtgaagctcgtatgtacacacagccgtgatttagaagcctcccgtgcccagcaggccttcggtacccgcggccccgtgccaccagcacttcccccacacgtgccgcttccacgggtgagctcctgtgtgctcacataacattgaattatcagagaggttgttttcttcagtcgtgacagccgctgtttgcaggggaaccactgtggccatggtgtcatccaaatgcgtgatcccaaatcccaaaacagccctgccttgtgtagatgtcactgtcctcatttgacagatgaggaaaagagggtccaagaagttattagaaaggcgaacgtctacaccactaagtcgagaaaaggcacataagccacagtctctctaatgcttaagagtgcagcctgtgagcttagtgttggtggggagattggcttttccctgcctttgggcattgcagaaagtacagggagctaagctttccccctggtatctggatgggagcatccacaggaggtggccttcaagtcacagcaggtggctgacatgcattagtttgctgaagtagcaccaaaaaacccagtgcccttgtctgagtcctgttttcatactagtgaaatttcagctgctaacaagaatcacgtctgatgcagacacaaagcccagtggctgccccaactccctggccacctcctactgtccgagaaaacactgaaatatagcagtcccaaaggactcagaagtcagcattgaaagcttctgtttttgttttgttttgtttagacagagtctcgctctgtcacccaggctggagtgcagtggcgcaatcttggctcactgcaacctctgcctgctggatccaagcgattctcctgcctcagcctcctgagtagctaggactacaggtgtgtgccaccatgccaggctgatttttgtatttttagtagagacgggttttcactatgttggccaggctggtctcaaactccagacctcaggtggcccgcccagcctcggcctcccggagtgtgaggattacaggcatgagccactgcacctggctgcaaacttttgtttttttgtttgtgaaatggagtttcactcttgttacccaggctggagtgcaatggcgcaatcttggctcactgcatcctccaccctccacaaggttcaagcaattctcctatctcagcctcccttttgtgggtttcgggcccacaaaacctggacctaccttttattacatagtttaaacaatgctgattttttttccataagttattggggtacaggtggtatttggttaattaagttcttttttttttgagagagagttttgctctgtcgcccacgctggagtgcagtgacgcagtcttggctcactgcaacctctgcctcctggattcaagcaattctcctgcatcagcctcctgagtagctgggattacaggcacctgccaccacaccggctaatttttgtatttttagtagagacagggtttcaccatgttggccaggctggtctcaaactcctgacctcaagagaaccacccaccacggcctcccaaagtgctgagattacaggcataagccaccacggccagccatgagtaaattctttagtggtgatttgtgagatcttggtgcacccatcacccgagcactatatactgcaccctatttgtagtcttttatccctcgcccccctcccactcttccccccaagtccccaaagtccgttgtatcattcttacaccttttatgtccccatagcttagctcccacgtatcagtgagaacatgcgatgtttggctttccattcttgagttactttccttagaataatagtctccagtctcattggaggtccctgcaaatgctgttaacccattcctttttatggctgtgttgtattccgtcgtatatgtatatacaccacagtttctttatccacttgttgattgatggccattggggtaggttccacaattttgcagttgtgaattgtgctgctataaacgtgtgtgtaagtatctttttcaaataatgacttcttttcctctgagtgggtacagtagtgtgattgctggatcaaatggcagttctactttcagttctttaaggaatctccacactgttttccatagcggctgtactagtttacattcccaccagcagcgtagaagtgttccctgtacaccacatccacgccaacatctaccgtttttagattttttgattatggccattcttgaaggatgaaggtggtatcaacaatgctgatttttaaaagtaaagaacagctcattcaaatgtgtatcagcttgtcagttcggatgaggttgcctatgaggtgagatgtgaggacagagaatcactccagcagttcccggggagaacatactgacacagcgaagggttcaggagccgcaggttcgtactcattctttggctggggtgtgggaatattaaaaagaaattgaatacttgcagttagcactgtagctactagttcagttatgtggtttatccctgggtgatttggcaatgactattaaagtcaatcggagcggaatcaaatagttgtgggattttaatgtctaccaaaaaatgagagttagcaaattggaactggaaaatctggacgcatccttcaccgtcatcccttttcatttaattgacgttttgctccttctcttttgtgatttatgaaatgcatcaacaaacgtttaatacattttaaataaggcctttaaaatagtatcagaactgcttctttttgtctgtctcctgaacccgtatttcccagacattgtcagtgcttttgtgcttgtgtttttgcccgagtggggtgcaggggctgcctccgctgcatttgtgggggccggtgtcagttctcagctgtagccaagtgtttgtcctggaaatctccaaatgaaaagagtcgggggtcactctggggtcactcacatgtaccaggaagtgaagcaaaactaatccagatttactcctggaagaatttgtttgccttagtatttaaaaacagattagggctaacccgacactagatcactaggtgcaatgtaaacacgggtaaaaggtgtaaacaaggcctttcctctgtacttcggaagcagaaatgtcatgggtaatgagttttctttctagactttcgcggaagccctgagtgatttctccgtgtcatttgtaactgtgtactctgattattcccctggagaaacctgaattttggagagggcgattgtgaatcagtgcgttattaaagtctctatgggtaactgcagtcccttcttacatgtagggcttttctttcttttctttttctttttttttttttttttttcgagatggagtctcattctgttacccaggctggagtgcagtggcgcaatctcagctcactgcaacctctgcctcccgggttcaagccattctcctacctcggcttcccgagtagctgggattacaggcgcctgccaccacaccggctaatttttgtatttttagtagagacagggtttcaccatgttggccaagctggtctcgaactcctgacctcaggtgatccacccacctcggcctcccaaagtgctgggattacaggcatgagccactgcgcccagcctcttttctttgtcatcctcatcaaaaaggcaggcagggagcacttccctggctgggcttggctcctgggatccttgtaaaatttcaagagctacttgtaaaatctcacactgttctttgtaaatttcttgtcccccaccaccctacctttttttttcccctctagcggtgctgcagagtcttgagttttcagtatctgtcacgctcttttttgagaaaccagaaaccatcatcagtagccacaaagtacaggagctgctcgcctggggtccttcctttgggtcaacataaacatgccttactgttggtttcctcttctatttgttaagcttctcatctcatcctgtcctctccttcttagccctccccacagatgtgtagcagggtccccatcctctgtagaccccccaggaggagaccatgtattacactggccaggtcgggcagccccatctcagccaggttgtgatgctggggccggggcgggcaggcatcagcatcatccactctccacacctccgaccccatccaccccctccccagctttgtcctctcctctgcctctgggctcagctctggcttctgggagctacctgcctgtttcccaggccctggaacagtttcccccaaaaaactcagccattcctgacattctgtcctttccacttaagccttccccaagtatctggagattccaaaagctgcatctccctgctaaacctcctcattggagtctccaccctctcctgcgtgagtctgttgccatgttttcctcagctgaaagggtttggagaccctggggagtccacacacaccccctatttcggagtttgaagctaaaagcacatggtcacccccaggtgtggggagcgcaccggctgtcccttccccccacccccggcccagctccagccaagtgtcctatagccctcacttacagtcctgcttacagtaaagcaactctcggccccagagaccatgcttccatcgtgcggtccgtgctctcggccccggagaccgtgcttccatcgtgctggtcccaggcagtagggtggtttcccctgtgcatcggtgtgtgagagccactgatccaaggccatggccttgagccctcacttggtagttttctttccaaggacagcttctacactaaaagtgacagaagcagcaccaaggcagtgtatgagcctgagatcagcggctctcacaccttgggcctattggaatcccctgcagggcttcttaaaacaccccgagaggtttggattcagggggtctggggcgtgacctgagaatctgcatttctgggctgatgctgctggtgaggatactgttttgtgaaggtggataaacgtttcccccagggggctttgtgccgagtgaagacctttgctttctgttatttcacttccctctcggcttctcccgaccacactgggcaggggctggcagcctgtgttctcgggcctgatcgtgactgcacctgtctggtggctctttgcagggaagagaaggaacggtggatccgtgccaagtacgagcagaagctcttcctggccccgctgccctgcacggagctgtccctgggccagcacctgctgcgggccaccgccgacgaggacctgcggacggccatcctgctgctggcacacggctcccgggacgaggtgaacgagacctgcggggagggagacggccgcacggcgctgcatctggcctgccgcaaggggaatgtggtcctggcgcagctcctgatctgggtaggtggtcggcacgcctggcagaggacggggccacaggaggcactctctgctttgttctgcttccgtgggcatctttctggcagaaggctgttgttctcgatctgcaagtggaaacagttcctaatgggaaactctgattgaagagcagagggccttacggagagacagccggtcctccttgtacagtacttgctagagtttctgaaaattgcaactttgtgattgccccttatcaagcagggttggtgctatccctcttttttcatttccatcatcttctggagagaaggcggtgtattaacgggatggcttgtagggtttccccatttccaaacctttggtgtttttattcacttaacacagaaatactggaccctaaactttgaggtctgatgtggcaggagtttgtcaaaggacttctttcgaaccattctgattaatttctactggggaaaagtattatttacattcctattgaagcatgtgtcacaatgcttgaaggagtgaaagagaaggataaagtggttgtgcagagaggccctgcctgtgccacccaggagctacgtctgagaagccacgcccacttaggggctgcctgtggacccctggggcttctgctgaggcaggttcccaccagaggcaggcagaaagctgccggcagggaggctccccagatagggaaggcaagtgtgtgcccagaagtggagacagcacccagaggtgggacacccagctggaggctcttctgtctccacccgcaaggcaggatgggtcagtccagcacagcagcacgttctacagcagcatgggtagagtgcagcaggtttctgcatgtttttgatctgacttttttgttttttgtttttttgagacagagtctcgctctgtcacccaggctggagtgcagtggtgcgatctcagctcactgcaacctccgcctcccaggttcaagcaattctcctgcctcagcctcccaggaagctgggattacaggtgcgcaccaccacgcccagctaatttttgtatttttagtagagacggggcttcaccatgttggtcagtctggtctcgagctcctgacctcgtgatccacccgcctcggcctcccaaagtgctgggagtacaggcatgacccaccacgcccagccttgatctgacttttttgatgggtgcagttggtgaatgagtgagatatagacactacaccaaaatcacacagatactcccttttgctcatgagtcatacatgtgatgtaatgcacattaaataagagttgtgtgtagtgtgctagggctgccataacaaaataccacagacaggggtgcttcaacaacagacatttattttttcacagttctggaggctggaagtacaagatcaaagggccagcaggaatggttcctggcgaggcctctctcacggctggtagacggccgccctctccctatgttctcacagggcctttcctctgcactcgctcctggtagctctctcctttccccccacccccttctttttgggacaaagtcttgctctgtcgtccaggctggagtgcagtggcacaatcatagcccactgtaacctcaaactcctgggctcaagcaatccccccaccctagcctcccaagtaattgggaccacaggcatgccacccccatgaatggcagtttttaaaaaattttgtagacttacgttcttaccatattgcccatgggttttgaactcctgcctttaagcagtcctctcacctcggcctcccaaggtgttgagattacaggtatcagcctcccagcccagccttttcctcttctcatatagatactaaccctattgtgacctcatttaagctaatacaccaccataaaggctctgtctccaaatacagtcacattctaaagtactgggtgtcaggacttaaacatgtgaattgttggtgggagcgggggacacagttataaattacaggccatctttgcttctccaattgagcaaaaattcctttgatggcgctggttccatgctgttgagtggcctcagactcccacacattgtgagttggcagaagtggaagtgaattcactctttttcatgagcaaaaagcttaaaaacgttgtgtactttaacctcatattttcccccttctgatcatcactctaataatcaatcacagatcctaagaaagattctatgtgaggacatacatccgggcactgtttcttccagtgacaattttttttttttttttttttgagacagagtctcactctgtctcccgggctggagtgcagtggcacgatctcggctcactgcaacctctgcctcccgggttcaagcaattctcctgcctcagcctcctgacactagctgggattacaagcgtacaccaccatgcccagataatttctgtatttttagtagagacgaggtttcaccatgttggtcagtctggtctcaaactcctgaccttgtgatccgccctcctcggcctcccaaagtgctgggattccaggcatgagccaccgtgtccggctccagtgacaatttttacaaagtgtgcacagttgaggggagagttctgaattctgttcatgtggtggaatactgtatgacttgcatatgtcatgctttttgaggggtggggagacagggtctcactctgttgcccaggctggagtgcagtggtgtgatgtcggcccacggcagcctctgcctcctaggctcaagcgatcctcccacctcagcctcctgcatagctgggaccacaggcatatgccacgtgcccagctaatttttttaaaatgtgtttttttctagagacagggtctcccagtattgctcaggctagtcttgaactcctgggctgaagtgaaccaccgcacccagcttgtgttgtgcttctgagtaatttttaatgatgtaagaaaatgatcacagtatagtaatcaataaaaaatgaaaaaaatacaaattatttgtacagtcttatctcaattatgtacatatacatgtagattcaaagaaaactcattgaaaggaaatacactaattcacaaaggttatctctaagtagtaagattatgggtgattttttttcttcttgagctgttatgtgttatttgtgtatttcctataatgaaaattctgagatcaaaacaatgattttctttgtgcaattggaaagtcaaaatagaaacagcaaaactaaagttatctttgattccttaatgttgcacaaaggaggggctttcagttgaaaaaaaaagacatgttctttccttaaaagaatccgctggccacgggtgcaggctgtgccaccagcactggatggtcctggcaccccagccagttgtgtagctggccccgctgtccaagcacaagccacatgcaagggctgagagaaagcttccctgccccctccctccatcacatcccccatgatactaatgtgggctcccttacctccgcagtacggagtggacgtcacggcccgagatgcccacgggaacacagctctggcctacgcccggcaggcctccagccaggagtgcatcgacgtgctgctgcagtacggctgccccgacgagcgcttcgtgctcatggccacccctaacctgtccaggagaaacaataaccggaacaacagcagtgggagggtgcccaccatcatctgaggaacagccgtgcccgcctgctcgccgcacctgggacgcggcagcctcgccgcattctcgctcagaagtcgcagcacgtgagtcccgtcgcatcccctccctcttcctggtggccacctccctcccgcccacccactctcaccccaaacaaaatcacaaaacctggacatccctcaaggggcgaagaggcggccgggagactgcagaagtggctccttttcataaactcccctaaaccacacacaggagagagcgacgggcctcggccctttgatgatagcacatggcgcaggacccttgtcctggtggcacaagggatggggacgcgagggggaggggaggcgaggaacaaggagaaggggcaactttccttaactggcagttgagcacatagtacatttcccctctaccaaacggaacacttggattccatctcttctctgaggagctcgacggcataaatcagaagcaagcacagagtttgtcaggtttgaagcccctatgatggtgtgtgtcaaatcagttgtagctaatctgtccagggagaatactggcttcattacacttgtacagccgagttcttcccgcattactgctgtttaatagaacgtgattagtcatcgccgagaagaaagcatattagccgaggaggtagtcacgcggcacgcgccggtgattgccacgatgtgattgcaatactcttagaagcaccatattatcccagacatgttctttcaagcccttggagccctctctaaattcactgtcatcatttagtatctgtttaatttttcagtccaaagagaggaaatcagtcgctgagtattatttgactccggtctccttggtgcaaaaacaaaatgggaaaaataaataagaataactcagaaactcaaaaggaaaccacaaattcagctaataatagcatttcgagtatatttcgtaaactaaggaaatacacaaaaggctgttttttccgactgtaagagatatttgatgtccttttgccgaggtggatgtgttagtctcaggccctcctggaccacgttgcccaagtcacacaggcttctgtgttatgtatttagataagatgtgtgaaaatatatttgaataaaagaagttcat

SEQ ID NO: 36532 - DNA, 137359 bp, Homo sapiens
atttgaggtgttctgaccagaagaagacagagcggatgatcattcattcaccacgttgacaacctcgcctgtgattgacagctggagtggcagaaagccatgagatttggtagttgggtctgaggggcgctcttttttttccttttctttctttctttctttttttttttttaaactgatttttgggggagagaagatctgcttttttttgcccccgctgctgtcttggaaacggagcgcttttatgctcagtgactcgggcgctttgcttcaggtcccgtagaccgaagatctgggaccagtagctcacgttgctggagacgttaagggatttttcgtcgtgcttttttttttttttttttttttttccgggggagtttgaatatttgtttcttttcacactggccttaaagaggatatattagaagttgaagtaggaagggagccagagaggccgatggcgcaaagggtacgtattaaaaaacaattgtggaactcaaatgtgagattaaattgaaacgtggccgaaagacactgctaaaaagtttcctttttttctctctctcttttaaaaaatgaggctcctaaagccgtggcctaagcgagaggatttattcaatgcatttgtagacttatgtatgttacttggagttgttaattaaaggaatctatttatctatagattcctaaccagcagctatataaataaaaatgcaagctcaaacaatcatctgggtttttttttaaaaaagctagatacctaaagctgtaatttgaacattcagagatcagaagtttaaagttatgtttaaactaaaatatgcagctggaaacttctgatatgttattgattatgctcatctttaatatcactagaagtattcagctttttaaaggaaataactttgtcatagtatagccaattttttggtcagaaaacattcatctttttatagtaatttcaatttgtatagacttgtatacaaggcaatattttgcaagtttctcttagataagccctctactaattgaatactaagcacacagttactcactttaaaaatgcaatactaatttccccatattcctttttcaatggaaatgcagtgagagtaaagtgagacaatgacaacccaactgaggtagtttcttaaaagaaagggggtctacaaaaagccttccttgcataatttgtgtcctggccctcaaagccctgtttgcaaaagaaagttactaggctgacacagttttctttactcctttggttcaggcaaatgtcagcgttcttccaaactcttttcacacctctggctttaaggagatgaaagtggcaattcctcctttctttgaaaatcatttcactctcagcgcctccaaatcttgggaaaataactgcctggaatgaaccaattagaaaaacctaaatagctaaatttcacacacacaaaataatgacaatcaatatgaaagtagttttttttttttttttctggaagaggaagatggaaagttgtgcatttgcttttgaatttgctttaaacctggtgagtaacatttgcctccttgacttctagtctggaaacaaagttcataagagtaaataagaaaatagaatattagctgcttcaactatagattttctttaactttgggggtggggaattgcccaattctaaattcagctctgatgttcaggaaaagctaccctcctttgagtttcacttataaggggtcagttagttttgtataatttagcagagtttgtcttggaaagcaaaagaaatgcagtgtcttgtaggactgcctaacctcacgctggcagggaaataaaatgagaagcctgtctaaattcacgtgctttgcgtagctgttcccatcgtaacttttttttttttttttaattccccctgatgtgaaggggctgtgaaactaggcgggtttgctgcagtgtcctggcacgttttattattgtgattttgaatttcttcctccagagacatgcccgtttcaccttctaccctcgggagaatgcttctctttctctctttctttcttctttccttcttgccaaaggagcctgaatttctaaactagttgatagggacacaagttagggcaagatcattcatcccagacgagtctcgctgagaattctgtattttttacttaaagctttaattttaaaataagaaaaactcagctttatagatgcaaggccaccgaattccgggtggaaggacccagctgtattgaccttatataagctcggtgccttgccgttctcccatttgcccgcctggcctcctgaaccttctttctctcctgtttgtcatgcagtacgacgatctaccccattacgggggcatggatggagtaggcatcccctccacgatgtatggggacccgcatgcagccaggtccatgcagccggtccaccacctgaaccacgggcctcctctgcactcgcatcagtacccgcacacagctcataccaacgccatggcccccagcatgggctcctctgtcaatgacgctttaaagagagataaagatgccatttatgggtaggtacaatgggcagcaggttaagtagttgagactcaacgcttccctctttctctgtgcccttggtaagaggaaagtcagagttctctggattggaggtacatctttggtgacttttcattcacatttcatggataatttggggaggtggcctgccatccctgaagccctacatccccatacacactctgtgcacatccagtgccctgctccaccatggcagtgcccgcaagggggtcccagatgagaagaagctggctaaagggcccttgtcccctctcagactccttcagcgggctggagtcctccctcgctcgatttcgcccgagagcgttaggggtttctaaatgcaggcgcctttgtgttgtaacgaaacttttagtttaagggaaaatctcttttaagccactgattgttctgacttgctgagtttactcagcagccttatgctggctctgccactgcacaataaaaccaaagcaggacagttgcaggtcaagcaagggggaacatgttttgcatttagggagtttgaccactgaagtcaaggagaggagcttgctctgaattgttacacacattaagaaacttctagatgttttagcactttgtgctcaaaggcgaaacctgcaggatttagaaataagtaaattcggggtgctcttcctcggaggttgttttctggctgcggtttatactgctttctcctccgccattcgattagaccctgggctagtagaatcctttgaaactcacttgtgcctactgtgtgccgatgaatttgggaacctctttttactttgcagaaacttttatttctatttatttatttttaaaaaatcaggacacactgaccctccctcgctggaaaaaaaaatatatataatctttttattttattttctgatcccttgtgcgatgggcttgtttaattcccaccgttctgtccgcagagttaactacaagtggtttaggctctgggacagaacatttggggaagctttgtaaaggaccccaaactgttaaattcccagctgagctgtgagagctaataaaagacttgagatacctccttgggcattagaagaagcttttctttctttcttcttcttcttcttttttttttttttttcttttttatgggctgagacaagcgacatctaggcccctcgcaatactagctgctttgccacttcgcagagacaaaatgaaaggctctactgcaggaacatttgaaggaactttctttggggggcggtgggggctatcagcgaagggaggggaatgtgcgtggagctgaggaggagcctcccggctctccgagggccttggggttgggatccctaggtgcagcccgttgacagtcggccccacggccatggacgtcctttccccaagttagctgagcgcctgccaccgagatcccccgagcctgggcttcgcgcggccgcctaggaggaacccgcaggaaccagccctccccaactctccgcccggcgcctttctcctccaccggatcctggatgtgcagtggaggggacgagggcttgtcgggtgggaaacttaattcaaaatggctgctggaaacgcttgggttttattcgtagcaaatgttgccaatttctccggccagatacgctaaaccgatcctcagataccgtccatggctcagggcctccgacttcagggctccaggaggaaggggaggtgagcggtcacctgggtctgggggagggggaggaaaaggaaaaaagtagatgacacaatcggagagggggtctgttcctcttgctcctccagctgtttttcttgggcacctttttccattgactggggactaaccattatgttgtttgtgactgttgtattttcttgcagacaccccctcttccctctcttagcactgatttttgagaaatgtgaattagctacttgtaccccccgcgagccgggggtggcgggcggggacgtctgctcgtcagagtcattcaatgaagatatagccgtgttcgccaaacaggtcagcaaaatagatgttaaaaagtaaaagaaacaaaaagagagcccccccttcgccaacacacacgcgcgcgcgcgcgcgcgaacacacacacacacacacacacacggcacactttcaaaagtagccagcacgtagtcggccttaagccatgcatgttacctccaacctcagattttctctctgtctgagtgtctgtttgcagataacttaaaatcacccatctgcatccccactcaccctccagaaagcaaacgtggagagctcactctgcagaataaaatcaagaacaccacggttgtagctgctgtggactcggcggtctgagcagcctccccgagagccgtagttgctagtagaagtaagattgagctctgggcttgttttcagcttatttaattcacactgaaatgtttctgcgcgggacgaactcggtgtcaccgggtccctcccggagggttacttcctgcccccgacagtgtaatgaggcaagaaactaggaaggcgaccagatttcaaatttttctttcttttttctctcccctccctctcccctctccttctcacttgtatttagattcgcgcagaaaaacctctattttcttctaatccagaactggataacttggtaagagcggacccctatttccctcccccgcccccgaccccctacctcccacctccaacgccctcagctttgctttgagagccctgagatttctagaccggtcttcccgtgcctgcaggttggctgcaaatgtttctgtacacggacaactggtccgggacaagatcccggggaaataaattcatctcgagaggggccgggcgagccagcgcggggaaacgcgagcttttgttttttatgacagccgggctgcgcagctctaatcagcgcggggatttatctcccggcctgtcagcatgtgtgcttaaactttgcggacttcctagccctctaagtcccatcacgagggcagccaccggacaagagcccccaaacaaccagtttgcctgaaaggtgtaaggaaggcagcagaaactttgcaatgggaaaagccacagtttgagggccatttggaatatttttctgtccactccttccaaggacacatgtagtccagtgttgtggcccttttggggtggggtggggccagtgggactgagaaaggggagagccatgggggaggagagtgtttatgatcctcacttagatgctgtgttgttgttttagctagttttttttttcttaagaaatataaacctctagatggtacccagttgctgctattaagttttagtgttattgccataaatcaaaataactctatttactggtgggagggggtgggctggagatggtagagctgtggcagccagttttctgcaagccaggaatggggtgcttattgtttttgtatctttgcagatgattcaagccatacaagtattaaggtttcatctattggaattagagaaggtaatttctctagcctcttttccttttacttaccccttacccccaaacacacaggggggagggttccgaatggctgaagttcagccttctgatacatttgcataaatgtctttctttctggtaattagtgtcaaggccaatcttagcgtccatttctcttcgcagtttaattacaatttcagccactaaaactgggatcacaaacgccctagccttgtgttcattcttaataacttgctggctttgtgtaaatagttgcaattctgtgcatcccagctgatgtttcgaatgctgctctgaggttgtttcacaagttcatacctctgttgtctcttctcatcctcttccttctcttctttgctacctctgagggagaaaaaagttttattcagttgtagtgagtttctggaagacagtcttgagagcaagggcagatcagacacaggggagaggcagaaggggagaaggaggaggagcgggaaggagtctggaggaggtggtggggaggcacattaaacgttttgcagagacaaagcagagttgatagttgtgtcaatttcttgaatctgtgaatcctgcacacactccaccttcacactcaagaaagggtgtgggataacatgattttgctagctgttctataaatctcagcaataaaaacttaatgcattgtaattcaaactaacattaaattgcaagcacactggggtttcttgtgaatttttgcatgtcagtgatgcctgggacctctaggaaacctctgcacttacacttaaatattttgaggcattccttctcctttttgtaaaaaaaaaaaaaaaaaaaaaaaatcaatttgatatgtttttgtgtggctgtatgttttcccatatcaggagtactggcaacttgatttccttccatttttttttcaaagaaagttttctaaaatataccccttagagataaaaaccttcattacaaatataataaggacttgggttgtcaggcatttatcctatgccaccacagtacaggttctttggagaatatatatgtgcatatatacacacgtatacatttttttcttagacacattagaaagggatttatgataaagtcactggatgaaattaaatagtttaccttaaatgtcacctacgcaggtcacctctctaatgaccacagccccaggagcagatgaatttaacacgggtgttgaatatgttgtagcctgtgaatcatcttgtcactgtcaattttctgggatatctctattttgcaagaaaagaaagttattcctaattctggatgcgtctgggggtctctggaggacaattgccctgtgtttcccctatttggaagtttggatctcacaaggggggtggattgcacttgtcaatgtcatttatgcactcctgattatattcccatttttttatttctgtcataatgtaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccaggtatgcgcttttcaatttcaacatccctgggaaaaaaaaaaatctgtatgcatattgcttgctgggtcactaccacctccttttattatttgcatatgattaagtcccttttagatacatttccatcgaaatgaaaatttttgaataatgtggctattattgcttcattaaggctggctctgggattcgacctgaagagatgagcttgtaaaagctttgctagcaaacttgacctgtttcttgtcgcttttaatttttgtctttattttatttaccctctataataatgggagtgttaactgccagtgaccgcctctgattgtaggggctttgttccggagcatttttcccccttctatcttcaagaaaagacaagtgtagggtctgcttatttcttattttattaggaataaatccaagataggtggtctaagaaagacagcgagagtttgaaatctagcaaatgctggctattttctccctgtctgtacggttcattagcctgtcttgtcagttttcctcggccgaacgcttctagacctcactgaacattgctttgtgtggtgttcactgcaagctcacccattttattgtacttaatagaaaaaataagaccaggccgaggttataaaaacagataaatatggacttttctcctccttctttccactcatcctccagctggtatgtgctctgggccctctgggttggcagcttgtggacatatcagcatcaggggcaccccggcggctccctgggtaaggagtgtgggggacctcgcaccgcctttgctctcaactgagggccttggcttgctgcaccctctcctctcctgtcttccctccaggcccttcttccgatgcgttactaagtggggacgacttttatttggaattgctgtggggatttctctctctctgtcaccccaacaccaccgtttgctcccagggtgcctctctctctcctgtggctgtatctctggattggtccaaaggagttgcaaaaatgcaatgaaagtgaaaacgtgtagagtgagtgagatgaaacagggctcagaacagttccgttgcgaattgttgcaaggcgtctagagatttgggtagctggcctgctctgcaccctcccacccttcccccctatataagtgaagtcccagtgttgtttctctttctgactcggcacgtgagtccagatttgggggaagagatcagcctgcctttgttaagccaaaggccagctactctgcaagctctgccatgatctctgttggccagtggctgtcttgtacagtccttgtcgagcgcctgacgcctggttcttagtgtcatcttatggttttcttctctcaacatcatcctcttaaaatacattctcagcttgattttctctgggcaatccccgcgacatgggctgaattcctcttttgcccatggggagcgagaaacaggcagagcagagatttaaaagtgccaatgcgccgggtccgcactgtgatctggagagttggaaactttcggcagtgtagtccattgcacagaacacgcagcgtgcgcaatcccagtgcggccccacagaagtgggaaaactgcaggcggctcccagccttggcccccgcgggcggcccgggcctcacgtctggttcagcccgccagccctggcccgggagctgttgagtgccgattctgctgaggaaccctcgagtagctgctgtggaataaaaattgcaatccaacaagcctaactggaaaatgggattctaaaagctccggagtgctgggtacataaagctatttgagcaaattacaagaatcgcttaggggcatgaatgaaatcaacactttaattgcctccaaaatgaagatttataccccattttctcaaggaatcattattttattaaagtcaaagataaaagaccaaagttatgggaattttttggaggggggagagagaatacaaaaattaatataatatcatggagctccccccttctccttccctaaacttttgttacccaattcccttcagatatgcaaatattggtatgcaattgtatcggataaaacttctcattttattgtcttctacctctaaaatgagaatctgacttctggtccccgctggttaagagtgggcttcgaagctttggctgagctcgtggcgctgttggcctatgcgcctgggctcgcttgtgtgaccccctggggctcacccaagtttcagctggtcggaggacagcaaacccaaggtccggtttggagaggggagcgcaaagcgctggacgcatgcggtacagtgccacggccgccggtgggctccactgccctggggagctgaggcgcgacgaatgaagcaccagggcgcctggtgggcgccagttctccggtctggagcctgctggcctgtccctccggggcgctgaacccctagtgcggcgtcctgggggccgggcaggaaggatggcctctccacctgtctgcgaatgcagcccagccagtttgagcctccgcagagggtgcgctccgggactgggcgcttctcgtgctgtgagaacgctgggccttgttagctcattaacccctctgtctctagggcccgttggcggcacggtttattttattttacctgttttcctcggagggcgcgaagactgccacccgcgcggggacctgggatcgacgactttgatactaggcggtatcccggagggctaagtcggcggaaatccacttgaccttgtagcgttagtcctttcttttcctttcctttcctttttctttcttctctctttcctatttatttatttattttaaaaataggattaagacaccagtagaagctgtaatcccgttccttcccccactcccagtcttccgggccgcctggaggtccctgccggagagagccactttggcgggcgcaagcctcctgggcgccctctcctgaccgccgcgctctcggctcggcttggctgttccgggctcccagaggctaggggaagcgaggggcgccaggggcttcccggcctcagcgtggggcgaggtcccggctgcgaccccggagcagagggagaggggggccatgatgctaggcgtcgaggcgagggttgagcctgtttggcttcagagaacgatgcgggttcgaccggaagcggggcgcgtgttctaggggcccttgggtggattagggggcgccaagaggggttaggcgaggagaggcctggccacccagttgctagactttaggccgcactccaggaaggagcagtcggcttccttcctaggccgcttctattgcgcgccactccttgaatctaagcattttccactccaagaacgcgttgggagagaggggagagcggagcagagtctctaggcccccagggccgcctcccggggtggccacgcctgccggtagcgagccgagattagctaggtctgtgctcgggcctcagcggtggccctggctcttcccataagcagcgggaggcagagaaatggtccctttggattacagtttttattcaacagcagctctccggggggtcctcgtctgaatctgcatttagcagctcctgggcgaaggctgtcgggctgcacaggacgccctgttgcatgttaatccagatttgtctctgacgtctggggagaagtaatatggcttgcagttatggaaccagagagccacgctcgccaggcaggttaaatgccaagtgctgccgagctcccgggggacggccgccggggctgtgcagcccagactggagagcgcagggccgccaggcctctgggatctggggcaggccgggcccggtgcgctttggttcccaagtggtcctgggaactctgatggcgattgttttatttcaaaagttcacaatgttgtttctgaagcagagtttggcttaaaatcctttaaactgaggtagaactttgacagaaaacgccctcctccgaagaagcgggggaaattcttgcaagggagatttaagctttctctttaagggaggtgtcacagtcagggatgaggcagggagggcaagaaacaacctaatgtcctgcatggatgggatctgctgctttagaagcaaatagatagggccagcgaatatttacgaatactagaaatgtccgcaattccttgtcatccaataagaaaagtggacacaaacagcgggaggcagaaaaatggtccctttgtcaggtagtttgtttttaaatgcttccatttgtatacatcttatttaaattataaatgcttcgtaggttcccacttaatgccttaatcctgaaacctctcagtccacaggacttgcaagtgataaagtcttagcatcacctaactttacatttgattgtgttgtgggtcatgtgatatagtcttaattccttttaaaatatatgtcaaatggaaattatggcaagattctctttaatgattaaataataaggtgttgactgcttgtcactacactggctaattgggatgttcattctaggccctttattacatagcaccctttgaattaaaagttagttgtttactgggtatatttttattgttactttctgattggcttttagtgtgtatttatgtgtgagtttcagagtagggatgtattgattcttaatagggacacttttaaaacattctagaaaaaacaaggggaaaaaagtacaccatagatgcagataggttgagatcacttacattggtaaatgtctctaagtctaaacgctaatactacaaaaaatcctttgcgtagcttccctctctctctgtctccctctttctctttcaatctctctctcagtggaagtccccagtgcaagttgcatgaataatggaaagcaatgatactaatgctactttgtacaaagtaaagcctcataacagtaactattgttcagtgatttaactagctccatggcagtaggtcattcaaatagcaattcttcccccaccagaatgactccattgctcaccattctgaaatatatagagtagttgttttatatagctattggtcctaacttagagacttgtattagaaaacatggagaatcttaaataatagaggaagaagagaagagaagggagaaaaatgtattaaaatgtgggccgggctttcaaaaaagtaactgaaatatcatgctagaattgtccaactttgaaaatatataaattttaaatcattatgttttcaaacactcatatgtttaagtttttaaatgtttgtcatagtcccaaaagatttaaaacacagctgtggctgggtgacaagaaaagaaaatatccagtaaaattctatactcttaaaaaacaaagactatttgtgctcccatagtagaaacttatgtttattaaggccaagtagatagactaaagtattaccatgaggcctactgtcctaaaactagcttaccttccctagcgtacctcacaggtggagttggagaaactgtgaataatgcataacaaattatattaagacacttgccataaatgaaaatactgtcaacatgaatttaaatgaagtattctcatattggtaatgttatgctttccattgcaacaacaatattttcttatgaaacataaatatgtcaaacaaatgtgaaatgctaaagttttaataaatgatcatttaatcatcaaacaaaacccaagtatgtatacaaaaacttttaaaggaaagtcggcatacagccaaattgctatagggactagcagggaaatgatcaaaaaatgaacatgaaataagacttcctgtaagaaggtctataattcaaaattatttgactccactgtcagggaaatagttgaaggatagtaaactgatacagctctcagtcatttttgttacacagtcttaaatgtttgcaactgtagcattttacatggccttttgtggattatgatatctgtcatatttgaatcaaagtactactttaatttatgacataatcgaaacaaaattttttgccatttctcctgagtgcaaaaaaatttaagaattaaataaaaattatgggaaagtattcttttacaaatgaagaaaaatagaatgcatgtgacacagtttatctgacagttgtgcggatgttattatagatttaaagattttccagatcccaagtaaaacaacactgctctaaatcccgttgggcttgctcttcttactaagcaggaaatatcagaatgtaatacctgtataaaaagttctgggctaaaacatataaaatacagtctcccaatttaagttttaataataattacaaaatttgatttttggcatcctgtagaattttgaatattttgccatccttaatgtatacgaataaaccatgggtgtctaaaatcaattttgaaaagttcaagcaaatgagtgtgtccatgtagtgtaaaagataaaagaacatcttcactgtatctttaatttaacatgccatgatttcaagattataggaatttagagaagctttttggagtcttaaacagactctccaggaagtatacctacattggccaattgctggaatccctacacttgtaaattggacatttgaataaatggtataaaggatactatgtgaaataagtgagaatatattcactaaaatatttgtcactagaatccaattatgatcaatgtaatgcattcaagtgcacagaattaaagcaattggcaacaatttactagactttcttcaaacactcttgctaaatagcatttcttaatctagaaaatatgttcttgttaaaggaaaatacaagagtgcaaatattttccaattattttatattcttgacttcttggttcagagtttctaaaactgactaaaacatactatcaagggttgattctctgatggaaaaagggcttatttatacacatattgaattatacacctgttgtttattggtgtcatgagtatatacaatcaaatacaaattacagctggagttgtatagctgtatatcaatacaattgaagtttataatgaaattgacacaaattatagctatatatgttttaagatataaagtaaccatattatggtttttccatgacatatggaccaatttatgtggcatacgctaatggaggacaaataagttgagcaaagaagttttaccttatttgtaattctcaaaaatacatttctacagtggattcttcccttgtacttcataattctatttacaattaatagaatttatactcacgaagtaaacaaccttgagtgtgtaatgttatgcttctttaaaaaactcaaataaaatcctggcatgcacttatagtctcagctaatccagaggctgaggcaggaggatcacttgtgctgaggagctgccagcttgggcaatataacaagaccctgtctcaaaaacaagaccaaaaaatccttaaatgaaatcatattattcaaaaaaaataaaatgcctgttattattaataagtttacgaagtgaaattttaaaaatggccacaaccttatgagtttaacaaatattagcaactgttatagttgtgctgctgcttttacgttttaaccaaatacaaagtcttacattttacaatggacttaaatatacattattttaactcatttagaagatatcagtaaataagatttttgagtgatattagaattactctaatatcaatatatgacaacattctagtatcaatacctggccacataagctagcttagaatgaattgttgcttgtgaatttccatttctatagaattttccttacactttacaatatggtagcatgtttattatccattaactttaaatttctgggttgttggttattatttagaaagatagaactatatctctttctttttctgatcacttttttttctgccctttggaaaccttctatgcctgagatttgaacttgagctagtttgctaggtctcattttcctattgtagtgccttgtgggttattacccatatgtgggtttgttttcgtgagaaaatgaagaatgttactcacttcaaaacaggaatgaatagaggccaaagtcatcaaatattcccaacctgtgctttacaattaggtgaaaaactgaaaactgtgattcttatttgtcttccctagagctgtgaacacttggtataaagattaatattagcccctttgtgttcttcctctaaaagcctaaatgtttattttcagcaactgtattcttaactgattgtccatacttggtcccagacctccataatttacattttattctgaatttgcattcatatcacatcccatagaaactctttaaagtgaagtgtgtttatgactattatgaaactctggaaaatgaagtttataatgaaattgacacagccgtcaaaaggacagtgaagagagcaatttgactgtacatccagagtttccttatcccatctcaacttgtaaaaggcttatttctcttcttttaaaaatattagaagctgaatgaataagaatttctttgacaataaacctcctcttaatgtctccaaaactatttggatgtgttttcgaatattaacttaatttgatagacaagatataattaactgtgacctatagtgttttctggtattcagagattattccttagcaatttgaaaacttaatttcaaactacatgatgtataatttctgaaattctaaaggcatacttacactatttacgtgaagtggagtgtttgtctacagagcttcaaaatggagatactttagaggtggaggaacaatttttacatacaaagtcttggcaaactagctagtgcaggtgggctatttttggaaacttttcaatatatagccttcctatatatttactgcaatattaaaatttttcttcctgaaggaaaaaaaaagctctgtgtttcatacagaaactcgtatatgacattttaaaccttcacatttcattgatcataaaatccagccaatatatatatagaaaatttgaaatagcagcaaataggtaagatgctatttgctattatgctacaatcagaacagaaactttagcagtacaattaattaggcattttgggtttagttgcaacatttacttgaaagttcccaccagatctggagttgttttataatccacgcttgagaatattttagtgtaaaaaatttgtgataaatcaccattgaacattacttttatttcaaattgctccttcctaagagatgtagtgtcaggagtaaccaccctgcccttcactcttgaacatataaatgtattatttatttacattctatcatatacattatttatgggaattatactataactctacagagcatatggaattcatcttcatgagataagggtggcatctctgccaatgtggtatagccctaagtagataattaaggattaccctcagactacagataaatattatctcttatagagtcattacatgtttatatttcatagctccagatgcaaatgtagtttgccattttcattttaattgtcatagttttcttggctctagcttctaacaaagagaaacaggaattttacatttggaattgatcttgatgataaattaatatgttcaagaaaaagaaagatattcagttgcagaattatttaacccccttcctttctttcagcctgctttccctgtccttaatgtgttccaaaattttctgaagaatgttgttcataaagtttgtagcactgtttgtgtatttggtggcttggcctattgtttcattatattttgggtttttaaaagctgtgtttaataacaaaataagcaagaaaaacatctgagttattatgtcccgtacttctttgcacaaaataacagagagatacagaatatgcttgttctgtgcatatgaagtgtattgctagtgttcaatttttttattctaataattattcaaaggcagtaacaatctgcatttaagtgagtataaacatttttattctggaatttggaatttgcagcaactcaattttattttccaaattaccctgccatttcaattaggtgcattgttcttcactctactgttgcgacattctaaaggtttgcttgccatcctaatagtgaattgtttgagtgtttaatatttattgagggcatgtaaagaacatgccaatagaaaaataggagaacaaaacattgacaaatcaattatgtggcttttctttgctcgtggtatactttcaataatccaaatactctgtaactgttaaatagtatgaataatctctagaataatagccttgggtatggctgaagaatgacattctgattaactggaattccttaaaaagtgcacagtgcaactcagcatcttacttctggaattcacagttgctttggctgatctcttagttaagtatcttgaaatatagaaaacttgaccgttgtaggaaccagaaactcaaattaaatctcaagatgctttgagaaaggcctccctgattattttacccaagataaataatgaaggaagggaataatcttttcccaactccaaatttaacgttgtcagtgggcttaaagatgcagacattcttgaggaatgagagacacttaaaacacaaaatgttgtaaaaaatataaaaaatcagaagtgcttctaaagaaaccatagggaaattagaagataccctattaataattattagtggaaatcagcggtaaatataaatttctgtgattctgttattcaaagtataatgctatgaggtagtagaacaaaacaagactatatcttggctgaatttttttttcttcttatgtctcaattgtgtgttctctggctcgagagtttagaagtagaaaagagaaaacttcagaaacacttgagactaaacagttaagtgtattgcttgtcatttttagttacacatcctttcaggaaggtggtgttctaatgaacaatatacaatttagagccagagcacttatatttgaatctagactttgctctgagagggcaagtcactgcaccttgacgggccttagtttaataatctgtaaaatggggatagtaacagtacccactttattgagttactgtaagaactaaataaaagtgcatctaaaacatttagagtagtaaatccccaatgagcacttcattacattatattttatcttcttgcttgtattctgcctaaccttcaaaaacaggaattgggtttatggaggaaggattgggtgctggttgatggggctgttgttttatagagtattttatcatcgtagagtttaagaaaaatatcttaattcttattatgaggggtcaattttattctgatttcagcatagtgtaaaaggagactgaactcagatattttactgagatagtatagtgaatcactgcagactcactcctagggtaaaattcaaataacagttatgtaaggaccctgtgctaagtactttttccccacatttctgaatacaaatacttcatgctgaggtcttgttgctttcgggatgttattatctacttttactcattatacaatgttttctgcattattggatttttcattttttaaattttttttgctaggagccttgcctagaaagtttgtggttgaagttgttttatataaaacacttttaagtttattttatcttaatttgtttgcagaacaaggagcactgatactaagttacggatgtaaaataaaacactgggaagcaaacagtcttataaagaggattttataacatcaggtatactggcatgtaatttactgattcttctcccactgctaagtagaaataatagaaaatgatcagagttcagcagaaaactctcaaaagataaatgaataaaacagattgaagtatttaggtatacttatttggaaatatagtggtatcagtggattagggtttttttcagccaaacatttaactctatgaactacaatttataggtatgatttcaagaagcacctggagtcattaaagtcagtaaatataagaatttatttttattaatagcatgccagttataatacaatggcatagaaaaagaaaaggttatcaaaacatagatacttttactaagaattttagcatattgaggctttatcttctctcttcttaagatttttctctacaagaaactggtaagtagaatttgaacattcagggcacttgaataatttctattacttaccagttttgagaaattggcatttatggtcaattgccctttggttgtaattattccttttctttgtaatttggctgaatgtaccacatgtagaaatctatattatcttcttagaccacagtagggtcaccatgggatgatgttagcattgattgtcaaagttaaagaattgggcaaaaagtatcagtgctgtcttgatttcatcaggaaagcctttggaatattctgagtgttgttttacatctgtagacctctgcttagcatagttgattcacttgtaatttattgggtaaattaattcaactgtgcaggttaataaattcctgaaaatgttagagtggagacctaaaagacaccaggctgttgaaaactagggttttaagcagcattgggaaagtgttctgtggtattcagtcctggcttcctaaggtccccaccctcactgcctgccatagcagcccagcgcctgagtattgagaggagaatgaagcatgctgattgcaggacagtgggcaaaatctttaagggatagcagattttaaaaatatatcttacagccaggctgctttaaattccattacaatgtaattaaaaaaccattagattcattttttaacattcttttgccttatgccttacgtatgtgataggtgtgtgttgcggtgtgtgcatgtgaacccatgtgcacactcatgtctgaacccaggctttagtgatttctgaagcttgaagaatcacctggtagaaaacttttcacttaaagatgaaattactccttggagaattttcaccaaaggcaagaaagcacaaaaattcttttcctcctctctacatgcctcattacacagagatagaggattcaatgtttgaaaaattatcatttttgtaggttttatttgtggtacgtgagaactgggaaatatggaactctatttaacagatgctatgtctacctatacaaactacccacagtgactatcatatgatttttatacacacacacacacacacacacacacgtttatttgcaagcaattcaccagagtcgcttagctgttaaggtcttagaaatctgcctcatttgatgctgaagtgtacacacttatgctgtgtataaaaatactggctggcaccaatgtagtgagtgcaagacgtaagagatgattacataaccaagatgcatttctagattaaaagttcacaatggcaaatatgacagggctggaactgtgagaagaggcagtgtggtgtgttggtgaaagccacagattctgaagagggatgctggatttccattgtcttaccgctaatttaccatctgccctgagtcaccagaattacccttcaggcctctattaagtggagtcataagcacattttatcacagcattaaaaaagggttcaacaagaaccctggcagggcttacagacttggcaaaggtaagcgagtgagggaggggcagagaaggaaatgagcaaaaggagagttggtggagaaagtggataaagtgtgtgagggaggtagccttttaaaaagttggcctctctgccaaagatgagtgtgggcctccatcagggagtgcctcaggcacctaccactattttcccagaaccagcaattgcctctctgcattttatccacttttcagcagtgcacagtgtggacttagaaaaggtttctctaaagtatgctatttcacgtccatatcattcctcacaacactttaatgtggcccctgaatccacagcacgtgtgcacagtgaaatattcatttgtgaatgtttatggcatttcaaaacatctaaatgctcaaaaggtaagagcagttttcctgtgttaagaaaaaaaaaaggcaaaacaaaacatactgcctaaacttgttgtggttaaatgaattttgcttagtgatttctagggattttttttttttttttttagaaatccacataactttttttccagaattacctgaatttgaaattgagtagatgtagccccaaaggagtatgttttgagaggagcaggctgtatctagcaaattataggtgctcaatacatggtagttgagtgggttgaatgattatatgctatgttttggttatcaagcagatacaaatgtgagccaccaagcatttcagtacgagtttcagtatgacaagactttaaatactcagacataaaaagccttctcagcatccccattccccagcttcaggtacacacaggtaaatgtgtattgtttctcacagcagctcctgtgccccttctcttctcctcatttctctgcatatggatctctctctgatccctttcctcagatggtatcattgattgaggagtgtataagaaatgatatttgctgaagtcatgcacctttaaggatcccgaaaaacactgtttagacagaggggaaaagtcaaggggagccgggctaattagatgcacccccccagacagtgtgggatgctgacatacagcgatcccattcactgtgcttcatggaagagcacaggtgtgcacatgggcacatacatacggacatgggcaagcctgccagtgtgagtgtgcgtgtgtatgcctgagtaccatgcacactggtgccttctccatgcggacctggagactgtcctcacctggagataataaattgttcacttttggagacaagccagctctttcaggccactagagattacttactaaagagaccctggtgatttgagagagtaaatgtacctccccaaagagaaagccgcctattgacaggtgcagactgacttcgaattttgtacactgattatttcatcagtttctacgtagctgctaactgacaccttcacagtaaagatcatcagactctcaattatccacctttttgaatgggaccagtagtgtagaagttttgaagaaaaaaaaactctatttttggttcgaaaaaaatgattctggcatcatactgatgtggtgaatgactgactgggaagatgtgtcaagatgctttgtatactgtaaagtgatttataaatattaggcatcgaattaaacttgatgaggtggggaggaacaaaccacctgtaaaaatcatgttattccaaggtgaaaataagatcagtttgcattccctgagcacacagcagctgggagatagcacaaagcataccaagctgtgcacgaagccagctcaggttaaccattctttccagaaggtctatacactgaatatacctgtatgtagataccccaaggttggcttaggtcaacttatgttgttacattaagaactatagaagctgccatttattgagtgcttgctgcatgcttgacaatttacatatgttatgtctgcaagggagtactttttatcctcatttacagatgaggacattaaggtttcaagaggttatgacttacttaagaccatgtaagtggcccaatcaagtttccaacaggactagctttaaattttctttcttttgactgttatgctacaactgagtattaatctatttttatagtggtgtgtgtttgtgtaagtgcaagtatgtgaggtatatttaaattgtactactcttttttagatattttgtgatgtctctcatatgggagaacacaatgccaggtgacaatttaacaaagattccatatgtattacttaagttattcattcaaaaatatatttgtatctaatataatatcaacattttcctaggatggaggatataagcataaataagatgtaggccaggatttcaaaacattcatagtgtagaattgtagacaggcacagcaggtcatcacaaagcaaagagtgaaaggctagaagtgtgcatgagatggtctgagctctcagagcagcagagcctcactcatccaggggttgatgtgtatcagggaaggttttctaggtaaggtggtatctgggctgtgccttaaatagcaagaaggagataatcaggggctggggtcaggcagggcagagcaaggcactgcaggcagaggagaaggatgagcatgggcctggagcaataagcagcagagtatttgtgagaaatcatgtgcaatgggatgttgcaggagcaaaagaaacaaggagaggaatggtcccttggggagattatgaagggctttgtataccagggtaaggacctcagattgtattctgtaggcagtgaggagcagtccattcattcaacaaatgtttcctgtgtgccagccaactgttgggcactgtgattgatagtcaggatgcaatggtgagcaaaactgacaccatgtctgacctcacagagcgtatgatctggtggaatggaactcttttaaaggttgggagtgatgagggccttaacaagaacagcagtcatgaatatggaatgggggagatttatttcagaactatttgggggtcaaaaatagacaagatttggtgactgattgaatggggaggtggagagagagagatagagagagagcgtatgaatggctctcaggtttataccacaggtggaggatgtgatacctactaggacacggaataaaaaggaatgagtaggaagtttggtggagacaaagagtttagctttggacttgctgagttgaaacaagtccactttcggacttcttgaggtggatgtctttgcatggagatggtttcgcaggtagttggacatacaagtctaaagaccaaagaagaaattcagacacacacgtctggtagcatataggaaatcaaaccactgtggaggagggaattatccaaggaatacctggaaagtgataagaggtcctgacctctgtccaaatttaaggcatagattgaaaaagagtgaatggtagaagaaaaaaaagtcaccagtggtaactttattcaggaagccaagatagtttttgaagttgcagtttgtttgttgggatgttggtggcatagtgactaatgaacaattcagattcattccctaagcacttggtgcctgctgaacatgagccatgcattgtgctgagctaggaaaggagaagacagagaagattaagataccattctcactcatggaggagtcaggggagctcattctttctattttactaccagatgccagtaagattgccttagagattgaaaataccatacatggaatcagaaaaaaccccaaacaacttattttgaagtgttcttaagaaacgatagaagaaaatgggagtgttctagctgtcaaagagagaagatatgaggagaatcatagcttgcttcaaatattttaaatggctgtctcttggggccctagaactagaaaaaacatgagcaaaaattaagttagtttatatattatatatcgatcaagaagaacttactgatggagtgcagtttctagctgcctgcctccatttatgacaatagaaatagtgtctggaggacactggctgtcaataacaagttagagtgtacattcagtgatctttcaggtctttccagcaaaagatttttttttcccaacaacttctttgttgttgttgttgttgttgttgttgttcttgttgttttgtctagccctgtgaacatctcctagagcagtggttctcaaattttgagagcactgtatacctgtttgagaatctgataaaaagttttgaaccctatcctttgggaaaaatatgcaagtatccacataaacccaaatattattccaacaagaccaccctaaaatcttccataggtgattctggacctcaggttaagacctcttgtcttactggatttccaataaatgagaacgcagccattgcttactctgaaattatatacattgaagaaaaaagcctctttgggacttaatttaaaaccatgactaaggttttttatttatctaatgccatgcattcttgattttattctgtcagccttacattacaagtggccccaagcaactcacaacttcacagatatgtatgcataatcagatgcacatattttattttaaaaataataatgatgttgtttggtgtaaccgcatatagtcacagagataggttattgtaactgaacttctctgtccatggatttggggggagttcgttctgattagggctgtcttacatatttatactagaagagttcatgagctatttctgatacttagactttaatcatgcttaatgaactgaactaagcataattcttgttctgtttttgtaactttgtggatttcttctaatgctcagtttcatgtgactactcattcttaaatgctaatacacaaaaatgctaattcaagaaaggagcacaaaagttagatttcacttcagagaagtgcattcagtattcataggccttctggaggagcaaggctgtgagaagaatgatattaggtgaaaaatattggctcctacctttggtgaacacacaaatttaaacatataggttgcacaaaatttggataaactgaggtggaatccaacatttcttgcatgaattcctgtataatgtggcgatagctgtgagaaaagaggagcccagcatctaaggcccaacacaatgaaaatgcaatgaatcggaatgcctcacagatcatagcggaatcagaatttccagcaaggaaaatcttttcatggtgaattaagtggtggatgaagaaaaatggtgatgaaaaaaggtaggcacagatcacaaacactgggctcagggctcactgctgaagatttaagaaccttagctaaagctatgcagaatagaatgtggaaaattgaatttactaaacaattaagcattgaattaatctacatcctgcacagtagaaaagtgggggagggagcagagcagagctgaataaatcagtggagctcattaaaagatagtgaatatatcaggtctgttgtagcataaaggaggacagcttcctgtataacaaggaataattctttggttctaagtcacctttttggagtcctagtcttaatcagattaacaaacatgcttctgatgaggttggtctgtggctctgtattttagcttgttatcgctagcttttctattaattaccagtcagatcaccagtcaacaatagtagtgagggacaacataaataaaatgagagtgcccaggagatgtcactcgcaggatctcatgcatcctgaaactcccacgggttcctgcagcctcccacatgtcttgctggtcttttgttcaattacagttaatgcaatagtttgccattttctctttctaattatattttcaagtgggatttgtagcacatagaaaaacatccttttacatgtcgaggcaccggggttttgtgcctggcattgtctgtcccctgggtgctgtaccattctttctgcagagctctgaataaacaagtcccccttttagagctgcagttgtacaaactgaaaatttatgcattaactgtttgcattctgagcgtgtgttccagattacgtcttacagcattcttctggtatgctgcagaatgcgtgtgtgcaaaaagcacttctttcacagttcacatatctttcaatctcagaatcagcagatcaattagcactgtttttgagaatatgcataatgggtcatattatacatgagtcaaacatacaaatggcatatctttctatgactttattttcatttttcaggctgcattaatcttctggccaagattatagaataagtgacagtgatgcatcttgttcagaaacagtgactctttccctttgattcctatacagcatgcctcttagatgggatctttacttttctctccctgggtgtctgagacattttgatctcctcagcccttcttatcttctccagggtaggaacatagttttctagaaataagcaaagagctctttgatttcgctaggcatacttaatgatattggaagggtcagcaaactctactactatatagtcatgaagcctgaccttatatgattgaaatgatgtatacatattttacatacgagatgatcctgttttcccactaataatcttgaagataaatatcacttcctagtgaaggaccagctttgtattttgcatcattcctactgtgcaggatgaccagtgactcatgaggctgtttttgaaagctagcactaaaagctaattaaaatcttttctggtgataaagagagatttgggagaggtgtcgccatgattgttttcctcaagaatttattttacagccaatttttcctatctgaatgttactttcaaatgcacccagtgataagaagcaacatctgttttccgttcaatagtacaagaaggctctgcatggggctgagtgtacacagtccatgtgaatctattgttattctcattccttttttgtgcctatgcctggtccatttgccatgtaccatccggcaaacagctgacacatactagctattatggacccaggcctaattgtgaggtcttaaaagctctgccatgtttgtcttctaggatgaatcagaggcccctataaaccacagtgttatagaccaccactctcattttgcatttccagagtagcagactgttgtgccagagggtttgttgatgttgaaaatatagtcagaatcagtggcggcattttgttttcctctttgcctggaatgtttttgttttccttagtaataaagcatgcaattacttacagaataactatttgtagatattattttagcttggaagcagaaactggcaaattataaatgtgccaatgcagctctgagctggaaccatggttgaagggggatgggaaaggtggcatggttatgtgctccagccctccatggctttgtcattatgccatgggatcctaccaataagggttcacagatgcctcttatttgggtttctgatttgtgcccccacagccctcttggaacagagatcatgatgacacggcatctactcgttcaggaggaaccccaggcccttccagcggtggccacacgtcacacagtggggacaacagcagtgagcaaggtaggagagatgttattctcttttgctacttgtttcatttttaaggattgaaaaatcagaaatgtctagtgagttactaagtatacagtttttcctagaagataaaccccctttaacttgagaatcagctcatcttattttattctctgaccctgctcttctgtgctattccagctgcttaactgtctgtcacctggccagcttcataaaacagggtagtgaattgactcagggcaagattagagaagtagcttagaagtttgaatgtgaataaatagtatgccattcataccctgctatacaaataaaaagtattattactacttgccctcagaggcttttcaagagctcatgaagaaacatccactaggattccaagttaatgatgtcttaggatgcttataaggctgtgagccctttagtagcacatgctcggcttccctctccactgggttgaagtcatttttttctggttttacttatctgaatctcctaagtgcttgacttcattgcaaagccagactaaataaaatttaggaagacatggaaagataacaggttaatttgtgttgtcctgtgaatgcacatacctatgtgtatgtgagtgtccatggattatgcatgtttgactataactagtaggaaataaagtttaaacatcaagctagtcttcagcaaaagggcgaattgagtattcaaatgtctgtactgcttttcatgagagcccgctgtgtggattttgtgttccattaatgcaattaaagtttaaaagagaattctttatctgaatataaaaaggctgttttattgaagttgactctgagcccacagtaggtacatactttaaaatctggttttatgatcatgtttcactggagtgctgttagacaacaaaggaattttgttgtctaacttagttgggctctaccaattaaaattgcaaagtctacaatgaatttagtgtgattaatttgaaaacaaaaacaggaaagttaatttttttgaggcacatatatgctgtttgtactgggaataacttcaacaaatataattttaaacatttgagacattttattgttcaaagaaaagttgctgacttcatcacaactataagcctagtaaaaacggagcccagaatagtaaactggttcagagctgagaggtaacctctgacctctgacttttactggaaaatgatatgcagcataaatccaaggggccttttttctttcaagtgtgtgtatgtatgtgttatggcgttgctgttcagagtgctatagttaaggtggtgtcagcactttcaatataaagccctactttcataactctacttacactatgagttttcaaaaaggtgtaaatggaatataaattctttttcctgtagcccaaaattgctacatggggtcgcagcctagtgtttggcttgtttctttttctttttcatttcttgcttttcaaaacttatatcatctgagaataggtagatagttcagctgctgcattgaaggcttgcaaactgctgaaatgcacttgaatttaaaattgtaatgcatctgttttctcaaacatagtatgataagaggattttcagatagcaaatgcccaataccagttcttcccctctgacatgctgtaacaaggaattaggagtgttgtatgctgcttcttccttcaacaagtgttctccaaaggcctatttaataatttgattgtaactaggaactacatattattcacattactttctacttataatgtttcttcctatattttttctttttatgttttatatttgagtccaatacctagttgtttttagggcagtttcacataaattatcttatttgaatgatctcagctgaatcatttaaaaacaatcctgggtagcagagtaagtgggtctatccccacttgacagaggagaagaataaggtacaaagaagctgagtgatttgttgaggtcccagtggagtgtcagacctaaacttccagtttcccaattacttaaataaggttcttctcatcagaccctctttcctcatctctctactaaaaaactacagtgaataacttccactgtcatcaaatagaaactttctgtgctggtttcccctaccccacctttctgtgcttgataacagaagctgttgggagccccaccttcagtcttatttgtccttccttgtgggttttctttggcagttgaatttattcctgctaaatgcagaatgatgcctgaaagtgttgctgcaacaacttatgcacacttccatgccaaccgtcacccttctaaacctttttttcatccctgagaactgcagagcttggtctttgtgcagccttcggattaactgtgcacagtggcttttccatgttttccctgtttgccttttctggcaggcatggatgtgtaagctgtgccagcatttggcctgtagtacatgtcctaaatagttatttacacagtttgagtccattttagtcaactgggtaaataacagccctcttcaaaagatttataaatccataaatatgtctttatacatacccaatagacagaaataactcaatctgtcaagaacatatccaaagaggtgtttcccccacagacaggagtaatacatattttaaaactttctctgacatattatttttactgcatttcttttttcctcattccttttccatttttaccacttcattatggcacctgtggttaaaaaaaaaaaaaagaaaagaaagaaagaaaggaaagaaaagaaaacaaaaaagaaatcccctaggctttagccctctgttaaataaccttatctgctacacagtggaggcatgtaacaggctatatatatatacatctcaactgagtcctattcttttgaacttccaaagtagataaaatgaaataagttatgcaggagattttaaatgttctaagatttcaaaatacagtaagagtttctggttagagcttcagcaatttggggaattttgaatgactgataatttgctgaattagtagctgttgtgatcagtgaaagagttttagtacacatttttacctaaacattaaaaaaagaaatacaaaatccatggctgggagcagtggctcacgcctgtaatcccagcagtttaggaggccgaggtaggggggggtcacaaggtcaggagttcaagaccagcctggcccacatggtgaaatcccatctctactaaaaatacaaaagttagccagacgtggtggtgggcgcctataatcccagctactcgggaggctgagccaggagaatcgcttgaacccaggaggcggaggttgcagtgagccgagatcatgccacagcactccagcctgggtgacagagcaagactcccatctaggaaaagaaaaaaaaaaatccaatcgtgggcattctaaagagaatgtacataagatgtgtaattacaaaaatatcaaggtactattattcagggatttaatgtttattcgcgatttacacaatatatctttccctcaattcaaattatttatcatgatgaccctttttatgatatctacttccattcaatattaatacttgtggccccttgcaggagattgattctttaatagtaaagtccttttcaattggcatttaagagggagggcctcacatctgtgtttggttggggattctgttgctgttgctacaacattgatttttgtttactccataacttcctcaaagtacttccaaagataccagattgaatccttattttatccctggcaattacttgctttattttcccatttcacaggagatagaagtaatagctcagaaatattgaagagtaactctcaaagtcagcttcaggatcttggtctcttggctttgtagctgctttaggatggggtgtctgtttccagggctgccaagtagtgtctcataggtacgggaggtacatgatggcagagacgtgtggctttcgtgtgtcttttgcatcctactgtgcatggctgcccgcctaaccataatcagagcctactctaggaactgtgtgttttggagtgggagaacttcaagcaaattgggtgcctcttcccctagatttttactgtttccccaaaggcctgccacagccactctatgcctcttaagcagcttcagctacgattgaccacatttttgagtctggacaggtctctgtttttgctttaaagttaagagagctaaataaatgatggtaaaaagataataaaatagaacatgaagggctgtcagtcagtgtaggtatttccatcccctcacttttcaagtgaggtcacggaggctcagagcgataaggagacttgtccaaggccacacaccggctggtgctcaagccgggacttgaacccacgcagtctgactctagagcccaagctcctaactatgacatcctatttgatacactgttttactggagaaacagatcatttgacagacattctttctgttagcaatttgacaactctttccccagttgtctgtactgaacctggcgctgtgctccgtaatggtgacctagctgtgaataagatagaatcaccttaaactcagaggggtaatgttctgttggggagggagaacctagttttgcatgctaagtagaatgatgaatgaagtatttacaaagggagcatgatgactgatatgattcattggtattatgtattaagagcctatatcatttcactcattcaaagacttagtgaattaagaatagaagcatgggaacaagtaaagatattgctcttgcagaacattttccactgaaagctcatcatattttcctcttttgtgaggataaagaaaaagtattatttctacatggaaatttgatgtaatacatttcaaccctaaaggcttttaatgattgctggaatctctaaaacccacttatgaacttctcctttaggaggcaggactcagaataacaatagtaccacttaaaaaaaaaaaagcaaaaccagcatgccaggatgtttctttaaagaagattaatgctaagcactgcatttctctatcataatgtatcaatagttgcagtgcctcccactgccccatccccctccacaccagcttttgtgtgagtccaggcaacctataggcagaaggcaattccatttattattgaggggactctccaggcagttgttccagacctgtgaagccagcaggcagagcggcctgagagggggtggggagcaccgggcgagggaggtggggaagggccacattatgttccagatgactgagtaacgatttatatatcactcgccttttttacatgaagaagaaaagtaataacagcccaaacccaggcatttgaaacagtcagctgtccgatgaataatgggataggtgggaaggagcgctctgattggatgtcttaatgagcacatttcgcacagagtttgggctgcagttccccttgacctttgccctttattgaccaaactgacacttcatttttcacatacttccaattatggctcggcttaagtgttgccctccctcctttatttctttcctatggacaacttgagagtggttgaggccacagaagatattttaatttgaaaaactaccgtagcgactcaggttcaggatgtaatctgaaactgctgtcactgcagcttttcagctgaaaacacaaagttaatactgcttgtttctagacaattttctttaaaaaaaaaacacgaaaaaatctaacatattttacaaacgaaatgataacctaagaaccttgaaaatgaaggaaaatggttacaaacggtaatttttattttttgttgtttcatttgtctgttggtcacagtgacttgaatgatctctatttgttcacacttgcttcttaagcctgtacctctccagggacttctggtatttcaatggcactgtaatgattttgactaatacacttttgggaggagagaaaagtaaaatataattgtgaccacaggccttagagcatcgcagccctgtgtgttcctttggttatatttaatgttgacctgcaaattaaagtgtggcctttgcatgcagtggcaggcagaataggaaaatgatttcctggtgggaaaagtcaggtgtaaaaaagaaagaggaagttattatgctccacaaatggccgttatcaaaaagtctatattattaacttatcaaacatgttgaatgagatgtagagacagagaactgttttcccaagaacaccctgtaatatactcacctttccttttattgactcatcaaatgtgagtaacagtgttctggtttccacctgcttgacttctagcatcatgaaatcaggtcatcttaaagaaaaataacttcatcatctaaaagtagtaactatatttaggggcacgaacttggccataagcattttcatagaaagtgcctcttctcattattaggcaacatcaccagtaaacttgaggtcattgtttttcatcttaaacaaccgaaaagtgcatttgaaattatttacagccgagtagagatattcttcgaacacagaagtatttatctgaaaagtggatgaagtgttatctactttattatgtagccctctagcatatctgtggcatatttttactgtaatatggtaataaaagaatatgtaaaagacagacaaatgttctgtctttttctgtaaggtgacctctgttaccaagtaactgctttacttatgagcttattaaaaactcaaaaaatgagcttttcatagttcacaggcattgatgtgaaaatgagctgtcctgtgagtagttttcttgatcacttttagaacaattgattagccaaagagctcctgtcattagttgacattgactgatagcaatttgtcacaagctctgaaggtcagctagacagttggagtttcagcttgtctttgattgacctttactgattccatcctcatgtgattgggtttgaatagttctgaccctcaattggaaaagacagggcattagtcaacagagtcatttcttatattttctgttgattgctcatttttatttatgtgtgaattcatggtctggatttcttatcaaattttgaactctcatttttgaaatttaaaaggtgcgatatttattgtgtgacctgtaagtcacaattctgctttccctttggtttgcacacttgatttgtgatgtcaatgacgtctgtctactggccactgttacctgtgcaggtactggagttttgttgcaagtgatggattaaaattttgttgttgctgtcattttttaagaaataccaactccggtgtgacttgtagcacatctaaaattatacaccaattcttttattttcctagaattgactacttttgtctcccaagactcatgcaatattttaaaataagaaataagtagtaaggaagtatatgaataatgatgttgtgtcagttcatcatttagctctgcagccagaggcatgaaaactttttaaaaagtatcttcttttcagtttcactcagttggctgtaaattagagaaagctcccctagctagaagggcattcgcttttcagtgatagtggaatatattttctgttttcatggacctggaagttaattgttcataatattcagttctttcttttcaaaactgtaaatattttccaaaaatacatcacatatagagaaatatgttccacatcatattaataccatgcattgtattgttttatgtaaacgatgaaaatggagatattagctttaaaaacccaggtcttaatctgtaattatttaattcagtttttatgtaaggccttttcattctcttatcctttctcaccttcccttcttctcttgagtctgcattgggttttaaactataagcaataacttgtttttcaggccagatctcccaggcattccagggccaccacacacagcctggcacagctcaaacatgtgtttcagtttctacccaaggaaataaataaggagagaattcattgtttcaggtggtagattcttcacatggtgtcattcttggcaaggcagaagtgaggaagttaattttagggaagcatccatttaatgtagcccaaggagataaaaagagtttagaattataatctctcctgcagatgagccaaaatattatcatgagttgtgtttaagcgggggatgggaatgtaaatttatacattctagtcaagtcatcaaaaatagattaagcacttactgtgtgccaggtactctgtgtgagctataaaaatgagtaggtcatagtatttgcccttaggaagttcctgtgtgctaccaagaacatcaagcatatcaaagtaaaatatttgctaaatattggatattcttagggagccgtgagtgtatttatttcacaacatgccaatgacccagacatggtgaactccgtggtcaggcctgctggatgaaacacagcgtggtgggtattaggttcaaattgcagagggacagcactaccttggtaggtgtagacgttcagcatctatggggccctgttaggtggacttggctccagagcccactcttggaaacttggtccagtccttccacactgccatgagccagccagtgcctctgctgtctgaaccattggggtcatcattgtgttcaccgccattagtcacctggctgctgactcagattgatcttcttcaagggaatcttgacattttgaggaggagaggacccctttggcagtctggtgaagccaatggataccttatcagagtaatatatttattaatgtatcaaataaaacccacaggactacaagggcagtgaattgtattaaaattcaatcttctaaatattttttaaagccaagttgtaatatagtaatataaggccgggcgcggtggctcatgcctgtaatcccagcactttgggacgccaaggtgggcggatcacctgaggtcaggagttcaaaaccagcctgaccaacattgagaaaccccatctctactaaaaatacaaaattagccgggtatagtggtgcgtgcctgtaatcccagctagttgggaggctgaggcaggagaatcgcttgaatctggaaggcagaggttgcggtgagccgagattgtgccattgcactccagcctgggtaacaagagtgagactccatgtcaaaaaaaaaaaaaaaaaaaatatatatatatatatatatagtaatataagtgctctgttaaataggcttaaataacaagatctactagtaattctgttgtctgctgaatttttgaagtagtgataaatgtaagtcatgttttaagatatttataacaactatattgtgatatgcaaatatgatttccgttgggaacaaagttacaggtcctgctaatagttctgtggtttgttacttacttacatacaagcatgaaggaaatgctaattctaattgaagttattgataataaaaatgtaattttttccccttctcaagtacatatatcccctgaattctaaccatggatctcccttgaggaggtgtctatatagcccaggttaacaacttctaaacttaagtgtcagaagttaaataaatgggtttggggatgtatagccatcccttggtatcccccagggattggttccaggaccctctcccctcaaccccgcagacaacaaaatcttcagatgctcaattccctgctattaaatggcatagtatttgcatataacctatgcacatcctcccatatactttaaataatctctagattacttataatacctggtacaatgtacatgctttgcaaatagttgttatactgtattgtttagaaaataatgacaagaaaaaagtctgtacatgttcagtacatatgcaatcatccattttttttttcaaataccttctatcctcagttggttgaatacgtggatgtagaacacatgcatatggaggtcttgaccttaaatcatgccatccacctaatcacttgttctccgtactcctaccctgggacatcaccctctgccccgcagtgagcatctaacagaagatgggtggatgccaggagcagcatctgaggatcttttgagggattatagggctgaggtgagactgaattctgagacaggaccctgtagcaagggtaactatgctaccctgggaggatgtttttatgtcctatgcccttcccagtagcagccatgattctacctgccctgggctgtgatatttagctctccccctgatgttatttctctttatcatgggtgatagcactaattaagaatagtagtagaggctttggctgttggcctagcaaaaactaacccaaacagtaaatttatgccaagcattttcctcaggaaaaaaaaaatgtaggcatggtctacctgttgtattgattagtcccagaaatgtagttggtaaagttgggttttgctcaagtgtctggctttgtggattagctcagtcttgcatatagttttccataattgcttaacctaaaagcattctatttgattagtacaattagtttggctttctccctcttaccaatatcaattcatatgcattccctcctaacgttgctcactttattttgtaacaaagaatgaagacagcagaacttcctgttacttatttccatattagaagaaaaggagaatatgaccttacgtagcaaagcttacatttttaaaaaatgtatatttttaagaaaaagagaactacagagtgaatgcagaaaatattgaatttgccaatgggcttgttgctaggttattagcatttactgttgtagtttgactctttccttgagtgcccctactacttatgacagccaggacagctagcaccttgacacccttttatactttaataccttgggagaaaaggatatattgattttaaaatgcatatatatatacacatatatatatataaatatatgaatataaatatcatttataaatataaaatataaatatgcacacctatataaataaatatgtatatttataaaaatatttataaatatgttatttataaaataaatatataatatattatatataaaaatataaaataaatttatatatttatttaataaataacatatttatatattgtatatatttatatatgcataaatataaatatgtatatatattctccctctcattctaagaaaggatttaaggaaattaataaaagtttatagtatacaataggataaaaaatgtgtagatgaacgaattagaatgaaagcaaaataaacaaaaagccaagaaataagggtagtaccaagcaatataaattataagatcatgtacaatgactagaaataggtattaatttggccctgagcttcctagcagctaaaacaaagactgaaatataattaattacaagatttacaacatccatggaagttgctcagaagaatcgatttgaccagcattaagatctgaaagaaattctcctcgtatcctcacacagggagtccagggagatggcagaggctggcatccttgacagcatctgtaggactcctcttacattccccagctcctagaacaatgctgcagttataataattgttgatacatatttgattgattggactaggtatctgtaatcatattcatccttttgtttctttaactcattggaatctgagtcttgattttcatggttgaaatgaatgacagcctattttgatgtgagccaaggtgctgagtatttggtgatgccatgaggcctttcttctcttgtctgtctccttcttctgaccattctctggtgggttcgcctcattctccagtcttttctccctccatctgaagtcaggaatggggttgaggatgctgttgttactctggttattatccccaggaacagggttaatggaaccagagagattcaggtaaacaatggttagaatggagatgctgagaggctaagatgggatgccagaatggaaggttctgatgctgcagtccttaaaaatgaaagttctgagggaatatgacttcagcctataaagctggagggggctgagtgttatgaatatttggcttacctcatcctggcaccaaaaacatcccctcaggtaaaaggaatacatttactacaaataaaagtattgcttgatgtacattttaagcatatgagaggattactcccaaagatagaagtgaaaagagaaatattcccatttattaactgaattaattaaatgtccactgcataccggtcctctgctaaatgtgggaattcagagtgaaagaggtcatttctggaatcaagaaactgacagtctggtggaggaacagacagtttagtatatcataggttaagtctccctagtgagcaggttctgagtaatttggaagtagaggaatggtacctaacaaactggcacaggggcagcacctgcctggcatcggatgggcctctctctagcctttccatggtggccatttttaatggatcacagcacccttgtcacggggcctgaaaggagtgcagatgcaggtccttctccacacagtgctccagcaaccactacctcgtcccccggagttagccctagaagaaattggttttctatttctgatctcccactcagtctcctaagagagcaagtctatgatggaaacttgggagagatggagaagaggggcatgtaaggaaaaaaaaaattagcttgtgtaaaggtaggaaggagagagagcatgccactttggggactttgtgtgtgcttcagcatgagtagagagtgggtgtgagagaggaagagtctgaggtaaggcccaagaggtaacaggggcaagaccacagagggtcatatttgtcatcttaagcccatatttgtcattctggcattggtttagcaggcagtagggagtcattggaaatgtgagggttgtggcgtggttggatggaagtgaaggaggaattggagcagggggaggctggagtcagcatgatagttattcagaaatgttgcagaactttacttaggcagagggaggaggctagagagagtagctttgaggaggaagactggactggacagagaaacagtggacgcagagggtagtggagtgcaaaggctctgggatgatgccaaggtttcagaagactgactacacagactacaggtcccactggcatgctctttctttgtcttcttttgaatgtagctttgccactctagatgggagaaaatgcagctggtcattgatggctgtggcttttctcctacacccttgctgggcagaggtgatgcttttcccacctgttcctgaggatggcttgcagaaatcctgctaattctctctgctgcactgctttccctcaaagaaggctccggctccgtggagaccaggggctgggtggaaaggaagaggccagccaagctgtcatgggaatttggtgactcatttcatcagtttactgctctgaaaatgaggtgacttccccctttgcttgacaactgattgatgaacatttcctgagtatttgcagaatagatgttttgcctcatgggccttcatgtttatgtgctcccagtggattctaatcctggtgtgcttcagcctttcccacttctcagctgctaatttttctttctatgtagagtcttcagattacctgcccaagacttaatagaatgcaggattagaaacagtataccgttatgcctgctgatacaactctggttacgttgactttttgccagaatgttaaagaatgaaggatacctttttacactgaaacagtatttatttggctaaaaacactgtcacctggtacttagtgtgtctacattgaaagctgtctttcaaagtagcgtacttcattttgtgtgtctagaatttcttgttttgtttttagtttttactttcttccccaagatgtgggtttatgtgtttttagaagaattagctttactttgtttccatttttcctgatgctcttgatagtgaaggaatcagctttggaaaacattaattgctccactaaataatggaatcttaatacaagttacatagcgagaagtggaagcattgcttttaggccccaagaatagaccttaggctcattttccataactgaaatggaagcaataggtttgcattatgtggatcagagtcatcatcttagacactagccatagtccgtagatttaattttcatatttcaaatggaggctgtaagtttaacatgtcttactttgcagctggaacagattctatttttaatccgtaagttgcatatggcatggagccatgtgctgcccagatccaaatgcataactcctgttgatatcagtgagcttcatgatgaattggaaagaactatgtggtctttgttccaaacatctatctgactttttaggattaaacgtgctaaacaaattctagcacttttcaagttcaaatggagtgtttttgaatgtagcaaccatgctggcttaaaggaataatgcaacaattccaaatagacacacgcacacataaccgtagaattggttttcaggcagagaaaggcaactgggctcaggaacctggctggcatagtaaaggacatggttgtattgagctacacaaaattgcctttaaatagaaaagataagaggagaaagccttttctttggatggtactctgctcatcagggtacacattattgttggtgagtaactctagcaagagccctcttgtacttcctcattcttatgaccgcaatggtgggaattgtctggcaatattcattcagaactgacagatgtttgcatctataaataaatgtactcaaatcataattgttataacaagattgtttgattacctggcaatggccttgtgctgagatagcttttggatcacctgttctttgggaacatttgacagacctcatgtttattacccaattggatgtcagtagcaattgcagctaaagaaaaaacaaaaatgcaagtacttgttgaccttgacttttttccacaagagattggacttgatggctctattgcagttgagctgataagggctataaacagtagtttaaagaaaatgttttattcccagaggaaaacaccctatttgctgtgggaaatggcaatagacatatacgccttttgccagattttcttaatttacctttatttgggctgtgggaaaaggatatgctggaaaagctttttatggctttaatgtacatttgcatagattgttataatttgtgaatggtgtagttagtatattgaatacaatttaaaagaagccaatgatgtttctatgatttatgataatatgatttttttgaaactgtcatgttagtataagattgtgtttcagagatgaagatcttataaaaatgcaatagacttatggtgccaaaatgctctttttgattttaattaaaaacataaaagtgtcattggttaatatgatctcactaggagcaaagaaagaaaattgatccagtgaatatttacatgggacattccagaaatgcactgggggataaggcaatcagcacttttctttaggcacaaagtcttaagctccagatttgaatcaagaagccccgggccatgaaggattccccatttcttggtgagacagtaaggctcggtaacctgccctatttgctctttaaaaatctcactgcattttccttcagaggagaggtgctttggctcaatgccactgacttcaacttttgctcttaaaatgttgttttgatgcatagtgtagtgatggctgaattgatttctgtgcataaacggtggcctagattcttgccctgtggaaatccatggaattaagaactctaggttcctggagtgataagaggtaagcaaatgattagatatgcatgcagggaaaaaattcaaatgctcatagaatagaaataagggtctatataatttgcaagtttaatgtaaatgcaagccactaatacaaccaataatttaatgctaatatgtgaggataagtaaatgttattctaattatttcctatttggtgtgttctcaaagagttctgagcaaaaaatatactgcattgaaatatttccctggctactcaggatgaaaatgtggtctactaacagctgtggccataatgaaacctctgggatactagtgactaaaatttctctttagatagaagtttgggacaatttgagatggcagaatctaagccagagtttctttcaaggagatttagcacactgggatattatgtgatttatccaatgaaggtacaggctgagatctagctcaatatgcccttttaagtagtcactagaattatttaataatgcagaatatatttttggtaaaaagatttgatctttttgtctgtttttcaaagtgcaaatttcctcctgaagatagacaagtcttgggtacgtttttgtgagaacagaccctttgaatgaaattttaaaaccatcagaaagtcataacatgtataatcaatagggaatttcttgctgtctaagaaaacgataggaaagaagagttccactctctccagtcttctttgctaagtctcatttctctacttgtgcatttctttggagaataactgcttgctgacttctactttcctatgaaacttttgtgaagaatggtggaaatctttgcaatgacagatgccattgcagattattatgatgtccattacttggagaatgaaattaggaagagtttatttctgacatggcacatacccttccctgcaacagaaagactgtagcctagaatctctgttaaaaaaaaaaacaaaaaaacaaaaaaacacatcctcaggatttctggtgattctctggttgatgtggtagaaatgagcagagaggcaagtctgctgcctcaggcatcctgatcccctgcagcaggagggcacccaggacatgtaagctcaggttccttttggctgcatgagcagggaaagtggaaggcagggtatcctacattcttcctactactcactgaaggatgtggcaagggcatgaattgtttgtggttggctctctattctggtgctaggaaagacttctgtgtttatctgcatctttctaagcccccattgctatgtagccagctcccaggccactttgtgggaaagctttctttgtgatggatgacgtggcatttcttgtcacttcctcaaattccttcctgctgcctatcagcattgctctggacttatctgggttgagcttcagccagctaaagctaatccaggttcctatttcagaggagcaaaatgacagcaatgacgctgccattcttttggtttgtgacctaggatgctggggagaaagagcaaaaagaggagggttgcaagagttggggcctgttggcttgatttttcaatcctggtaccttgagcatctctttattctcatgagtcttgcctctccataaggctgacagtattatttattttcatgtgcagttggatgtaacttttccaactctgacctgaagtggcatttacctgagattggttttattccatctactgaagttggcgctgacaattttgagcctcttaaatgaagtcttatgaaatggagtttagaggatcagagacttgtggctctttaggtctgatatttctttttttttttttttttttttttgagacggagtcttgctctgttgccaggccggagtgcggtggcgtgatctcggcttactgcaacctccgccttccagtttcaagtgattctcctgcctcagcctcccgagtagctgggattacaggtgcacaccaccacacaccacacccagctaatttttgtgtttttagtagagacggggtttcaccatgttggccaggatggtctcaatctcttgaccttgtgatctgcctacgtcggcctcccaaagtggtgggattgcaggtgtgagccaccatgcccagtgatattccattatttaataaatatatttactgaaaatctactatgtgccaggtacaatgctaggtgggaaatttttcaaacaaataactcatttttcatgcattcagattctgaaatgtgcccaccctcgttcatttgtgagcctcacaccaccacccttatggtggagcagagattggtgtctctatttcataggtgagaataacctaaggcctgacagggtgtgagtgagaaaacaacaggacctaagtcagtcaggtttctcaattgcaacaattttcttttttaccaggttaagaagtaacctagtaactgatatctttttggttcatttatttttgaaatgtgtctaccagttctctctctctgtctctcgttagaaagagagaatacagaatgacatatgaggaaggatctttagaagaaagtgatcaggcactgcttagcattatatttcttgcattcatttattcattcacggagacccttctgtatagagggcattgtgctaagctctgggatgacagaaatgagtaagaccaatccctgtcctcaaggaattggtagtccagtgtttgtttctccctttacccctgaattgagaactgtctggaacacacatatttcccaatgttgctctctttaggagttacctgctgtctcattcaatattcctgatgccatctagtgatattcaggcatgagggggcttcagtgtaggatcagaatggaagcaacccaatattggtctctactcatggagaacaggcttttaataaatcagatttctacgtgagatggtttgacttttttggacacaggaacagcctaaactcacccataaaatggaagtagtattagtacctacttataggactgctgagaacattaaacaagttaatatatagaattttgaaccatacctggcaatggtaagcattatgtatgtgttagctgctgtcattaccacatcatcattatcagctgattaatttttctctgtggaaaaagagattctgcttaggactggtgtccatttctaaggggagttatgcttatttttttttttttgtcttttttttttttgtctttttgtggagaacggggtctcgctatattgcccaggcaggtctcgaactcctgagctcaagctatcctcctgcctcttgcctccctgagagctgggattacaggcgtgagccaccgcgcccggctggactggtgtccatttctaaatgtgagtgatgccttccaagaaattgagaatctagtattattcccaaatatatatttattttacaacgaagactgtttggctgcccttttgtgtcaggacagagggcattgtaaacttggtgggccatcaagattttcactcttataggactcccttccactgtccatcactctgaaatgttccacaggtctgctacttttacctgaggaggcagtgatgaggaagtgaatggttgagaagggacgcagactgataaaattcttaccacaaggccttgggtctactggattccttttaaacaactgcttatgttccttctataccacacattaaagtgtctgtgagaaaatgaagtttgtggtgtcagttaagattacaggttgaatggcatacctcttcttgatggtcagattgggttaaggttgagtgtccttgggggtcctaggtggaatttcctcacaggagccaagttaggatggggaatatatttggccactaacaaagtttcttcttgtgtctctggtctcatctggtcacaataacctttggtttttgatgaagctattgggtagtctggcctttgaatttcagtacatcaatgttactggtaaatcttaagatatggaaagataatccttagcattatggataaactttaccaagtattccagatatcttgagaactaggtttgtgacaattgcagttggtaaaataaggtttaaaatacctcttgcctattaattgcgactagaaaagtttgattctggtaagttatggggaagcaaaactagatttatagggagggttttatttgtttataagaaatcaactttaccacttttttcatctaccaaatgactcgaaggtgctgactacccgctcaccctctctgcctcatctggttatgtctttttctcttttttatgtgtacagtgttgtagcatagttatgatgagagcacagagagcccatttcctattttgactatcttcctttatttttctattcattctctcatgacatagcaaagtgcttaaattttttatattagctgcaagcccatttatcccttctcaagggattataggtggttttctaacaatcaaacatgatcccattccttttttacaaaaggaattttctttctttctttctttcttttatttatttattttttttgagatggagtttcacttttgtggcccaggctggagtgcaatggcacaattttggctcactgcaacctctccctcctgggttcaagcaattctcctgcctcagcctcccaaatagctgggattataggaatgcaccaccacacctggctaattttttttatttttggtagagacaagattttgccatgttggttaggctggtctcgaactcctgacctctggtgatccaccagccttggcctgccaaagtgctgggattacaggcatgagccactgcgcctggccaaaaagggaatttctaatacttgtggtgatgactctgttctgttggggcaccatacagtgaaaatgtccaaagatcctcatactacagcctaggatggtacatagaaaatttaaaatataggacgagattttttttggggggaagttttatgtaacttactctatacaggtgtgagatgatttttttgttgttgtttaaccattttttctttattgttggcttatatatatatacacatatgattttttattaatatactttaagttctgggatacatgtgcagaacctgcgggtttgttacataggtatacatgtcccatggtggtttgctgcacccatcaacccatcaacccatcatctacattaggtatttctcctaacactatccctccccttgcaccccaccccgacaggccccactgtgtgatatttccctccctgtgcccatatgttctcattgttcacctcccacttatgagtgagaacatgtggtgtttagttttctgttcctgtgttagtttgctgacaatgatggtttccagcttcatccatgtccctgcgaaggacatgaactcatccttttttatggatgcatagtattccatggtgtgtatgtgccacattttctttatcctacattgatgggcatttgggttggttccaagtctttgctattgtgaatagtgctgcagtaaacatgtgtgtgcatgtgtctttatagtagaatgatttataatcctttgggaatatacccagtaatgggattgctggatcaaatggtatttctagttctagatccttgaggaatcaccacactgtcttccacaatggttgaattagtttacagtcctaccaacagtgtaaaatcattcctatttctctacatcctctccagcacctgttgtttcctgactttttaatgattggcattctaactggtgtgaggtggtatctcactgtggttttgatttgcattcctctaatgaccagtgatgatgagcttttttcatatgtttgttggccacataaatgtcctcttttgaaaagtgtctgttcatatccttcacccactttttcatgggattgtgtttttttcttgtaaatttgtttaagttccttctagattctggatattagccctttgtcagatggatagattgcaaaaatcttctcccattctgtaggttgtcttttcactctgaggatagtttcttttgctgtacagaagctcttcagtttaattagatcccatttgtctattttggcttttgttgccattgcttttggtgttttagtcagaaactctttgcccatgccagtgtcctgaatgttatcgcctaggttttcttctagggtttttatggttttaggtcctatgtttaaatctttaatccatctggagtaaatttttgtataaggtgtaaggaagggatccagtttcagttttctgcatatgggtagccagttttcccaacaccatttattaaatagggacttctttccccactgcttgtttttgtcaggtttgtcaaagatcagatggttgtagaggtgtggtgttatttctgaggcctctgttctgttccattggtctatatatctgctttggtaccagtaccatgctgttttggttactgtagccttgtagcatagtttgaagtcaggtagtgtgatgcctccagctttgttctttttgcctaggattgtcttggctatacaggctcttttttggttccatatgaaatttaaaatagttttcttctaattctgtgaagaaagtcaatggtagcttgatgggaatagcattgaatctataaattactttgggcagtatggccatattcacgatattgattcttcctatccgtgagcatggaatgtttttccatttgtttgtgtcctttcttattttcttgagcagtggtttgtagttctccttgaagaggtccttcacatcccttgtaagttgtatttctaggtattttattctttttgtagcagttgtgaatgggagtttgctcatgatttgggtctctgtctattattggtgtatatgaatgcttatgattttgcacattgactttgtatcctgagactttgctgaagttgcttatcagcttaaggagtttttaggctgagacgatggggttttctaaatatacaatcatgtcatctgcaaacagagataatttgacttcctctgttcctatttgaataccctttatttctttctcttgcctgattgtcctggccagaacttccaatactgtgttgaataggagtggtgagagagggcatccttgaaaaataggacaagatttgtgaagcattgcattgacattcttttctacatatcattttttagcatttccgcaattttttattatgaatgttttcatacacgcagaaaaatagaacaagttgtacaataaacacctgtaactcaccattccgtttcaacaattgttaacattttgccatgtttctttgtctatatacatggatacacacacatatatgtatatattaccatgtgttcttcatcagtgaaaaaagaatatttaggaatccatggatttctgaggagatagatatttcagctatacctatattccccatcaaactgtttaaccacttattttggtgtcttggaaacaaatactgaaacatttgcattcagaatacagttgtgtttgactctatgcaaagatcagctcgtggtgatcagtgtctattttaagtaattggttatgtgtatttcattctgggaactcctgagtgtccttctaagaggacctgtggccaactttgaagacttgctgtccttgaaatacaggttgtatccctacttcgtaacttacaagccatgtgctctagcttgtaaataaagtaaattgagctaggtgattgaatgtttcccgtcacttctaaacgactgaaattctaagaaccaagttgaaagtttgcttacaaacctagctagaatgaagaacctttcagaaacattttacatatagattgaagtatgctgaaggtcagttaagttccacataatttcatggtcaatgagaagaaattctgaatctaggacttagcgtcagtaatagccatcaaaaagtacaaaaccttaatacccgagtttcctgaatatctgggtgcaaagtggtattacagatttgattcttttgcatacaaatatggctgaaaagttccaaatgcatatcagcttttttgttagactttggatatgtaagtgctttatttggttattactaaaatttcccagtgatttgtgtatttaactatttgtcttctgctttttttctccagtatactttatctatgctgatggaagagtgtgggtcaggaattactggtataaacagattaatatgtcccatcaaaagaaagaccattttagttatatcatgtatgaggtcaccttacatggtttgtgaagggttttcatgtttttctccttggatgaaatatatacttctgagaataatatgactacatcaaataaacaatgagctggctaggtgcagtggctcaagcctgtaatcccagcactttgggaggctgaggcaggcggatcacaaggtcaggagatcaagaccatcctggccaacacagtgaaaccctgtctctactaaaaatacaaaaaattagccgggcatggtggtgggcgcctgtagtcccagctactcgggaggctgaggcaggagaatggcatgaacccgggaggcagagcttgcagtgagccgagatcgcgccactgcactccagcctaggcgacaaagcgagactccatctcaaaaaaagaaaaaaatctattggtaaaaagcagctgacaatatcagcatttgtttattatcttggatttaatctgttgataacaaggtgaatatatctgtcccagcacacaaggataagagaaaacttcagtctgatattggctagtgaaaatttcagcaaaatccttttagtataacatctgccttaataaatggcattaaaagcggggaggtaaagaggatggaggcattctctcttccaaatgtaaatatactgctgcttacctgtcaatcttatgttttctaagttaattcttcctaaagttttttgtttttaactatttgatgagaagattacactgctacaggccaactaaatgggatgtattatttgaacctcttccattgtttttaaaatcattgtttgtgttgtaatcctttcaaagagccagccagtagctgctttcctgtttaaagagtaagctctttccattggcagatcaccttcatttaatcctctgaaagtgcacacttaattcttagcaacaatgcatttttagcaccaaggacatattaccaagaaaaactgaatatggcaaacaagtagaaaaatacgccttagttgtctaagaaggtaattgtgtcttgcttttggagtcttataaatatccctcttggtacaattagcctctgtaaatatttgaactcctttgtagttgaaacactctatatttcaacaggcagatgaaggacagtttttcaggttgattcttaatatagtagacttacattttattgttggccacactttaggattttattgcattaaaatgtatctgtgattgttaatataaaacttcaatcaacttgcttaaatattggaagctctcaggatgtggaataagcatggcattgtggagaatatcaccctggcccgagtcaagtgcacagtgctgcaaaagcattgtgctaattttagcttacaaagaggatgaagataaactgcctactgctagtttgccatatgctatcctggtgataatattcaagtgcaaaatattccatagagagccttattgtttcagcaagggaagcctggataagagttaagcaaatttctcctcagtaagtttataagaaataatgaagtaaaacaattctcaaatgcaggtagatgaaatctgctaaatttattttggctttattgactttcatgggagttgacagaattagttttggtttatatttgattcaattttatctatttttcacatgtaaatcttaaaaatcaatctgaataaatattgatctctttcagagaggcaaaaatatagtttggattgcataaaactgcttaaaagacagcatcccttgaagttcaataaaggaataaagcaatctgttcaactggttttaaaataacactttaaaaagcctttttaaaaatgaaaaagtcaaaatccattacatttccatatttggcaaattcagcgtctacagtttcaccgaagagtgtttgacctatttatttgtcactgagaccacttcacagtgaagggattgttagttcctgcaaaactgagaaaaatccaatgtgcatagcgcatttgcagatggaaacagactgtgtagccggatttggagggtgggttggctggaagctttgtgttaacaactggtgaaaagcttgacctttgcgtgacctaggtcaaacaaacccccaactcaagagctctcctttgacatggatacctgtttggggaaggggccaaaaaagggaatggagataaaattatgttatggacttgcaagcttactttttaaaaagttctagttaacttgactgtttggggacatggtggccattttagggtgttataaaggaccacaaatctgtttgtaagtgtcaaagggaaagggtgatagggagacctttctttttttctttctttcaatgattcaagccatgcataggttttttcccccattgcaatatgatctgggttgtgattcacagagttgaatgaatgggctgaactccactgatgaaaacatttgataatgtgtaaaataaaagccctggcaaggaggagatggcaaagcttccattgtttgtccccacactttgtttttataggggattctcacaggaacaaataaattggagtaaataaaagcaaaatagcactgttagtccatatcgggactttgcacatgctcacaagtcaactttggcaggaaactagcaaaggtctgttccctaccatttgcgttgcatctttatctctccggttcattgtttgccactgagtgcttaaacctcaacttcccaagtaaaagcttcctgttgcttgcttttaaatatagttttgttacaacaacaagaaaaaaaaaatggagaaatgtattaaggaagccaaccaatggaaaaaaaaaagagaataaaacaggcctagtccaatgcaactacaaaccttcagggctcaaagcacacactgctgggtactcttgatgcaataatagtccccttttaggtataaacctataggaaccatctctatgcccccacaataggtcaaaagtgaagcagaaccatgaaaatgtccagtgtttctcacattggccctttggctgtatttggtttcacttagttttcactttgcagtgttgtctgtggatggaattttctgccctttcaattgcaggttaaaggaaatcccattctttattaattgtgctcttgctttgagatcctttaatgtcagtatatctgaaaaatggtatccattcctatagaaaatatggttcttattccaccttaatgggtgggggctactctgatacttcctgcaatttcagaggaaagtgcagcagttttctcaggccttggatataaacaacattgtttacgctgtttccactctcttcatcctctgtttgtacaggccctaaaacaagtgggtctgttttgcatttaaaaaaattagtgtatgttttcagaatcaatctatcaagtgaggccaagaaatgccataagaacacatgggtgggggttagcaaattctggctttcaaaactgacttgacagccatttaaaatgctggctctacattcacagagtgtgtggggcttcgtacactcccttaattccacaatggagacagttgatttgggtccctcttccctgcttattgcatgatataaggacagctgcacccagaaaattattagcaccgtccaaatgattcttttcaaagggaacttctgttgtgctaaaatacacacagcattgtgaaagtacagtttattgtagatatttaataaggaatctgttatcaatcactggtagtacagggaattaaaatttatggaacagtagctaattaaaacaggaaaagtgtgagcgttcacttgtgtgtgtgtgtgtgtgtgtctgcttgcatgtgtgggtgtgagcgaggaattcctagtggaggggggctagagggggttcctctattacatgcatactggagagtcttcatgaacacccttgcagtcctacaagaacagatgagacagacagctgaccaggcagccatgaacctttccgtctgtgtgaactgtcaccgtgcttatagacacaactccacatgttccgtagaagttggaaaatagaatgtgcctgcagattgtttgggcctgtgagtacaggattcaaacctccttagcagattgctagattgagactctgggtggatgctgaggtctcaagtctcagttcagcttggtttgctgcactgaactcagcacacacatggtcgataactctttcacttggctgccctctctaccctgcactggagaaactgcctcctgggcaactaagctaagaaagctgttgctctcatctggctggtttcagaaggagaaggatgtcaggagtatgcaaaagcttgtttctttgtgcaagtcttcagctgattctgagttgagtattcagcttgttctttcttggagactcctacagcagaggcccctgagaagtccttggttgtttgtgcagatctggctgttccattctgatgcacaggtattccacatgggtgctaggaaaaagtgtggttacaaagtggctctgggtcatttggaataaatcagttggacaactctttttttgttgttttattcaggacactggaagtttgtctcattgctttaatgagagttgcatcttcttagttatgctgttgaacacatctggggcctgttactgcacccttactcttagataaattgtagcacccatgcccacacaggtagacctcctaccttcataaagggaagtcagaggaagctgataccccactcaggtggcctttaaatttgaggggcggactttgggaccatgttgcttggcaacaaataacatatagcaaaaacaaacacataaagatatgacccatgatattcaaactttaaattctataacactagtttgcttaagatatcagctgctatacggtaaagtttttaaggcagctgtaatttgcggaaatgctggcatttactttttccatagtcttatcttgaaggcataaattggaactaaatctgggttcaagccccttctcatttctctggtactcttccagtaatatagttaacatttggataaggacgcatattatgattctatctatagttatttaccctctcccagtttaacatgaagccttgctagcttcctaactataatatttccaccttattttttagttatgtgttggaccctgagttgtcttaaggactgaggaatttaagactcattaatatttttattagtgttatttccttataaatgaattatccctttcagctaactatatctttagaaaatgatcttggttttcttccatcatcatatcaataataataaaattagctaagaagttgtaattactcttcctatattctctgtgatgtgcttaaatagaatatccacttattatgatgttaatttccatttattacaaatgagcaggaacaaaatgttcctaactgtctgactccaccttttcctgcacattatgactcccctataagtaaaccacacagcccactatcgtatgttctctaatgtactttctaataaataaagccagcttaaaaaaagatgttattcattacatgtaaaatgatcatttgaattgcttttactctgagtgacccatgcatcacttaatcagacccatttaaacagagagagaaagagaatatgagaactgagtgatctgtctgtatttcatttggtggcaatatgggcagaatttagtctaagaatgattctttagccatctaattgtttcctgaaaaaaaagtcttatcttcagcatatataggtggtggtatgatgggctgtatagaaatataagtttaatctgactagtgaagatcatacttcatcagttcacttgtgacaaaaaaagagtggcatgatctcaaagttgttctcagccttctcactcctttcaatcagttgaatcaacaaatcgatcacttgttccatatgtaatagctctccccgtgtagaaatgaagagttagcaaacctctagaatgcaagaccaaattctttgttaaagttttcttataatgaattctgtctattccgcatatatggaaaaactcagggtaagacacttaactttttttctgtagagaaacgaaagctgtaaaggcaaaggtatttttctactgcctccccttcccacaaaccactgtattactctaaagaaatttattatctcaatctgctattcatctaacaaactccaactgcctgctagtaccaggccctgaggaaatacaatactgaacaagactcatttactatgctcaaagagcttatagtctggtaggaatgctgcatataaacaggccgtgtaaaggtggtgtaatatcagctataattcgcacatggaaaatgcacctacctctgtattggaggatcccggaggaagttctcccatagtcagggaatgttttacagtacttcatgttttcccaagaactttcacatatatgatctcgcttgttcctcataacacccctttgaattagccagttccttatcaccatcacgtctttgtgggtagaagaaggaaggctcagcaaattgagtcacttcatgaagagtacccagaccgacctgagactgaggacccaggttctgaccttaaggttagtcatgaatgcatatgtttggggaagtaggggaacttggaaagacgagaaatagtggcccggtgttgcgaaattactgtttgaccatctggaaatttgcccctggttcacagccaggtttcagaagacatggaacaatcattccacattcacatagcctaagcacagattcagaatgcccactttccctcttctgaccttttttttttttttttttttttttttttaaactaaggaaaagaagcaagtctagaagacaggcaattagcatgatcactcaggccagtttttataattttggttttcatccaaactagtcacatttcatacttttaaagtttttaggcttttctgctggagatcatcttcctcacactgtgattcttaaaggttatgtattttttttaccctgatcatacttacgtcttttgacaagagagaagacggacatccagctttgggtctgcagtgatccatcattcaacttccggtctttttcatcatattagattgtgctagtacttgctctttccttaagctatctccattacaggagggggaacttattgccccaaatataacagagatgcctgacttatggagagttacttcagagatgtttctggaagaaagagttctttgggtataaatgagaaacaaggggacagttgtgtttcccacaccatattttggtatctagcatgtaaattatactctcatagaccacctggatctgaatggctgcgatctggggccctttcccagttttgcatggcagatgaggaaaatgcaggaaacgctgaggctttgaagatgtgctagaacctcagcaacacagagccactgagcagcaagaggaggctgagacagggcagaaacacccccactgttaagagtgatgagggtttggagcacctaatctggatctagaaattggccgctgtgcaggcagctgggtggttcaagatctagcacccaaagagtgtagcaagttcaggcctgggcatttcggcataaccagtctggtaggtggggccagcaagaaggaattctaggccacaggccaattcagaagtcaggcaggcctacgattggtattcggagatctgtttgggaagagatgatcatccctccagctggcagcacaggagagcagtattcagttctggggaaagaaagggctgggccaggggaggggaagagagattcccagccagctgatgttggagagaagactagatccagaagaggaccaagagcagagaaggaagtaattccttggtttctgtgacttctttctcacccaagatagatttcaggttagcacactgtgacgtcatcactgaaaacctctcccctcccctcgggcgtggggggcagtgtgtgactgttctttactccaggctggtgattcaggaggcagccttgtttgtgtttccgtatgcctcctgcaggggagacttgcttttctttgatacataaatggtgagtgaaaagtaactctcctgtgagcttggtctcttttttgctcttctctggtcgagcagcctgaccaggcctggtcagtgtgaattgcccaatttcatagtgtgcacgggggtctcaggagagggcaattgcctcataacttttctattagcagaatttcagattcctgacgtggagcgatacttgaaaaccatttgcgtgatgctgggaaatgtttgctttgtccttctttatgtcctaggcatgggcatttttgtcatttcactggggactacttgtaggctctgaaagcaggaaggggcttctctcaggccatgccctagctaagcgaggattcccctctgtatttggatagctggttgctcaagttccaacccttacatgaggtttttctgtatgattttctcctttatgttttggaggcacactcgggaacgttctcgtttttttttgtttgttttgcaatgtggctatttttgactttacaaagcattggaactggcatcctcccattcttgtgaactttctctggatctgtaaatacttggtatttgttttcttccttgtacatttcaggggtggtttttatatttaactttgactaagatacactcacatgctactctgagagtacatgcttcggtgtctcttttttctttgccttcagtaaaaaggataagattcagggaaggtttatgaactcactttatgggtcagacatgtgctggctgtggagagcatacagcaataagaaaggactgtctctaccctcagatacctttctagaggttaaagaaatgcaccttgatcattatcattgtctctaatggagtaaatggaaagggtagtggtagaatggttaggagtttagcctcaagtcagatctgggttgaatccacaaggatttgtattccttatctgtatagcagcctatttccttatctgtgcattagggacattcaaaggattaaatgagatacttcagaaaagcaaggattgtgagaattaattgatcaaagatcaatgccaatctcagtttctggtatctagtaagtgctcaataaatgttagtttttagtactgtttctattattcttattgtctagagaagagatggaaagttagtcctgtttttcggtagtgtgtctcacttttcctggatctgaaagatactttcttaaatgatataacttttttccttatcagtaaaacaaaaatctttgctgttaaaaactgctgcagaggcttggcatggtggctcatgcctgtaattccagcactttaggaggctgagacaggagatttgcttaagcttaggacttcgagagcagcccaggcaacatgtgagactccatctctaaaataagatgaataacataaaaaattaaaactgctgcagaaatattatttagaaggcagagggtgagttatcataaattaacctattttgtgtgggaaatgaaaacttgtactagtaaaaattgctttccaatgtatcctcatccaccaattggctgccagcttaatgtgatgggactatttaggcagcactgccacccattgttactctgaagcacacttgcaaagttccaagtcactttacaaggctttttttggggggctgtgggggaagaaaaagaaaacaatagaaaaaaaatggtatgccatgttaggagagtgggtatagatattttggaaaagacttctaggaatgggaatgggatggggagaggtgacaagagtagcaatggtcattttggagctttgagtgggggattcagattaatgttcccctgttcaaatggtgtactcactagcaaaacaaacataagaactcacattcgctgagctaagccactgctgccaaacgatgcgcgaaacatttttatatagctgattttatttcatctgccccacaactctaaggtgtaagtactattactaggttcattgtttccagaggggtgaaacggggctttggagaggttaaataacttgcccagggtcacacagctattaagtggtaaagctgggatttacatgagcccagacaaagaacccaagaagctaagctattctcttgtaatacctccaacataggaggcaagaagtgaggtattatacaggttgaggagataaaggggagagaggcctgcagtgctaacaggaggagctgggattcatcctggcttgttctgataggtcagttagtcttagagatacccatgaggtcacctactcaaaatggggctcagagtagccttgtcccattcttgtccagtgggcgcagctacagtcttcctggcctggagtgactggaggctgtccccacgtcccacttcagtgaggcattcatgtgcacccagcacactttctagctttatttgcctggaggggaagattctccagaaccttgttaagatgcacagtgtggtccttggactggcagtgtggcctcggcagtccctgggagcttgttaggaatgcagaatctcaagctcctccctactgaatctaaagctgcattttaacaagatcccagctgtttcgtatgcacatgaaagtttgagcagcactgctctagaaagttacttttatctttactgtgcccaccaaagtaatcaaactttgtgaagtacgattattttcaaacaagcctacgtccctgactaaccgagtggaaggtgtgagtggcactacaaattcacaaaagaactgtagcctcagataatcaaaggagagaaggtcagatgcaatcactgatgcatgctagtaattctcaaaccttcgttttcagaaacgattggattttcagatagatttgcagtaagagaataacaagtctttatttttttcatcccaacttctttcttgcacatttttcttctagctatatttaatatctgttctccccacacacttgctaatctacatttcacaatcttcttccacttcactttgtctgcaaagaaatctacctggacagaatagcatctctttttttccccctgacccttggcatttcctctccctccaacttctgcctgatcctaggatggactctctcatccctcattctctatcattagctctcaggctgcccttcctgcactttaccttcccccacaccttcttacaggaaagcagaatagaaaggcatcagtgagggatgaacaggagagtgccttgagagaagattcccaggaagacagggagagccagacagtggactggttgcaacccatgtagccgaatcatagtgctcattgctgtggaggctctggtctgtctagccacacagaccagtgaagtgagggtacataggttaaaaaaaaaaaaaaaaagcttctacagaatacagacatgttatcctggtgtgtcaatcaggaaagatgtggtccggatgaacagaattgtacctttttaaatattataacttttagggacattcttgatgaaaatgtttccactctatacataactctctcatatctgattataacacttaaaaaataatttaaagtcagtggacatatgagtttatgcactgtgctatatatttccttatttacacagcctgttaagcatttatatggctttttttcctatgctaaaagggccttgtgtgcaatgccttttaggttcttgtcttttgcctctttatcatcttatacttttacaaagctctcagcctacaaactatgaggccagaagctagatgagcaaacttgagaactgcatctaaattaaatgtaactgttcttcaattgagggtcttatgatcatttctctgtagaaagtatacgagctttaccacatataatctatgattgtaatctattggttcttaagcttggctgtatgttataatcaacttggagctttaacagtcactaatgctgaaatcttaccccacctcccaaactgatttaattggtcttgagtgcagtgtaggcatcaggatttgtaaaagctaccacatgatttaaatgtagcccatgttgaaaagcactccttctaatctggatgtcagaaagctttttaaatttttatttatttatttattttttattgagatggagtctcgctctgttacccaggctggagtgcagtggctcgatctccacttgctgcaagctccgcctctcaggttcaagggattctcctgcctcagcctcccgagtagctgggattacaggcatgcatcaccacgtccagctaagttttgtatttttagtagaggcagagtttcaccatcttggccaggctggtctagaactcctgacctcaagtgatctgctcgcctcagcctccaaaagtgctgggattacaggcatgagccaccgtgcccggccagcttttttatttttcaaatcctgcttttcaagtgtattttatttaattgagtttgttgaaaaagtgacctcagataaataaatgctatcttgttgtgtaaaagtgtttgtatatacacacatatatacatgcatagcaaatacatatgcagagtaatatagaagtttaaaactaaattacatagcaagcttttgcagatatcacaaaaataaatgttgtctttgtgtgtttgtgtgtgtatttgtgtttgtgtgagcatatgtgtgtgtatgtgtgtctgcctgtctgtgagatcctatatggggtactttttttcctaaaatgatctatttttgtggttatgtaggagtttatgaccattcattaatagagcatttatatgtattttggggagcatattatgagtaatgaactagcattattaaaataattttaaaaaataggcaaggtactagttctgaaaattctttctaagctgttgattcaaaataaaagtttatgacttttgtactgttttacctttgcacttgaaagtgcaaatataaaaataaagaaaatactctttatttcctgagaaaaagattgggggatttccattttattttaccaataatgtaaatgtatagatttcagtatattttgcagtgtactcacatcctgaagtttctaagactccattaaaaagttatgctgtttttgcagggattttttcagggcatttagttgtaaaaaaaaaatgctgaatagatgaaaaatgagtaaaatctgtgttttttttttctttcctattcatcattgctgtttgtcctctgtgtgtaggcaaccaatttgctgttgttcccctgaggggaattcaagtcaaaaagtaatattgaattactaggaaaaggtattcctatctcaaaagaacaaagtaaaatgattcagaaaaaaaaaaaaacttggaaaatttatccaatttcctggtgtatgttgtatgtgtccatggtactttacttctatgaacacttacataaaataaatcttaagtaaactataaatctgaacactgacaaactccaacggacaattcttaatttttatgaatgtagaaagtctgctatcttcctttaatcccatccaatgcacattcacattttgtcaatttttttttttcattctatgaaaacctagtaaatattttcattctgggtctcagttatttgatttctttccatgtttttcacccagttatgttttatacattatttatgttgaaagtgaagtgatagaagcttaattgaatgaattatttatagtaaagaagttattccacatttatttcaacagggtggaaatccctgacttataaatactcaaattgtgaatgacctagatatacatacagatgtttatatacatacagcctagatctcttacttgtatctcattgtgttacatccacagaactcatttactgtcactgcaattcctgtggaaaaacttgacgtgttcagaaacacatggcttcccaaatataggcaggggtaaatggcagggattgtgaggaaacagaggggaatagaggggaggcagaatataatgatcagtttggaaactgaccatgaactcttttataagaatggcatctgttgattaaaaaaacaaatcccaataggagctgcatgttttaaaaacctttacttattactttacctaaaattctgccatttaaagattcactcatttgcaataacagatctttcaaagatgccaacatttctgggaaggtgaggaggccatcagtcatttcacccccatccaaattagttctttgagattgcttttacctgaagtctggcttatatcaacaagcctgaaacgatggacattttgattgttgggagacgaagagggtcagttcagagcaggagaagaatgggtccaggtgaagtaaccacagtgggagggcaagagcctcttcaaagcactggagcatgtggaaactctaggggagggatactatgcagtggaaaaaagatacagaaagggaggtgctcagggcaattgcacatagtttaacatttttctagactggctctgtgcacaggaatatgagaagaaactcttcttcccccttattcttatactttcttcctgcacccagggctcagacatcagttggagctttattcacttaataattagttttactttgctgagctggctttgggacctgacagcatccacaactggcttctatgcaaaaatacatttgaaatgtccaagaggacaacttatcaattcatgtcagaatgtaatctgtgcctaaattggggtctacctgaatggactcattgcttttccattgtcccccattctttaatcttcatgatttaatcaggtgatttgttaggttgaactagaaagagactgggaaatgaggcattgtttgacaaaatttacatcatattagggcacgcaatggagaggacactcatgaccccatagatacttatgactcactaataggtcatgactctcagaaccctagggatgaacacccacaacctgctcctcttacctctccagcctcatcttgttttgctttcccaggttccagttcctccagccacacaaggccttggtatatgctgttcctttggcctggaatgctcgcctctgcccttttaggctgcccactacacgtagttgacttttctccgccctttagattttggctcaagatcactccagcctaagtgaagtcttcttgtttcacacactcatagatgtgtacttttttccaattaagagcttcagtttgcagttgtacatttattactgtaattattttgtttaactttagtgccttctaactggaaggcttgatagaaacagaaactgctgattttgttcaccatttatgtctccaagtgttggcctagtgtttgggacatcaataggttgttaaatgaatgaacgaataacaagaatgactttatgcaaaagatggttacatatatggggcattttttttttttttttttttttttttgagacggggtctagctctgtcgcccaggctggagtgcaatggcgcgatcttggctcactgcaagctctgcctcccgggttcgcgccattctcctgcctcatcctcccaagtagctgggactacactcacctgccaccatgcctggctaatttttttgtatttttggtagagacggtgtttcaccttgttagccaggatggtctcgatctcctgacctcatgatccacctgcctcggcctcccaaagagctgggattacaagtgtgagccaccgcgcccagccctatgaggcatatttttaaatgctacattttaccctttagcggaggagggggagcagtaaattcataggaagaagtattttctccaggctctgactctccatgtcttcctttaggtttctgtgatgtcaggagtccactaaagggcagaaaaaggctgtgagctcattccacactggttaacaattaacaatttctttcttttttttgagatggagtcttgctctgtcacccaggctagagtgcagtgacgcgacctcagctcactgcagcctccgcctcctgggttcaagcgattctcctgcctcagcctcccgagtagctgggattacaggtgtgcatcactgcgcctggccaatttttgtatttttttagtggagatgggctttcactatgttgggcaggctgctcttgaactcctgacatcaggtgatccacccgcctcggtctcccaaagtgctgggattatagttaatagccactgtgcccggcctattaacaatttcttgtcaccatttaagaaacctaaattctgctagaaaggaaaagcttgatggcagatctctgtggagccaactttaggaagcttattgagccatttcttgttataagtgccaataatacgtttatttaaagtttgtgtattcttaatctacagccccaccattcttagctccatcttttccgtcattgccactgctatgtctgtaccacagggcacttgttaagcctcttctagaacttagctctgccacagtaggttcccacgtctaactctttattttggtttccaaaggaaccgcttcaaattttccaggaaagctgtgggtggtaaaatatatgagaatatgccttcttttgttgttttcctttgattaactgggaatcactttgcgctaagaacaaggaagccttaaatatctatggataagagaagatacaaaagtgaggccaaggagttaacagaatcctaattaaagataaacttggatcattacctatttgtatattggctgcagagttgtatacttcatatacatatgaagtatagtgtgtttctcttgaaaatgtgtaataagacctaaggggttggccagacacagggcctaagacagataatccaagcacttggaaggctgaggcaggaggttgcttgaggccaggagtttgagaccagcctgggaaacatagtgagacccctgtctctaccaaaaattagctggtgtggtgccatgcacctgtagtcctagctactctagaggctgaggcctgaagatcccttgagcccaggagtttgaggttacagtgaactatgatcatgccactacagtacagtatgggtaacagagtgaaacactgtctcttaaaaaaggaaaaaagaaaagacttaaggggctgtattatgtcttcagggaaaagctgatacgattacttgaaaaaaaatcaaggaaagccagagttctagagttttatatatttagcatcagatatttgatgtttaaaatgccggcctgaagtttgagctgaggatcaaattgtctgcttagaaacaactgagtttctcagctatggtaaacctgggaaatgtgcaaaggggggaatataattaattaattcactgggaaaaaatgcagaaagaaacaacctttgctcagaaaagatgcacaaacagcaagaaattttagttaagtaaatgattttaaattataattgcagaaagtagtgatatatttctgaaaggctatggtagacatcataaagaattctgataccttaactcttagtccatcttttgtgcaagatgatcttaaaggtttagaagaaatatcccagctctgagaaatgtatttcttccatgttttcttatagttttttattgattttcattggtgaatatttttcaagagtttaatttagatatgtctcaaaaagaaatgtaagggatgaaaatgcaaactatggttttcttcctacagcgaaaaagatacattcatttattcattttataagcgatgaacaagtttgtacactgtacactggagtaacgccaggatttgagagcagagaggtgcatgacttggttcctgccttctcagaccctgtagtcaaatcagggaaagagatatggaaataaacagttttagcagagtgttaggatggaggaatgccagtaaaagaaaaatcacctggttggtgggtgggattggtgtgtcactaaatcagctacagtccagcaaatacctcttagaggagatggccattgagctgagctgtaaaggtcaccaggaagtttgtcatgttgttgggggaagcaagcgaagactgctgcaaggaatgggactaggataaggaaatgcaaagaggtagagagagcagtgcatggtgccatgagaacttcaagtctgctcaggaccggaggtggagctgtgagtgccagtgcgtatggggacttggcaaatactaggctggaaaaacacccaggagagagatcgtgaaaggccttccacgccaggctaagaagtataacctttattctgaaggcaaagggtagccaccaaaggattttaagtaccagggtgatatgatcagatatatgctttagaaaaatcattctggcagctattatatattctaaatgaagataaaacatctccttaagacctctgaagtattccagctggttcctgaagaagggatgtctataattcttgccatatatcctcttaacataccatagaaacattatcccacctgaattctggctaactagacttaaccatgacctggagaaataggtttggggtagttgttacatttttcctaataaccctggacatcaggcacacccagagaggccactgtaaaggaaacccagcctttccatattgatggggtgtttgtgtcagcagccactagcaaggcaggatgttctacacacttttcaaggggtgagatgccattttccctcatgtagatactctatgggagaaacatgcaagagaaaaaagaaaccttcatgttgggctttctttttgctgacaataagatcatgcaacaatatcctatttgcatgaaaatgtagccatcttacaacaggaactatacattcataagcatacttttgaatggaccatttggaaaactttttaggcacaatcgaatttatgcagtatcaagagatacaactataaatggcctgatttttgagtctaggtacgttttgggattaaacactgttcctaaacactggaagaggagaaaagtaaagtttaaagagaggatatggcccaaaactgtggagtctcaatacaaaattgtaaatgaaaatgatcttgaagtcactgtggcttccagcttggcttctagaaaaacaagggggtccacaaccttacacgttcatttgccctggcagttgaaagttcatctccttaattaggagttttgcttctatgacataaagagccctctaatagaaaacctattttatttttacctgatggcccactgacacaggaagttctgatcagttgtgatgtaaatcttaggagctgttttgggttttgttgttgcttcactctgagtaggtttaggggaacagcagtcctgagaggacaggagttagtagggagagaaaaaaaatggaagcaaggctttgacctgccggagaggagcccctgctgacacggtcagtctgacccattgaatggcctgaatacgataaatgccgctttatcctgccttgaaaggcacgagatagcacagtctaaatgcctgggcatgcttaaataggcgactcgggatgtttgagttgagagtgtttgaaatctgagctctctgacagcctgggagctgccacaggtcacctgccttgctccgtagggacaggcccaggtctcacaagaaattgtccgtagacgaattgtagtacaaattcctttctttgttggttggcctctttcactagaccatggcctataaaattttgtaaaaacaattcttaaatattatttgaaagggcaaatggcccacgctgaaaggtttgacagtttgacatatagtgcatggttttgatagctcggaaactgaaaagtgtggccaagattctccccctgctcgttagaaacctggtgtttttttaaatagtgtcttgttgctgtgcagagttcctctgctccttgaaatctgacaggcaatgagtctgctccagtgatcttaaatccttttagactaatttgtgagagagtagcaaagtactgtagctagcacctttgagtccagcatccaagaggcacagaaccaggtattgccaattaaggagccattccgataatcgtatcaaagcagattgctttagagtcttataatgcccgagcctgtgcctagagagagaggaacccagagtttcacttcaatgagggggaaaaaagagactggagtggcccggtctcatcagagcccaggaagttgcagggagaggatttctgcattagaatgttgcatatgtgcggcctgtgtgtgcgcagccccggccgctgcctctgcatagccaaaggccattttcaggagcctctggcccctcagtcactggcctgctagttaattgccacacggacttcatgacacatgggcagataatatgacattttcagtttctgtcactagcaaacgccacaacgttgcttgcactagttgctaagaagctgtcagaaaccattagcggttggctaaagtcgccctatggcatttcctcatagcatcagcaaaacgagcataaatcacccactggagcctactgctatcctaatgaggctgtaagcttgtttatggactagcatcatttttatgattatttccaccttttcagtttgccttcatttggcggcaggagaagtcagctccaggaatgaagtcactgctgacattttacaaatgtggttcagagctgctgcctgctgccgtgtggtcggccggcggttctccaagtttgtttagtgatctcaaaagtaaaaaaggaaagaaattctcgagagaccacattgaggtgactatatcaaattgcggagtgaatggaaatgctaaaggtacaattgaccatttagactttcctctgaggttgagacatttccagatcaattttcaattttagaaagtggaagaggttaaacaatttattaaaatctatgaaagtgtttgcttttagaatagtctgttttattatgctcttctccttccccatcttctccatttccctaacttgtgtcggaaaggagcagggtttattgttttaggcttttctgaacatgcaccagtatttacactggattgaaagcatttgcttccaatgaaaatcttgtcttagattacaacccagcagtgtaatttccctcccagatgggagtaaagtagctgtatttgcctaaaaacagtaggaagaacaaactgtgcattaagccaaggctgtttttggcttgagctaatgatgtaatagaaaccttttattcaggagaggtcactgccagggactgaagggggtgatctggctcctgcttgaaaggtttctccattgtatctacataagtcttcacttaaaaaattctgttcctaatgcttctgctttcatacagcagaaataaacaggaaaggttctggtgagtgttacacatggaatgcagaaagccttcctctcctaatggagtatataattcaggtgccctcaaggcacgctttcaggaattcttttgcctgaggtaatgggaagctaaggttgctttaaggccttgattatctattgatgcacaaagctggaaaaaagtcatctctgctggattatagtagatatttccataaattatcaatgaattctcttctaggcaggcactatgcattgcttgctaaattaatctgaaggggtttgaggtggataaaaaggctattttttttaaaggtggaaaataatcatggggaggtggtgaaaacagtattgtaaggttataagcttttcatttttaatcaatgatcaggtcgtatgtgtcttttccttggttaccttttgcatattgaaagtggattagcccattgaaaatttaaatgctgttgagttgttttcttttctcatgtttctttaatgaattgttattttatatggtaaactgcttctctgaataaaaaggctgtttaaatactggactttcaaagaatttattaggcaaatccaaggggacttctcataaaatacttggttatgcaaataaagagtttggttgggtggaaggagtgctgatttacagatgtaggggtctggaacagcacagaccccagtagttccatgccagggtacatgaccttggcccagtcagagaacatagcattttcttcactgatacaacaatggctttggagtggtgggttttcatgatcttttccaagtgaacacaagatatgtttctgttaaacttttaatgaaacagatagattttaaatataataaaattacagatttttaatgaataaaagtttagaatcagaaaagttttgcaaaagttttgcatttatagcatattctgtaataatagtagaaatgttggaattagtttgttcctcacccaacaaactttctaaacttcatctcagtacaagttaaggcaattgaaaaaaaaaaattgaggaatgcttttcttttctttttttcacaggagagagatgggtctgctgagggagctgttaaaaacagttgattagttgcaacatacctactatagattagacagaaataactgaaattgaactagagaattatttttttatgtaggacctaataacagaaatgagaaatacagaaattcatgaagccatggaaatgaacctgaggctatgtgcaggaaacttgtcttaccaaagtttcaggttctttgggtcgtgtagttggctctccagtggcttatttaacccagtgaatgtgctcttgggtgtattttttttttacctcatttctaagcctggctgctatagctcttccgtttgggcccagatcaacctgtcggtttctaagagaacggttgaccgagctaagctactttttagtgtaatgggtcttgtcctttgttgttttcctttttgactttgatgccaaggcaaaaaatacctactttccatttgtaccttgtaacttattttgaacagttatatgggttaaatttttattttttcttattaaacatggcattttaaaaaagaaatactaactttttaaatttcattatgtcacagagccaaaatattttctagaataaagagtgtaaatgttataataaaaatcaatagaaaaataggatccaatatagaggaatatgttagcaggtgatttttcagtgtgaaaaatgctaggtttacctagcatgaattttagaaactgcctgaattattagtgtaatacaattctaatttactattaatttagcattaccttatttgatttacacagtaattgttttttaattaagaaactatgtcaggggtttttcctttactaaacttgatgctttctctctattacaagaaaaattatattttatttgaagcattcctatgtcaaactgcttatatgatggattacctacatttccccatcctagtttaactagtcttaagatagatcacttgtggaaatagttgatatcttaaatgaatcttctcacaagtcaatgtcaatgactgtgggatttgaatgcccaggcagccatagcgccacagctaatgactgccaccatgtttaactccccggtaggagttacacttaacctgtctcagctatacatattggaataattaccatagcaacaaagccacaaggggattggatatttccctccattccctttgacttttggcaatgttctttggaagaagttctttagacctgactgctcttgagcctaggccttgttctttctctgtcttggaaaacaaaacacaacaaaaaaacagtaccaaagaaactattaatcatttaaatttgctcttttggttttgtttatatccaaaggcattctatttgaataaagcatgtcaaggtagcatcagtcaaaatttgattcgctatgtttgcaggtgatggcttggacaacagtgtagcttcccccagcacaggtgacgatgatgaccctgataaggacaaaaagcgtcacaaaaagcgtggcatctttcccaaagtagccacaaatatcatgagggcgtggctgttccagcatctaacagtaagtggattctaaatgacatatataaactaaatatggacaatgaaccagtttttatacaaaaaaatgagaaaaaagtgatccctctggacttgaaatatttaataaataactgtgttcccacagtttttgcaaaagtattagcacttatttcttagatagataccccaaatgagaaattttatttaaaattcacgattgcgattttgttaactttcataagttaaaagatttaggtgttcatgtgcacttgtgattttaagtatgtgttttaatgatgttgcttttctaagtgtgacccttaagtgctcagaaccatctcctactaagaagaaagttagacaaaccctagagagagacttaatatcttctgatgctttagtggatctttacaacaaatggtccacaaaaatttaaatcatgttgcaatggcaagatgatcacataatttgcttttaagtggtttgaatgcactggcttccattacaaaacattcatgtaagtcagagctccacagtgaaagttgtccctgtatttagaactgtaaaggaaaacagcaatatagagtcagctcttcctgtgtagtcccttgtgacttttcaagcagagtaacagtttatattgtctgtgccagtattgctgttttcactgcaggaattctcctggagatgtgagaaactggagatttggggctttatgccactgggggatttgttttgtttggttattgttctgaatgaatttcatgttcaaaatatttataataataatattttggtggatatttttgtaagtgcataccaatttaaagaagaagatacaatgaagatttgtggataaaataatattttaaaaatcaacaaaattgttgaccagaggaatttcaatattagagacaaaggatgaatttagacaggttgtagcaaagttacatagatggataaatgttaaaaactcttgagggttgttttttaatatcaggagaaaatattttgtgttactatttttgtcttagcttgcttttcctaaagtcaatttttccttaaatattaaagttaatcttgcattgtcataaacacttgcagagcctgtttaccttcatacctgggcccacattcaaagccatgttcctcagtgagttttacgggtacagagatacaaactcaggggatgtctgcaggtcatgttagttctgctcctctggatagaggctgtgcctctaataatactcaagggtataaattaatccagattttccagcatcagtgaataagataaaagctgagagcagcaggaatagctaaaaaaaaaaaaaagtttcctcccttctcttcttcccataataattccaaacagtatctagactacactacagtttttgagtaaacttcagggcttggctatgctggaaattagttggagatttagattatttgagctgttttgattttaacatcatattaggtttacctagaatctgattcaggcaccactacttatctgacacctgttgcatgtgtgtagatatttcaatatctgactcctgcaaattccccactgaggattatcaatcactaatgaactaggggaaagaggactcaggtcttgagggcatatcatgaaaaacgaatgatatgacatttagataagaagtggcaattggtcaaaggtgtggtacaatgatgctgatgcaatgatgctaatattttatctccagaaataaccagctaactcgctgtgtggaatgagttggtgtggtggataaaatcaggttggccctgaagtcacaatcaaataatttctatttcctatagactaacagaaacaatgaatagatttcttcagcccccatctcaatctgcaaaggagttttggctttacttgaagctgaggtgcccctgaataaaatataatcaaatattggttcagacagaatcaggagagagagaagcaagctattttatgcagccactagttttcctgtttttctaggttgtacccttgtgaagacccttgcatagagctacattatcttcttgaaacaaacaaacaaacaaaaaacccaaataaactttctaacagcccgcatgattttacatgcattgcattgcttatatggactatgtgtttgttactggggcaattgtaatcgaaattattcatgaactgcctgatttcttgagacctaaataatagtcttcagttttgaggtctttgctggcctgtgccactgccctggaaggggaagcccattcatccatgtttccccagctttctgtgaatgtttataggtgttaccttgtggtttccattggatatttctacctccattacccactccaatgccatctgctcatacagaaatattgattaatgataatggtctgtagatagctaattgttcttataacatcatctgaagagcaaagttaagagatatgtttaaatttttcatcttttccttcccccaatgaaaaagattccttcccacttctctaattgcaagagcaaatagacctccagctataaggaacacccgttacccttgttttgtaatccttcttgaaggaatgcatggactgcttaggtaatatttatagtaaggagctaattttaataaattctattttaaaaacctatagaatctaaagagagttttgttgttgtttgtctaaatgtaagtaaccactgacatctcagtactaattctttagtgactttatttcaagttctgggaggtcttcagggatgcacaattcattaggaagactgtacaaattttaaatggtcacgtcattgctatgtgattaatgcaacttatctaggaaatcctttctgaattcttgctagatgtaaaaaagccattgaaattctggctaattaaaacaatagcaataccaatttattagtaaactgtaaactagtctttttttaaatgtcaaaagacatattcgaaaacctctcacaccttttaaaagcaaattgctatttctttttaaaataaatggatcaatcctttcactgggtttattcagtgaaaaaatctgcccttgaaaaggctttaaagcatttctgtgttagaagagtagaataggccctgaattaaaaaccaaaacaaaacaaaaaccaactttctgaatttgtaccccagctacatgagaagaaaaatgtggcagtctgtagttatccacaggtagacttaatcagtagcacattttactactccaaagagagaactaaagcctcactcttgggctcacagtctctagcaagctaaactggacatacttgtatataatgaaaataataaaagaaaaaggaaacgagttttaaactttggtgattatggggtaagaagaaatttcagtgaggtaaattcccagcttatacttagttgagcatttggcagagtcgataagtagagagggtctcttaaaagaaactattccctggaattgaaaggaatgactgacatgatttaaataataagagagaattagaaagaaaataaaggcatttattaataggaattcttacatttgcctgaagatgaattattgcaaacaattaaaacgtgcttaatatttgcatatgagtcactgtgtattcacaatcagttcaggggcatatgtcatatcaaggtttctttttccttcttgaaggcattattccaactgtaaacatagcctgtgacatcatagtgcttaagctggatgtgttttgcatgttatcagttcttttgctgcatagtattacaaagatatgtgtccaaaggcttagtgaaaatgaagaaaaagaatgcatgccacgtttaaggtaaaaatcaagggtctcttttcttttttgttttcctatcctatcatattgcagtctaaagtataatctaaatagaaaagcgcttaatgtggttcttatttaaaatatgcagtgactatattttcctgcatggagctcccgtgcttccaggaatactgaaagttagggataagggagggaggtagaaagcatacctacagattcaggtgaagcaagcattcacgggtcaatatccagcattgaccagtcggaatggtgattctgatggtgaactgattttcattcacactctctcctactccccatccattcaccatcctgaggatcccatttggttaagccttactacagggacaaactttgcttctaagttagacacacttatgtgccaagtgtttttgtttcattttctttcttctttctttctttcttttttgtgtatgtgtgcacttctagcctggaaaatttgtgtgtgtgtgtgtgtgtgtgtgtgtgcggccaaatttatgtcttgatttctgatttataagacttccctctcattgtggataaagccaatgcgagaggttgtagaatcttccaggttgagaatagcgtttccatagtaacactattagatgaaaagtgccctgcgggtccgccactctaaggacggagtaaatggaattgaattgggaattgaatgctctagaagagacagatgttgtttcattggtttcgtttttagtaacaagatctgttggagtcatcttagtgtcgtatccctccttgccattttggaagaattattctgtaaacattatgaattattacaatgaaaaagtacatctaattggtatctggataatccattctgttgatcaaagttaggaaaagatagaaggacttacaggtaggcacatgggcaggtagtagatgaaattttctcctctcctcccatttctatttctttttattgcccacctctgtactctgccagtttgaacagtgaatattccttttaagccttaccagccagcatccttcaacaacctatcctgaaagatctagggggagtcctgagaaggtggtggggaaggacaactatattctcacattcttgcccaaactgttcatcagggtatttgagaaaggcagtttcttcttcaaactagtcctaatctaccttaattgtcatgtgcctgagacaagggaagtggcttgtggagatagcaggtaactttgattccttcttcactacctgttatctgcagacagatcattaaattaagagccttgaaaactagtatgaaggtgcgagaagatttttttttccttgcagatgtccatgtaccctatcaaaaattagctcttttacatacataagaagaatattttcatagtttttactttttcccttacatgtaactgccattcaccttcacctctgaccaaagctaggctttgctgaaactaacccaggcttggatgacaaaatcctttatctgagttttaaaagatctctgctactttgtagatagcgtatttcaactttgactagataaggaccctgactatttttcactcaagtgggaatcatcagtctggggagggaaatggagtcgattatttaattacttgaggggaatattggaatgctctaatttttctgtgatatacatcatataaactctgttttaataatgaagcgggtggtttccagattctggggcaactgcctttttctttttcttagctggttattgaaatcctaatgggatgggtgatgaattttcttaggtcaggtaaactgaaaaggctacagctggaattcttcacccagaagaatcggagttaatactaatgatcattgtgaattagaagatcaaaggagaagcatcagcctgttctccacattgttgccccagaggccattagtgacctggcaaagctttctcccagccttctctgtacctccttccccttgcctgggcctttcttccccacttgtagttatgcacctctgacctggggtaattacagtcagttgatgcggaggcatgggggaaaacaatcgaaagcaaaatcaaaagtccaactttaaaattgcttatttatccaggtatatagcccttctgagcacacgacctctgtctgagactctatgttactgtcagagtatgagtgcaatttttgtgtgcagtgaaataagtggtttattcatttcaccaatggttgtttcactataagagacttttgtagagtctggctggcaatttgtcagatcattctaaaaattttctttttttcccaaggttaagatacagatacacgatagtttggttttctgatatattcttaattgggctgattaaataaaggattatgtgtaaaacaaaagtgcccatggactttttacaatttgttaggttgttactgatacacctaactgaacactagccagccatttgtacttcaaagtgtgtatcaatatcatgtcttctttttattttaattagtgatgatatatttttaaagataaaatatcaaacttggtcactgagcatgcacctcaatttatctttccgattaaaattggagtaccacaagtatacatgtgagtgtgtgtatatttttttaacgaactcaatccaacccctaggaattttatgctagtttggttctttctttcttcatgtttaagattcctaatgaagataccttgtcttaaaatatgaaggtttgaccacaggaaaatcagatagatttattttataaaagattccagtgttttggattgttttgtttttgttggttggtggttttgccagtagtagtaaatctacatgtcgtggaatttaggatcctaggactgaactggtaacatccacatcatatctgtctctcatgctaaagtgtgagtataactatctgctcatgtatgtccctacccctgccatctatgaattttagtagggaaaactgatccattttacatcttttaatcccctaagtagccttgtccaaggttctaatttttcttcttgtactgatgtaggtccatgacagagggcaaccaagtagtggagtacttgcacattgcaaccaagaccacgttgcaatggtctgttgctcagctcacaaaacactctgggccatgacccaagcttacctttgatagattgaaagccatgtggtagcaaaaaaaatatttgattgacgctccaaggcagtaatgatagggattgtgtagatccacatcaaaatgattgctcctgatgtgtgagcactttcacttcagtattgctcacccttccttgtgcagagtccggagtgtgggcaacttggctagcctctgtggacttgatagtcacttcagtgtgtcaagagccagagagtgcgctcaagaactcagataaggcatctctttcttggtgggccagtggagagcctccaggagtaagcagtagatgaaagggttatgctacgcaaccttctaacattttaaaggctttttagtccttgtttttcattgccattgcaaaacgccttcactcagcaaattataggccagtgagcacgggtcccaagatgaaatgtattcctctatctaaagaaaaggtagaccttaaataacttgatgttatgaaggccaacatcctaaattagttggtatttaaatgagacagaaatgacttggttttatgtttttagaaatattctgaaataggtcttggtaactgcttgaatttgaatgtcctgttggcatgatctcttaaaaaatggggtggtatatattaatttaaccttgtagttgtctttgcatttcatttcttaataatctatggtcagtttttatctgtttccacaattacctttgttgctagcatccctgcagtacccaagtgctgtcatttgccacgtggcatagattaccctgagaatttggtatcctgggaagtttttgggatgtccagagaccagcaggtatagtttttttttccaacatgaacactcatcctatgaaagatcaaggtcatttctgttgcagtttatagaagtttagaaaaaattcttatctattatttaaagaaaagccagttggccgggcgcggtggctcatgtctgtaatcccagcactttgggaggccgaggtgggcggatcctgaggtcaggagatcgagaccatcctggctaacccagtgaaaccccgtctctactaaaaataaaaaaaaaaaaaaattagccgggcttggtggtaggcacctatagtcccagctactcaggaggctgaggcaggagaatggcttgaacccgggaggtggagcttgcagtgagccaagattgggctactgcactccagcctgggtgacagagaaagactccgtctcaaaaaaaaaaagaaaagccagtttcccaacttcaagggggaagaacttcacaaaatgaattcgttgaaaaaataaaataaaatattctcctgcctgcataatgtgacttttattatatttttaaaaattcagctattaattgcttggctattttgacattggattattctatcctttcaacagctgaaggaaaaaaatttattgtaatgctaaataaaaatgtaatatgtatgtatgtagtgctttattgtttaatattttcctatacactggatgcataagacaatcctgtaaggtgggcagcatgacaaaaatgaaatttagagaagttaatgatttttctcaagatcaaaagcgaggaactggctgagcttgaaccaggatctcctgacttgaatttccatctgctttccaccacgctgcctctcaaacacacagcaaatcaaatcgcgttgtgggagttcaaagatataattataatctcattccacaagctagctaattagtatttttaaaaaataaaaatataagccagagggcttggcataaaacttcataatgcaatctgatggttattagtaactaagggtcaagaatggtccttccctatctggaatctttttctgcagatatctgcccataaaaaaggcaaagaaagctacatctgttgatattttgtgacaatcttgataatttttgcgtttttggaatttcagattttcaacattatttaactgctcctccttccttacagaaatatgtaattctctacccatgtctgttaccaacaatgtctgtgatagtgctttggggggtgaagaatctttcctcatgcagatcctaactaaaccttctaacacagaatttagctccttgaagattttttttttttgcctgtcacgtggcctggacgccaaagagctaagtctttaattttctttatggagatagaggaaactgcttatgcagccccgattactcttgaaactacaatccaactgtcgtttctcagcaaagaaggctgctaaacccaggagaattaagctgccactctggggtatgacaccgaggtctgatcattttaaagctagtaataaccagaatcctaaaattcttatgaataaaatgtaattttagtaatgtttccataaacagtggtaatggtggcattttagtaggcagtgacattagtcacatagaaattgtaccacattggcttttaaattactccacctgtctgtatgaatagaattttcagtgtaaaagcagagagacagctgctgctaatgtctccttctccctgtgcgtataatgctggcaaatctacatgcagaaaggactggcttgtgatgtaaaatggtacctgaccccgctggctcctgagctacaaagcaatacctttaattaccagtggctgtgtttagttgttgatataaaaatgtcagcttccaggagtgtcacctcaggttcactccctctagtaatgtcacccatcgtacaatatttttcttccacccacatccgtaatgcgatgggtgggcatttatctttgtgtgtttcagaaacatgcaaggcattaatagtttaaaggaaaacgcctaatactgtacgaacttgattaatgatctttccgttggagaaattttaaagattagtggaatttggttccttctttctagccagaacagaaatatggcatgccatttgtaccatcaaagggcttagcatcatttatctaatacaaatacaggttcttatgtgaggatcatggcaggcatgtcatagagcagaaagggtaaagaatggaggggcttgagaatatcaaatctgttactacgtgcccatgtttcctattgatagatgaggaagtttactttttagataagcccctttgctcttagccatttggttatggttctattgtggcagctccattgagacaacagtgggccaggcgaggggatcctcctgttggagatgcctgttgccaacaatgtatttgatgaaatggtaaataggagatatacgtgtctggctcattggcaggcattctttttgacttctttcacacaactggtgttttcgtgtttaattgaacaaggaatgagtagtaaatgaaagctgctgcctgaaatcccactgtgagcatgttttgcacttggctccccagtgaaaaggcaatttgtgaaattatgtgatggagtaattagatgaagccagggcttctgactgttgccatgcatatgtggcgagggtttgttgggaagagggagggggagaaaaaaatagattattactctggcaagtcggctcaaagcttcttcatttatttgtaaacagaatatttagtgaccgcataggaagtagctgtaatcaccagctcataaagaaaccacagcagagcttttggatttttgcagagtgctcatgtaaaatttaagctgggaggcagaatccctgttaatgtaattaggatctaatttaccaccctttgcacacagatgtaataatgtctagatatttattctatctttaagcatgttacatatacctcagtgcagcagttactgaacagaaacaggtgtgagcagtttcctaattcgtttttacactgtaaacacatagcaatttaagggaaatatttaccaaaaacgaggggaaagaatgtctgcaaatgaggcagtaatggacagttgccgtttatgtactgatggatttctcaatggttaagtaaattaaagcaaatgctagaaaaatcaataggccagcatagtcttggttttgcctcatagacttcaggacagaatgacagatgtggtgtctatgacccatttaagtattaatgcttgaaaaactgcttctgcatgcaaggttgtaggcttagaaacattctcctatattaaattacagacaataatatttttaagtatatgtggaatttatatgtttcagttaggttgttcttatgtgttacatttatactggaagattagttgcttagttgttgcaatagcaccataaatcagttttgaatgttcccacaaggaaacatcttcataacgctgtagttggaaggtgaagatgatgtattttgagctgacgtgtatgttgaagtgaatatgctcaacagcactctatgtggaaaccaaattaaatttaattaaggagtagatgctcagagcctttggaaaaaatctgtaaagtagcattcaaatgtggcattataattcagttaatctccagggctacaaatgctgtattttacatttgaactaacatgggtaacatgtcacgtaggttgactgtcatagcgtgtggaattgtggagctattctgatgtcctaagtggtaggtgttagcctctgaaaatgagaaggcagaccttatttggtagcccctcagaatgttaagttttccactcgttgttcctatttctaaaaattcattaccaatttcatgataaataatttaaatacagtcaaaatgttgatttgttgactaccagagataggaaggcaaggagagaagcaaggccaaatgtacttgcatgtcagagaccaaaatttgctcttatgatcgaaataaaatgaggttaaagttattatcctggtcattggaggagaaggtgccttttgttggagagaaaaagagttttgctggcttgaagtgtcctgtttaccttcttgtgctgtctgaacttagacaataattgctcaactaccttccttgctcatgacaaagcaggcatggtccagcctgactctgggttttgaaaatcagtatgtaaaggtaatattgtggctaggagcagtggctgttgcctgtagtcccagcactttgggaggctgaggaaggaagactgcttaagccccggagttcaagaccagcctggacaatatgatgaaaccccatctctacaaaaagttaaaaaattagccaggtgtggtggctaatgcctgtagtcccagctacttgggaggaggtgggaggatcacttgagcccaggtgtgttaggctgcagtgagccaagattgcaccactgcactccagcctgggcgacagagtgggaccctgtctcaaaatgaataaataaataaaatttaaaaaattaaaaaaaaaggtgatattgtgataagtcatatcattggaaacattgctaagttggtatgatgaaaagaagtacagtgattatttaggttctaaatagaagcctttaaattttttttcacacaagtattttacacaaatatttcatgaaaatatttacaacatttctccgaacttgtcaaatttatcatgtgatttaacaatgaacacatctggagttttaactgaggtataacaagtaactttaaaaaagtgaaagtctatcacctgaaaaactagaaaatgaaaattactacagaattgaaaattcttttgcttctttaaaaacagtgctccttggctgagcacagtggttcatgcctgtaatcctagcactttgggagaccaggacaggcagattgcttgagcccaggaattcaagaccaggaattcaatgggcaacatggtgaaaccctgtctctacaaaaatacaaaacttagcctggtgtggcggggcacgcttgtagtcccagctactcaagaggctaaggcaggaaaatcgcttgagcccaggtggtggaggttgcagtgagccaagatcactccactgcactccatcctgggcggcagagtgagaccttgtctcaaaaacaaacaaacaaaaaacaacaaacaaacaaacaaaaacagtgctctttaagctatggcatgcatttaaattatctggatctttttaaaaatgtagattctgattgagagggttggggcctgagattctgcattttcagcaagctcctattgctgctggtgctgctggtccacagactgcagcttgcatagaaaggatctaaggtacacaagcaagatgacagattttaaatggaaagatgattgtttttctctttgatttttatactttgattttgcccccctgattttgaagcttaccccattgtttttatcatattagtttgacaaaatgttttattttttctctgccaactttcaatgttttttaagcatataagaagttccttttgaatatcaaagcactttcattggatccctcaagtactctgaaagcttctgatagacgcagggctctgcagaaagacagactgtttcttctgggcttgttgacagtacacttgtgtgttcgggtgggtggaggggtagccctgaaggtcccatgatacagaatgttgtggttcacctccaccacaaggaaacatcttcatagcttcagtgctctggtgacaatatgcagcgacggaagttatcatggagtgagggcagtgtgtgtggcatgctagctcctagactcctgcagaggctctgcagatcaggtagcctttgtcagtaagaaagtaacagaatcactcactgcagaaacaacacatatgtttgagggagaactgcgtttgtgcctcacacttcttgcctactttatgtctgctccaggagatccttttgtattcccactgccttgtgtactttatctgccatgggcactgtcactctcaaatttcgcagcatcctggaaggaaggtgaatttgctttcaaaagtgagtatctgaaaagtatatttcctccagtgtggctaagatctaaggaattattataagtagtgcatacctattaatcattgcttagcaggtaaattctctcactcattagagttcacatgctagatgtagtttcttgaaattaggtcatttactttggtctaagtcattgaggatcaaaggtcataaggaatccaaaagccattagtcagggttcttttctggaccccttagatgtcattgtgcaagtcacccatggcaggccgggcctggcctgctgtcagggagctggcagggtgcctactttatttccagtttgcatagataaaaagcagagcagcgactcttggaatcactataaaaataagcttacataaaatctccatttgaaatacagtatgtgtggtgtgcccctgcatgctttctattctggaagccatgggagctagaaatcaaaattaagaagcgaagagacagacctctgatggcattgtagactactctttgtttgggtgtaggcatttataatttatggtaagtttagtgaagaccaaattttcacaaagaattaaaatgacaaaccaagcattttaatttgctaaataaaataaaggcattgcttaaccattgtcaaacatatatatacatacatatagctaccccctcttaataagactgaagtacatttgtcggtatcagaagtggtgggcaagagatatagtcaaatcaattcatttacttctctcattgagccctgtgagtctcaggcccacaccttgaagtgaaaacatcatcaattaccaaaatgacaggtgctcaggacttacttcctgaaagatgttcatattggaccagacaccacgagcactcagcaacattcatcacttcgttcaaaagagaccgaaaaaactgtggggtgaatttgcaagggaaaaaaggccaaatatacatgcatgaaatagcatacgtttgaatttctaaaagtcagacagcaagcaagtatcctattttattttaaaagattattaattgttatttaatagtcaacttgcatgtgatcttacaattaataattgtatccccatttcacagatgaaggaactgggacagaaaaggttaaagatctaacagccatcttagtgtacaatgaagttgggactggaaacaaaactcagggccataaatttcaacttcctggagcttaccacttccataccctgacacttaaaattatgacttgttattgttcttgaaattgtcctgcatacacagttgactagaactaatgagaatggaggcagaagtccacatagcctcatcagagtcatgcctttgacacagttattccagagcaatcacaactgctgtatggtcaaccagagctgggggcccctgtgtagcccctttgctgtccctagagatctctgtggctctgatacctgtattgcagtaaaagcaagtgtgtgtgtgtgtgtgtgtgtgtgtgtgtgtgtgtgtgtgtgtgtgtgttgggggggagacagggatcatgctggcattagggcctttatctatgaataccttatgctttttggtttgaggagagatggctagaatagtttccatgatatgatgacttaatcccaccacactgcaggaaaaagcaactttcaaacctgcttgttatgttacccaccataaatcatggcaaaactttaggccacatctaacttatctttgaattgcaatataaatggggtcattaaaagttttttccaagaaagtcaaatgttttttgagggcctactatgtacaaggaaccatatacatccggaacgttctatgatgtttgaaaagggcatggatctaatctctggtgcagtttatagaaagctggagtgaacagaacagtcagaagacagctataacagtttgggtaagaaggctgtgctgtgggagtacaaagaaatgaatgagtacaagatatgttggaggtaaatctgtacctcataaatagaaacattctttcagttaccaccacagacactagagatgtatatagagtcatagatccagagagtgccaagagagaaaaggaggaggccaaagatagaatttgggggattattatttctgaaggctgtctggaggaaaaacctagagaaggagagacgaacagacagacaggtctctgtcaaatacagaggtggcatgaattaatttctgggtcccttccagctccaatgctttattattctaataaaagcaaggaaggtacagtggtaagaaagtcgaagaatccattccctacactaaatccatcatggctcccaaactggctctccttgctgtcagcgtcgtctcagttcatgacatcaccatagacccagaaactccaactcagctgagacccaggagtcatcctggaaggttcctctccttcccccttcacaggcagttgctcatccctgagtcccatcaattctctctcctaaacacttctccattcttcttcccacctagctccattgccactgccacaggtcagtcctctatgtctccagctttctccgttcgttccccagccttcctgcctctaacattggtcccttataaaccatcccttattttgacacagtttttctaaaacaaaacttggctaagtctcctcctacttaaaatcctttgatatctccctactacccgtaggatatgagacaaacatccgtggtgtgccactcaaggaccccttgaggtctgacactggtgccctggcgcctctctcaccattttcatacaggctccccatgcatgccatgctgcagccaagctgagggcttacagctccccatcagtgctgcacagtcttgtcctctgtgcaccttacatgctgttccctcacctgagatacatcacttccatgaccccttctctacttgacactttcctccacatccttcacatcttagtacaattgtcactgcttggggaagccatttgttgttttccccaggagagggaaagtggcccctgcccccaggtccacagcaccttgatgagactctgatagggagtgcttatcatagtgactgtttatttatgctgtgcctttctatctagaggtcaggatttaatctttgctctgtacatcttcagagctgtactatagatgcttgatattatttattgaccaaagcaatgagtacagttgcaaaacagaaatgaccaaactctgggagctttataaagtagaaaggctggaaaagatcctgatacaggggttaggatatcatcagtgacttttgtcatttatttgtttatctacttcttcttatttcttttagaaatagggtctcaatctgttgcccaacctggagtgcagcagtgcaatcttggctcactgcagcctccacctcccaggttaaagcaatcctcctgcctcggcctcctgagtagctgggactgtaggcacatgccaccacactggctaactttttaagctgtttgaggcatttggaagagaagaagttgtattatgaggcatatgatgatactgcagtggaggcagcaaaggtagatccttttgcaatcacttgaggaaatatactaaaggatatactttagacagaagcttcaggaagtggtaacaagaaggcatggtttttcttttcttttttaatatttaggagaaaggatatttgaatatgtttacatatacaattgaattcagctatctttcctggaattgctactatgttccatgcaatttgttaatgcatagcctacttacttacttaggcaatagagacctttgaagatcaaagtagaaagggactgattaatgaagcaagaatcaagggcaggcagacagtggaggggagggtgatgggactcagagtaagaacatagcaataaggaagaagtcagagaaatttagaaatgaagaaggctgctattctcctcctggatcttttagcaggctggaggcaaagttaactgatgaatgtccaagaagtgggattaggagctggaggagaatggaagtcatttggaaaaattgctgttgggaacacagtaggcaaagcaaaaaaaaaaaaaggaaagaagaaaagataaaaagactttcagagtgtagttgagaatacatatagaagtagcactagataccacactgtgaccaaggactggctagacttttaacaggcacatttcataatcaatctgtttttcacatgttaaaatgaaggtaatagatgaattcttagtggttttccacaggaaaataattccattttctattccttaaaaattagtaccatggggccgggtacggtggctcacgcctgtaatcccagcactttgggaggccgaggcgggcggatcataaggtcaggagatcgagaccatcctggctaacacggtgaaaccccgtctctcctaaaaatacaaaaaaaattagccgggcgtggtggcaggcacctgtagtcccagctactcgggaggctgaggcaggagaatggcgtgaacctgggaggcggagcttgcagtgagccgcgattgcgccactgcactccagcctgggtgacagagcaagactccaactcaaaaaaaaaaaattagtaccatggggaacattcattgagccccagtctgagtcactgaagtttgtgccatcatatgtaggttagtgaactcaagattgcattaaaggttttatctcagctttggaggaagttaacatgcagttattgtacattatctttcagtactggttgtataagaagtttgcaaagttgttattgataacctttgcatgtgagttcaacaaaaaccatgcaaatgcagctgtctgctaagataaattttttttcttgccatgtgatttgagagaaaaggggagttttaaatttaattaagacaaatccacacaacattgtaaaatatctgagcaactgtacacgttaacaggtgaacaatctcagatatgttctggtaaaccttcctctgctggaagccttatttttagcaatgggaaggagagatgactggcttgaacagactactttagcttcacaagttgaagttgaattgatcttgacactgctccagaagagtctactgttgtcattttggtttgatggtaaatgatatacaattggcttcatgaaataaaatggtaccctacacataatgaacactcatcaccatatacaaagaacagttagctcagtgtgatcatcaggtcacagatgactcatgtgaagtctctgtttaaataggaaggactactgacaagcaaacatgctcacagaaaaatagctaagtagcgaaataaataaagggctcagtagtccttcaaacatgtattagaaaacaaattaaaaattggtttcctattcagtactgtaaggcaatgtcatgacagtgttggaaaaccaactccctggtagctggtgtattgcggacatttctgcccttgtctttgggagtgccacgtacacggttacacaacgcataaaggcgagggtcatttctaggacagataattgaacattaatactcgctgacattgccgaaggaatgatatgtcaacttgacagggcctatgtgcttacatctgctgattggctgcggacgaaggccctgtgtgtcaggatgagaccccaggcctgactgcagcagggccaaggatgcggcggccattaatcatgagctgccatcttgagccaagacagtgtctgtaaaatcactcgacatcctgtgtgtggctggcaagttccatctgttgtatactagagtttggtaggtatggctctcagttaaaaaaaaaaaaatcatcgcagaccttttggtttgcatcatctaaccagaattttgggtggaccagatgtcctttgcatgtatttctttcttttttttctgaaactagttataaccagttttagtgggtaaaagggaggttctgaggtggagtgtcttctgttcctatgggaattagttttgatgagtttctggtttcctgattcaccatagatagtcagtataatgaagaaatccaacaagaattaaactgaagttacttgctgtgatttattttttcgattctctacaaaatattaaaccccgtaggcagatttttgaacagggaaaaagaggtctatgcaattattttcttatccctgaaatcacatgaacagcactttcctccctcatttataataaatctttagtgagttaattctgttgctgcagtatttccacagccagcactttactgaacatgtatcctttcagagaaaaaaaaaacacaaaagcatggaacaatcacaaggccctctgacactcaccccaattgtgccttcttaaaataggggtaaacactctggcagtagttagtgtgggtttccactgcataaaatgttataaaatagggcccctgagagcatccattatcacatattggttaacatcacagagtttttaaatcccagttgccttgatgccatgaaaaaaaaaacagctttcatctgtaaaatctagtttccctttgttattaaaataaatgaagccattaaacaaaatatatgcatgtaatagtcgagttcctcatttggcatcatcaaaatgatggaattttgcatttttaaaaattggtgttgccatcttagcaggtttgatgtgagctacagaatccaaatgtgctggaggcttctgaaactgtatgacatgacatatatttctctctttagtctgcatatatatatatttatctggctctcctttaacaaaaagtagaattctgtttaagagaactaaaaaagaagacagttttttttatccaaaatcctgccatcaaatcaattaattataaccattgatgagctcgtattgtgactgtgctagaattgaaataatttccgaatactttatttccaaaggtttgtttttaattacagcagcatttggttggcatgcaagggcgagttctcactcttgatctatcctagctggagctcaggccaaaagatcctctgctcccttttctcgagagcacacttttctgccaaatgtggtgctcgtcccctgccaagaaaggtgggcgaattgccacttctgacttccaaccaccaaaagacaaaggctctcaacattcctaagtccactgagccagaatgggcctcacaccttgaaggatcccgattattattgattatttttcccccatagactttataatatagaatattttctcagtgccttagtcagtccccgagggtgacttaggcacttacagcaatgtgtgaccccttgaaggccactggagggtcattgaagtgtccttactcatctgtctgaggcctgagcacatctacactgtcagtgtcacctctatatcttgcttttatagtgtctttttttaacactctttaagttagaatctagtaattatttatttacttctgtgaagctcaaataaactcaagagaagttgtagctaagcataaaacatctaatagggaaaacatagcctcttttccttttaatgggacccattgcgtaatttgtggagaatgtgtaaattctcctcataaattgtgcagggcttcttaaaaaaaaattcaagatcgtgacagcagcacattaagtcaagcatggggcccgtctatgtgggggtccctgtgtcacttacaggcagcacacccatgaagctgccctgccttcagagatcttggaagcaagtttgtccaaataaagagaattacaagaaaacattaaaatctaatttaacagtaaaaataaatttagaagaattatctagtcatatcttcttccctgcaaattgagaactgtatgcattttatgtatttttacatagattagcccaatcttaagagtcatctcagattcagctactgtttactagtctctaaatatatgccagaccctatgctaagcaatttgatgcgtgttgtctcatttgaccaccaccagcgtgattatcctcattttaccaatgaggaagcaaggcttggagatctgaaatgttgatcaaagtcatagttactgtgggttctaaggacttaactttagttatctaactaaattgatacactgaactacacctcttaaaaccaatttttgggccgggcgcagtggctcacacctgtaatcccagcactttgggaggccaaggcgggcggatcacgaggtcaggggtttgagaccagcctgtccaacatggtgaaaccccgtctctactcaaaatataaaaattagctcgtcatggtggagcatgcttgtattcccagctacttgagaggctgaggcaggaggattgcttgaacctgggaggcagaggttgcagtgagccaagattgtgccactgcgcttcagcctgggcaacagagtgagactctgtcttaaaaaaaaaaaaattcttttaaaatgttttcctttagatttgccatttgtaaatgtgtaaccacatcactgaagcatgaatggacttcatgaccacgttcctgggctaaacgggcttatgactctccacataggcctaagttttcttaagaactcatttaggaagggaaaactaggcccttctttgtgtaattagcaaccttaagtcacaagtggaatggcaaagaaaaacacattacataaagcaaaactatatctagttgtttcaaagaggaacaaacgaatcaatcctcactggataaggacatttctttcccaaagcatgttttagaaggggcaaatgtcactatttaagactttttggcattaccagtaagattatgtatataagttcattaggaatgatggcagctaatttaaaaggtgatggttttgtttgattttagtttaagttttagtttagttctttgtttcatcctgggcagtacacatttacacgttaaaacagaggctgggtcaactaactcacagtaggtttctgacagatgaagctacagctttttattttatcattaacaagataaactttgagcttcagtagagtgtaaagacaactagatagagaagtaggaggccttagggccagcaacttcccagccacgtaaccctgtatatcttgccatgtgtccactctaaattttgttttctcttgtatagaatgagggcaacattacctattctaacttcaccagtaattgtgaggttcaaacttggcaaaatataataaaacctctttgaaaatgtaaagctatatacaaatataagggatcacccttctcaaagtcttaaaaaaaagcccaaactattcttcaagttaactttgatgaaatatatttttgccaactttatctcacagtcttgttggtgacaggtcgagccttctcccactcatctaagatattccatgaacatttgtgataaccctgcagaaataagtccacatctgtgccggcatccgcacctccctgcccccagcccagttagatttaatgaggaaagtgtactttgggaaacaaatacggtggatctgcccaaattttgactaagactcttccctcatctataatccattctggagacagacagtgaattcacatcaataaatgctttcgggagttggaaagggtttgcttaagaaggttcataaagataaaggtaatctgatcactaaaaccatttaaagtttttagattttttttttcttcttaagggggaattccctttagtttgattgcaagataagagttttgttgttaactaagataaaatatagtgctgaataatctctgaaattaaaaactgaagtgcatggtgcacagaatagagaaaattaaatagcttagacaacaatggataaagagaaaagagttttcatgaaaattagcttagtaaaggtaaattgcatttgaatcttaacttcagatctgggtgctctgctatttggcatatgttgaattgataatgcctgtgtgttaaagaattctgattgtttcttttgcctctctcacagcttataaaaatgcaagcagacccatctaatgaatattaataggagtgatgtctagataacacataaaccccgggatctgtggactttggatggagtagtcagagaggatttctgtggctttatttaataccaaatttacatacttttaaagaataaacatcatcttaatattttaatatcaatattccagagtggagattttagtcaaataaaaagcttaattttgtcttcccaaacattatgttcaccagggtctgcattttaagagacaggaaactgttagctaaaaaagaaattaacttaatcccccttcattaagttccagtctttttctgttacttagagacaagtaataattatacccgtagcaatgcaaagcatgttttacacttttgttatacaaaagaactgcggttgttaaggtgacagcaaaagaaaatgagaacattgataaatactgatttttttttcttaaatcttctctgactcttgaaaataaatttcactcaggtgtctgagaggccttttaattcattaactgcaaaaatctacacatatgattttagaaaatgtcaatcaactagctaaacaatattttcccagctaaggttataaacagcagctaagtgggtggaaaatgtctaaaacgactatacataccagttcttttataatgcataaaaagtgggcattttgttttcaagctggtatctttgggatggaacttttagcaagcacacagtacatctcagcagtgtatattatttaaagtgcattctctctctctctctctggcattgtgaagactttttaaattttagctttacaaaggggggaaatcattaaaatgtggtttgtaccattacattccattatttgtcatctttatggctattctatagttttcattgacctttaatggtaagcttggtcaggagaggtgagcaggaatgttcacatacttggctgagggtgctgcttgagagtgtctgttagctgggcttcaatccacgtccctgtagattttaatgtccctacagactgctggcagcctgcttccagctgtggcaggcatgatgcagtgaattgcttttgaatgttctttactcaaataggcagtaattacaagcttaaagaggtttagtggtccagtaaactacataatcacccctgaattagcctgggctcatcagttgcagtccagcaagctccagtctgctgtttgtatgccgtcttgatcacatagcaacctgatcagcaggtgtggagcagccagagtcccccataaacacaactgtctactggggacaatgatctctaatgagatgaggctacatcatcactgtaatttaagtgggaaaattagcactagagaatgggtaccagttccaggggtctttagtcatattgggagcagcacgaattctccatctcattctccctgtctctatctttttctctctcaaaaatatctcctcaccaaatgtaccattttgcttctaacttacggatactttattctttagacaaggatttttcctgaataattaatgctagacagggcatctgtaaaggcaataatgattgctgtcaacagactcattccaaaatggcgttgtagtatttcatcttccttgtctttctacttaatggtttcaaaatcctttctctttgatttttaaagtggaaaagtgttcttcaggctggtgttaggtctccttttagctgacgtgctctctgaaattgtagagatgggctatacatagtttgaaaaagatccttactttattggagtttattgtataaatcagtcatgaactttcttttcagaaaggtggtccagtatagtgtgccatgtttttgttgtgcatgttcaagtgaaattcttggggaaaagcctccatgttgaaacagtcttctttatcctttcttctgtcctgtgctaggcataaagatacagaacttgaattttgttgcattgaagttagagagtaggaagggaattttgtcacaaataaacccaagaacaacatagagtgaatttgggagaaactttgggggaaattataaattgacgctaagaaagaaaagcagaataacacagtaattaaaagcataggctgtgcaattgactacttagagtcaaatcccagctctattttacttgccagtaaattagattctgagcctcagtgtcctctgtaaaataatggtaagagtacttatcttagagacttgttttaaggattaaataagtaaatacttaaagctctgagaacgctgcccaacatacagtaaacattatataaatgtcaggtaaataaagtgagcaaaatctggactaggcactctactattctgggatttgttgaactaagtgagaaggatgaataattgttggaatggagctgctagttttgtgtttatctgaagtcatctactcctactcacaaatgcaggttgagggattttagtcatctctaactttaataacattcattcacagaaatatttattgggcacagaactggtagctgcatcatcactgggaatagcattcatatgtttttattagtagtctactaaaatgtaatgattttgaatgtcatttaactcatatttgattaagaatcatgtaataaacaaaagtaattggcgaaacacacaccccaatttgtttcaaatcccaatttgtttcaaagctgacaattgaaggcatattgtagtgtggttagaggaaatagtaggcatttgattctatgatccttaaaagagttttttttttttttttgtttgtttgttttttaaggagtctcactctgtcaaccaggctggagtgcagtggcgcgatctcggctcactgcaacctccgcctcccgggttcaagcgattattctgcctcagcctcctaagtagctgggaccacaggcgtgtgccaccacggctggctaattttttgtatttttagtagagacagggtttcactgtgttagccgggatgatctcgatctcctgaccttatgatccacctgccttggcctcctaaagtgctggtattacaggtgtgggccaccgtgcctggccaaaagtgctcttgtatataagctactatcattcctgtataagcaatgctacaagcattaataaagtgatgggcatgtgagtttccactgagttttctgacttacagcaagattgactcttccttccattagcagaactgagttgtagaaataaaaggtacacacacatacgttaagataatagtttttttcatataacaagtaataatcatcatatatattcatgattaactcaccaggagtcagtgggatttcttcacctattatataaaagacaaaatcgtttggaagtgaattttcccgacttgtatgttaccaccaagtttcaaattccagctctactacttaccagctgtgtgaacttgagaacttcctttgtcctttctgtgctcaagtttcgtcatctatcaaatgggtctagcggctgttaactacctcagaaggcttttgtgaggagtcatataagtgaagcatttggaacagcgcctggcacattctcacttcctgatatatgttacaatgactacttcttccactcttattaatactgctaagctactattaataaagttcctttggctggatgctggaaggagaacatgggtcaaggttctgatgaactaactttccctgacagccccctcccctccccttctgcctgcctcccaggcagaagcagtggatattcaggtaggagtggaggagcagggaaatggcaactctttcctctctgttcaccatgattaataacatggttcatactcccttataatatattttttgttaaaaaagggaatggagaaatgagaaacaaatggcagtgggagtgtagccaagtggagaaactcagggccggacagacctggcaccagcactaagtagctgtgtgctgttggtgtgtttttgacctggccaaccctcagcttcttcatctgtgaaaaggagctaagcacagcccttactcagggggttcaccaagagtacatgaaataatgcctgtaatgcatttgttgtactgacaaataatgagtttgaatgagctattgtttaaaatgattcaaaaatgacacttcaaagtaaagcatgagttttctcccttatctactcccaagggcctcctgtcctgtttttgttttgttttttgttttttgagatgtctgttgcacaggctggagtgcagtggtgtgatcttgggtcattgcaacctccacctcctgggttcaagtggattctcctgcctcagcctgccgagtagatgggattacaggcgcctgacatcacgcccagctaatttttgtacttttagtagagatgggatttcctcatgtcgggcaagtcctgacctcaagtgatccacccactttggccttccaaagtgctgggattataggtgtgagccactgctcccagccctggttttcttaatggccatttttgtatttcctcttataagcatggtcttctactgagagaatcaatattcagaggattcattaatagctgttcaacataattttagcatccttcacgaatgttaatccatttaggaagaggatataagtaatcactaatttggaatctaaactgtatgtcttaaacgtatatactttaaaatatttctgtaacatatgtgtagctaatgaagaatatatctaaaacattgttattttataaatttgtaagcaactttaaaaaaaattccaaatacaaaggactatgcagtttcttaatataagtatctgacttctttatttagtgttttcattttctatttaattgatatttaggagaaattaaaagatcagataagtgaggcagggagggcattttattttattttattttattattttttattttttatttttttttgagacagtctcactcagtcacccaggctggagtgcagtggcgcaatctcggctcattgcaagctctgcctcccgggttcactccattcttctgcctcagccacccgagtagctgggactacaggtgcccaccaccatgcccagctaattttttgtatttttagtagagacgaggtttcaccatgttagccaggatggtctcgatctcctgaccttgtgatcctcccgtctcggcctcccaaagtactgggattacaggtgtgagccaccgcacaggcagggcattttagtattggtctcttataattggctataaaacaatgtctttactactgtgtattataaatatagtcttagtacaaaaaacaaagattgttatgaaacattatccagcattctacttttccttccacacctatgtcattttcatgtgctaaggttacatttatagattcctacctgacacctccactggcaacttcttttaactgctgttggatatacagaaatcagagagattgtctgcagaatgactctactgggccccagaaaaaacaaacgctaaacaaaaaatggagcccatttagtctgagcaactaggcaatataggagtgttggtggagaattaagaaagcggatggaaatcctatgactctactgatgatgctccaaacatttctggcttcttagccagtcccaacaccacccttccttcttttgattccagcatgtgcgaggatgcaggactcaactactatgcattcaggctatgttctgcgactgcacggtgcactgcttttgtaatgcaaataggaggcacaaagtgtctctttgataatgtgcagtcagaagacaaaaaagcattcactgaaacagtaaaactaattcataaagctgaaagacaatagggaagcattatggatttttttaaaggaaaaaagtatcctagatcaatgtaattgtcacagtgtaagctattcacagtcaatgcaggaggggaaaatggctgcaagtttatttaaagtgggagaagttttataggcaaaaaaccattatgttaaacaaatataaatatatttggttaacaagtttctgcttagtctcttagaggtcaaatatatagctggttattttcatttagatccacagtattcccttagtgacaaaaactcagtagaagttttaaaagagcacagagatctaatagttaaaaaccatatggtagattttttttttttctttaaagggagtatctccccatcacataccagagtttagctcaaggtcaacttatattaatgcattaaacttagctgtggaggaggcaaagggctggaggaaaaaggataaaagaagttctgaaattgttcttccaacatattcagccaagcaacagaacattgcctggataaggcttatattggacagttgccataattcctcctgttagatcagctcctctggtacctattcccataccttttaaagtatagcatgtaacattttgcttgaaaattgcttctacctctattgctttgttatagccgttttgcagtttcggtatagaggcagttctgtgtcacaagaaattactaatctgaggcttgagaaggggcagtgtagccttccattatctcaccagcaagctctgtacaggattattttcaaattttctgctgccattacaatgtgctattagagtggccaaggtggtgagggaggggatgttattgaaacttggttaccagggtagataagataaacttcatcactttcttggcatccacatttgtagccaagggtggaaattttgatgaaagaagtacatttggtcaaagatattaaggtgtaaagctggatattttctaactgcattctacagagtctgtctcttccccattgatgctcatctgaaatagtctgcttgattgtttcaataaacacactttctttcaatgtattgtaaacttgtaaataccagataaccaacttaaaatccccctcccatcccagtctcaagaaataacactggttatgtgcagacataactttcttgagtaagtcaccattttctgtcactttctatttgcggctggtaaaatgacagctcaggcttaacttttacataagctatttttagatttttctcagacatcctttaactatttcttttatacaggatcctaccctaaggatcattttattctttgacggggtcattaagcaatcactctatactggttcattattggaagtcactgcaatatccagaaatacatgaagagtggcaagtggtttatatttcagcaagagatttatgctagaaaggagaagtcaaggtgttgacgattgaaataaggatgatcatttcatgagttattccctttcgctggggttccactgcccacaagccacttagtttccctttgaggccagcatctcttctctctgcagccaaaccagcctaatacacatgtgcaggtttaatgctggaagggaggggccagctttacccatacataatcactgttttatggctttcactcattcctgaggtgttaatgcagatcaaatgggaaacactcgagaaagaacccttgcagctactgcattgcctggctctcccctctcaatcgttaattcttattgtaagatctaaaggtaattttgtttgctctcttaatgtgttgcagttctcccagtggcccttgcatatcctttctcaaattcccatcttgatcaattgtttgcaaataattaagcttttaaaagataatagcatgaggctaatgtacacaacaaaggcgaggtctccctcactgtctatgggactgtggtcaaatttgctttgatatcccgaagtgattaggttgattggtatatctgggaagtgccatccatcttgccttcacaagagcctactgatctttcttaaactgtgtccttgagatgcaataacagcaaaggtgtttgggaggatggcaaggagtgacataggcctttagttgcaaaggtttggaatgaatttcccattttctccctaaaaacagcacttctcggagattactctttatctcttttgcaaagtgacgtctgcctttgcccattgcatggcctcactagacctgtgggcagaaggcaacagggctttcaatgtttttttttcagcagccatgcctgtggcatgctgggtttttgtcaagtcatttttttttaagtctataaaagaataactcatactgtccacaaaaagctttatttagtaaagatgcataggatttaagatattgaaacatattaggtttcagtttaaaagcctacttctttgtgaatttttggctggttaaggattaactacatgaagtcacggctttcatgtgattctagcaattacagacttttttcagggaattgaaagtttgtgggacactaaggccaagaactatgagaaaaagaaatacattcagttgacctaccatagacaagggtttaggaatgttgttgatacctttttctcctcttaacaatggccagattattgtgacatttaatttgtccaggctcattcatttgtattaaaaaaatatatatatatcccgaacaactgaaaatttcttaatggagacagagtgctgagcctccatagcttgaggctgcctagcaattatgctgcatgaaattagatacagtttgttccaattacttaaaatcagatcacatgaaaagtgacagaggaaaaaaagggtagaactttctaattttgtgatatttaaattatgaaatcagaaactatatgatgtgaagaaacaactgaaatttgcactgaaattttgagagccatattactaccctttgaagctccaggtagtggtaatgattcaaagagaatttttgtgacaccacttgcataaataaaatgtgaattccatttgctttgtaagaatgtttgtaaaacttgctcataaacaggcatgcaaaagtactcttgaaaatacaggaaaataaattactgtgacaattttcagttttcaaagtaactaaagataaatggtataaataataatttttatccagttctggtcataatattaagacataactaataagacagggcaaaaggttttgccatctgactatactaaagaaggactgttgacatatttattaattctattaaaaatcactgcaagtgatttctgtaagacctggacaactgtcagcaaataattttacaggaaatgttatagattggaagttgcttgtgtacttcagtgtacaactttatatgacacatagtgccagtggtgggatgctaatatttgcatatttcaaaattgagcttgtcttctggcactgcaatattgtaagaactgctagcctgggtaatctttaacctcaatggatcttagaactctggatgacaaaattgaggataagaaaagttgtctgttgttcaaagtcccatagttaatgagtggcagcatcatttatacaatctaatagagtcacctatattaggtacaattcttcaactagtagagacatagacctactgtatatcaagctgtaattcagcattctatccatgggataagaaattcatttggtttgtattgtgtgccaaatctttatacagtgggagttatgttttaaaccttagggtaatggattcctttgagctcagtagccagtcatgagactttggctgcaatggctggcattctgttgagtagtcacttatgatcttagcctattaggaggtttatataccttcatttgaagaaagtgggtcaacatcacttttgtgaatgaagcaaagaaagtagtgtcatggatcttaaattggattgtttctgctttgttatacaatttgatgttgcatctgagtggagagtgtctgtcatggcatggtacagccattcctttgttccacaaatatttagtgattttctgttatgtcccagtctgggctttgaggataaacagaaagcaaggcaaggggtttattagcattggtagatgagtgagaaaagacacaccaacaaggaaataaacaattaaagcaggtgcttcagagagtgatgcttgctattagggaaataagaaaaagatgaatgtgagcgtgataaggcggggtgctgggaggtggggagggtaaagctgaacatttgagctgagagctaaaagtgacattggggtaagaatctgagtgacgggaaaagctggtggtgttaggaaaacagaaagaaggatggtgtggcttggtataggggtaggaagcgggtgagaagaaggtatcaaaatctgagaagtgggcaaggctggatggtgacaggccttgcaggccatggtaaccagtctgaaggttatttcacaggggacatgaatggggattatgaaaggcgtctgctacatcctttggtcatggtgaggcttaggcactgaaagggaagcaggaaatatcactgacttatgtctgcctctgtccatctcttcccctggccagtttcctcacctgtaaaacagaagggatgatagattccatttatgtcactcaaagggatataatggggattaattaccatcctgtctgtaatatacttggagctctttagagaaaggcactatattccatgaaagcaaagccttattctaattgtgtatttattgattaagtgacaatcatagacaatgcttatgggaaaaattgtgatctctctgctgttcacaaacaaatcccctgtgtatagatatagagcatatttaaacttacatataagagtactgaagtggtcattaacaagcctttttagcatctaatcagacattattaattaaattaaaagctatgtcaattagcattcaatagacgacaatttagtttccatggcacagatagttaaattaagggttgggggtgcacttttccattcataatagaatagagggttgactctcagaagaattttatcttgggataatttattgagatgtggtgtttcaagcaagctaatgtctctatagatggaaaccatatcctcagctcctcccctaagctttagaaatatgtatttcaaattagatatatttgatcagtgaacagaaagcatttgtgccaaaactaatttcagtagaattccaaacgttcttacaggaaggtatgaatttcactttattatctaatcctgtaatacttttatctactatgactcttgaggaacatagctgggcttgttcttagcatgcaaaatatgctggtctttgaccttatattggcctgtgttcagaatctcagcatgtgttgacattcagatttggaaaccaacattggtgaattttgttttttttgctgaggactgaaaatgaatagtgtatgtgtgtgtgtgtgtgtttaatagcacccactttagatttgatatttgcatctggcaatatggtgttttagagggagaacgtcactatgtggacctcagctgagattgttggtccaaatgggtcagctttagaaatttatggttcaatgaatatattaagttagggcagtatacttttaggtggtaacaaatggcttgtccttattttaatcctataaaatacagtgaagatcatactaaactttctgtgtttgcaacaaataaagctgttaaaggataaactcagtgtcaaggttctgcaagtatcctaagtagctatttatacacttcattaatctttgtaattggcttgtcttttactgccattaattagatgatgtagtattccattaataagagtgacacacctcagcatttttacctttaattatagacttcatgagacacttaggctattgacaaaatggctaaatattgcctgatgcacacgtatcttttttattctctttcagcacccttacccttctgaagaacagaaaaagcagttggcacaagacacgggactcaccatccttcaagtgaacaattggtaagtaatttggctttgtgtttacacacaatctgtttccccctctggcaacctgcagctcatgttttgcattaagaagacacacccagttgccactgctttccctggtggcttgttgattcaaaagtgaaaacaaactgttgactgatatgtgagaacatttgctagtatgggaaataaaacattgtattgtcttctacctcctttataagttgacaattttatgcatagtataagtatgtgtgtaattcacattcactatggctctgtcaatgtatctctctctatggctttttttttcccccttcagggtaatcgatagagtagtatcatcctattttctacaaaacaagaaaatccaccatcacatatcagtcaggtttaaattcattgaataactaaattcagttagattttgttagggctatgcattcaaggatagcctctcctttgctcttatctcctgaatactgaaaggaagaaattatttgtttctctttgaggctattccaaacctgaggcatctcgtggctgtgcaatactgtttctaaataaagtgtaaattcctgatttggggcgaagctgagattatgtaccaagtaccagccaacaatattctgactcaatgtacagcagtgtggcaatgaggctttgagaaagtatgatttattaccctttgtgaatgtgctgaaagccaggtttcatataatcacccaggactagtgtcatatttgaagggtatcgaaatccaatatcctctaaaagtaagtgtatctaattaattgtcctaatatttttagattagtgtttatgatggggaaaccttatcctctttgaagtaaaatccagaaaaggcccaaagcctgggctggggaaggggagaactaggaatgccagtttgcagacagaagtatttctttctgttcaataagtgtcaaagattaatattacagaatctctgattacatggcctaatccattttggtgaataaatttgttcttgatgtctattgcacctacattaacagacccttctctgttagagagcctgggagcctttgggagagatttcagatatattaaaccccattacagaaaatgtaatttctgtcaatataatcccatgtattcttcaatttagtattttagagataacaagctacttacaatatatttgcctttggaggattaatttacaaagtgcactatctgcaagacacagacagactcacataagaattgcttgtaagggttatcaatttctatgaccttactgctgccttgagagatcaatttttgcagcccttttcatcagtggatggtaaaccaagcaaaggcatactacatctaaatgtgttactacgagttgtgtggctgctgaggttttttgtttgcctatttctacctgctactgtgtcttaattttcaaggctgttaatactacatattggaaatttcaaatatgtaataatttcatatttgaaatatgaaatttcaaatatgtaatatttgaaatataatatcctggatgatattataggggagaccatcaattttgcgtgcacatctagattcatatatctgtattttaaaacttaaagctgatgttgagacagttttaatacaatggaggctgcacaaatgtccgcatttccctgggaagtgttcctgtttgcgggcaaaggagtggcaggacaagctctctagttaagaaacgaaaagcgctgtcattcaggggatctatcctgtgagccatctctcttcctctgcagggttgctagcaaactccactcataaacacagttaccagagaacaaatcccaatacaagttgcttactatgggtggacggccttattatgggatatttcctgtgaatgcaggaagaggaaggcattcttgtgacttcaagcaatatatatatacacacagttttctaaattctatgcacagtctctgccggagagcaatcttcctaatcagtccatgatcacaattcgactttctcagttttgtaaccagaagggagagaaaggatgtttaaaaagttttaattcacactctaaaataattttaaagtatatgcagactttaccctaaacttcacactgctattcaattctgcacgggtaaataacttaaaaatagcttttaattagttatttgggacagaaacacaattctgtgcttaactgccactttgtgcagtgtgtggtttctctctacttgtatatatatggagttagaagtggcttttgcttgcaccacagtgctttgcatttggcaattgtttcaacatttaacaatgttgtttgctgtagaaaatgtccctcaagtaactaaaagttgtaagagagattgtttttctttagtttgacaaataatgacaataccatgtttgatttgaatttttaatggtttattaatttttatagaaacctcttcctgttttgttttgttttgttttgttttgttttgttttgttttgttttgttttgataccgagtcctgctctgttgtccgggctggagtgcagtggtgtgaacatggctcactgcaacctccaactcctagctcaagtaatcctcctgactcagcctccccagtagttgggaatacaggcatatgccaccatgcccagttaatttttttttcttttgttgaggcaggggttttgctatgttgcccaggctggtctctaactccagggctcaagagatccacccacttcagcctcccaaagtgctgggattacaggcgtgagctactgcacccacttataaacattttttataaaaaatgtttttcatcttagctatactgagcatcggtacaagttattttctactaaaaataataattttgaaaatgtcatcattagtatttctgtgtttccctttcatttatttatccacaacttttaaacatctgtgtcttccttcttggatttcttaaaacttgttaatacacatgtacatttttgtatgaactatgagtcactgttgaaatgcaattcaataaaatgctgaaggacaggttgagtgtagatcagtcataattattagcagtaacataatgtatcaaaatatataatatgtaagtgaaaaatataaactcatgtctagttgttagagtgtcatagaaatcctggctgatgcagttttaagttaggctttgactgaaaaatagacaagaagtttgctacattttaatggttctttcacttcatcactgaactaattttacatttctcgaattgacagtgatatatactacctgcctcaggtggctaaggctaaagtacatgggatttgaggggagaaaggcaaaagaggagagaacttaaaagtaaaacaataagactgatttgattaattaagagaaaatctggaaaaaagaaaatctcgttataactcttattttggtccaattgtcagaataaaaatggagagaaagaatcttaaaatggttggcatcagtacttacagcatgtgggccctaggatggaatgtgaaatttattagatgtgacattgtgggccaagtctatgccaataaattttttgagaattgaggcaattatgtaaataatttgagtaaaatatttttaaataaattatctaagtatttgatgtgactgcatatttttaaaaaatcaacctccataactagttgtctaaatatttcaatctagtatgttgtggttgacttagatttaaaagtgtaatcattttcgaaacataatatgcaccagagatttatgtattcttccttctttggtcccttgctcccaattataattttatccaaaaatgataaataatagcatcaggggcttttgtctctttgcttttttactgttgttgtggttttaacaaatacttatgttatatcagcagtgcaaacattaccaatatgcaaatgttttagtaatttaagtagaaacatcttaaattttgagattagatggttgtttagacctttaagtatttaagtagaactttatggaagacacacacacacacacacacacacacacaatcaatacttggttgttttttctcctgaatagaccaacttaatttttttatattgaaaatgtgagtgtagaatggtcagataaaaattcccttatacatgatcacaccagtgttgcggacctgggaattccctgtgatgaaaacttatctcttgtacttgtgtcgtacttactggatgcctcagttgcctcctgcctcagcagagttttggcctagggtgtactgaatacattttacagtttctttgtttactactcctcatccaaacactttcctattaagttctgatattaaatgattatccctttatgctctgagaaggcaatatgggttttaggtgcaaaatatatagtgtatgtgaaatacagtatttatatatagagaaaaattattctccatcaagagagcatataaaattccaggttccatcctagcagccaagatgacactgttcagaactatggtactctacatttcttagatttagtgctcataccagattttcctagttatttcatttattgctttcaaagctgcaaagcattcaggcatcacttcccatttattatgagtgggaaaaaagtatgttatccttggagatttatgccactggcaagtaaaaatgtaaacttattttttaaaaataagatctcctttattataataaacagattcagctgttaaaggtcaagtttctttctgagttatggtaataatatagcaaatacttttacaaataatcaaagattctataaatataggtacctgtttagatgtaaatgttaaaacattcacaaattatcctttcaacttctgtgatctaaaaatcaataggggtcatagggtttcatagaattgttctgctttttcttccaacataatttaataatacattttacagatgttgtttgaatattagacacagattgttttgtcaataaagttaaacagaggtatgacacaaaagcaaggaaaacagatgtaaaaaaaagaaaaaaacagtacacgatgcaagaagctctgggtcacttgtttgctattcaactacaaaattaaagtgtgggctgtatggtgattttccttgcctaggaatcacctagggatggaacagcttcacacatagaaagtaattgtattaagcaggtggtttaactttttcccttgagaattgaagtgtaacctacatttaaagtagacttcctaattgatcaatggagtaacaggtgcggtatattaaaaagaaaaaggagaaatataaatggaagaactccccagaatatttcagaatgggttgttgttcttcaagcctcggttaattgctatgcttttcaccttgagtgtcaattctaataatattacctttacagacgcttactctgggcttagattatagcaatcagtaatactcactagataaaatactgtctagttgctcataagaaaatattgaaatcagtcaaaaaatgtttagcttgcatattgcctgagacagagctggcggggcgccagacaggcagggtattattaggaaagctgagcaaatagctcgcagggaaaagagctgtgaatttagaaaccttcaggtattgtcatgtcagagagtcttaagagttcaacagagacactgctttttttttccttcagatttaaaaaatttccaacaaacaatcttctttgaaaatgactctgcagtctgttaaatatactttgttgtaagttttacaccataagtttactcagagcttttccccactgcataaaatcacatcgttaatactgttaaagacgaaagctccttatgaaagagtacactttgaaacactgtgctggctggaaaaaccctgccccttccaccatggggccctaagtctaggtgagaaaagaaatgaaggtctaggatgtaggaagggtggatttgaaagtccaaatatggttttgtgtaaccactgtttctcctccagccagcattcaaaggcagttgctgagcttctcaggaggacaagacactagctggaagctgcaatccagctggtacaacctgaggaattatgtcgggaccctgtagggttggggttcaagtgaggctcagagttgagtgagttgggagactgatttacccagcagggacccaatgtttctgaatatccatgattcatttcaaggcaatgaaaccagtgacaacggaggttgactttgaacatggtatgcaggtcagcacaacttgttgcaaatcctaattaagccagtcttcttgttttcagtgtgtctgtaagtatctggtcagagaaatgcaaacaacaggctgtgggtcatgcaacccgatggggcaggacttgactcccatttccctggagagggcatagggatgaggggctgagaggtgtcacggtcaagggggaagagcttggctacgcctcatccataggtggctaaggtgtaagcctcatgacaatttaaaatttacacagggcaagtatgggaaggggaaatgcagggacaggtcgctgcaatcaaaacatttcatccctcatccctactccttggatttgggcgacagtgtcctctggtttaaaatggacaagtaggacgaattagtcaggactcaaaggactcttttagctgtaatattctagactgtgtaataatgtgaatcaaagagaagtaaagtgtgcgctctgaaactctcattccagctttatcctaggagtggggaaggaaaaaaaatactttgataaggagacaaacagagaaattaattaaaaagttgtagttgtaactttcctcatcttacataagcaaatcaaacactgtaaaataaaaactagatgaaattaaacattatcacaagacatgaaaaagatgtgtgctgtcattttaggattcataataaagataaatcagttgtttttagcagtgtgctatgagtctatgaagggcatgacagataataggctcgaaatttctgaagttattgtacagcaaaatttgttttttcctcaggcattcaatctttttctccagtaattttgaacatgacaaactttttagtggatgcattaataatctataagtaatgggttgtcaggtgtcagttagataagattaaaagactgtttaagcattatccatttgcttctttgcatgagttttataggtcagcagaaataactttttgaattgtggttgtgtgtacgtgttctctctctctctctctctctctctcgtctctctccaccccccaaacccccctccctctttcatttggctccactccaagcatacgtggaagaaccgtattacattccataaatcctgtatgtaagagcagatttgaaactcactatgtgaatcaaggggacaaatgtctcagctgtcttctgtaaatgtattttagtttttaaaatgttactcttcatcttctcaaaggaagctctgtaaggggaaacaaactcggctaagaggggcattgaagctttagacattagtagtttcctagcaagtcaggtttaggtctattcttgtcaaatatgtcttaagtgtgtttacatatagtttgcctttctggtattttctgcttgcacagacctgatctccacctattttgtgtcaacagttgctgaggctggtgttgggtgattaaccgttaagcacggaagcgcagtacccagagagaccctctctctcctctcacttacatcatcatctggcttcaggctgtgcctacagaaaacaaacagcatttttgagtggttaaaaagtcagcctgaaatattaaaaaatggggcaaatgttgcctcctggttgaatagaacagttttcttgaaaaatggagtggagccaggggctcgggggaaggaagtgtttccgagggcaaacgttggtcttagatccggtctgcattgctccagtgtgtgcacgccgaggagctttctgtagacgctgagggttatgttctgcttcgtttttgattttcaaggggaaagaggacatacaaaacaaaaacaaaaaaaaacctacaacaacatggatgcctgtaactttggcaaatataaggctgtcctgttcaatgccctcataaatcattaatattttcctgtctattttattttcattcttacaacgctcttagcctgaccccttaatatggaaaataattaactctttcatgctcctgatgcctgaacaataacaaataaacaaaagaatattaatctgttccgacatatttgagaggtttcttttcctttttaccctcttaactaaccagtgcctcacaagattagatcctatggttgaagaaggggaaaagtatttcctttttcaaacacattaactcctccaggtctgggggagatgattggagctacatgtaacttagctcaaaaataaatgtcctgcctttggtgagatctggcttaatattgataaagtcacttttttttttttttcaaaaacaatatgttgcctacggatggaagttaatgcaccatataattatacacacatacacacgtgcatgtaagttttcagtatttttactctaggatgctaactaaatcaaatgcaaaccagtagtcttgaggtttgttgtctggttgaagggttttgttggcctatatcactaggacatctgcagtggttgactttgtttgtttgctagtttgggtcatagttcagatgtacttggaaagggccggggagtgggtagggggatgttttaaaagcttatggaaagaattgaacatgtacaaaaagatataggatctcagccccctggctggttacctgacaatactgtttacagaaaggaaagtatagtaggttatggcagagattcctatcctcaggacttggggcggggtgggagggggcgcagagagggggtagcggggcacataagaagcatgtcacaatcattttgagtgaatatagtatttaaaaagcatatcgagaattaaattttgtttttagtcatgctatttcttttgaaattgcaaataacaaaggaatataagatttttgatgtgtcaaaagggagcatggattaaaattttagaaaccctatgctacagaaccataaagtaaaaatcctgggagggagggaatttatgcatcatacgacagatgaggctcagggctaattagaggcagggctaggactggttcctagtccagtgcttcttccagtccactagaatgtacttatttttaacagctttattgagatataattcataaaccatcatttcacccatttaattcaatggtttttagtgtgttcacagagttgtgtaaccatccccatagtcaattaaaagacattttcaccaccttaaaaagaagccttgtaccctttagctattgcccctctttatacttccgtctctctctccaacagctcctggcaaccactaatctactttctgtctctatatttgcctattctagacatttcaccaatgtgatcatggaatacgtggtattttgagactggcttttttcactaagcataatgtttgcaaggttcatccatgtcatagcatgtattatcagcacttcattccctttcaaggctgagcaatgttccattgtatggatataaggtatcttttttttacctatttatcagtggatgggcatttgatattcatctcttaccattataagcgttcatatacaagttttggtaccattaagtatttttgggaatgacagtatagcaacaaagacctgtcttaggtttgtataatttggaaagcacttttcattcgatcatcccaatttcagcacctaaacactgctagaaaacttgccggtgagtggcagttttcccactcagttctcatattcttctcactacacactgctctcactttccccgccactgggtagtgttttgactgtgataattacgagtgatgttcaaagaaaaggaaagttggctgggcacagtggctcacgcctgtaatcccagcattttgggaggccgagggaggcggatcacctgaggttgggagttcaagaccagcctgatgaacatagaaaaaccccgtctctactaaaaatataaaattagctgggagtgggggtgcatgcctgtaatcccagctacttgggagactgaggcaggagaatcgcttgaacgcataaggcagaggttgctgtgagccgagattgcgccactgcactccagcatgggcaacaagagtgaaactccatctcaaaaaaaaaaaaaaaaaaaaaaaaagaaaaaaagaaaagaaaaagaaaaaggatagtcacactgaaatccagcaactcagcagtaaaatgcacaaagttccctcgaaatgacttagatgaccataagcattttcaaagatttgacagattccaagatgtcattttgctaatgttattgtctttattcgagagattgttttcctttaagtgtgtttccatttgtattttaaaggtctacaggttacatattgacatatattattacatagagcttaggtttcaagctttactcattaaaacagaggtcacagtgaacattccaaggatgcatgcaagcctccattcaagtcaaatcatcttcattgtgccattctatagcctaatttcataaccagacggaactagaaatcaagctaaattttgagatatcctctcttgacatgagcagagactccaggtctagaggtttatggttgctgaagacttggagaactgaggcaactacaggcaagatcctagagaaaggaaggagctcaaaggtactccaatatggagctaagattctttaatacctgattagggccaggcacagtggcttatgcctgtaatctcagcactttgggaggctgaggagggcagatcacctgaggtcaggagtttgagaccagcctggacaacatggcgaaaccctgtctctactaaaaatataaaaattagctgggcatgttggtgggtgcctataatctcagctactagggaggctaaggcaggagaatcacttgaacccaggaggcagaaattgcagtgagctgagatcgaaccactgcactccagcctgggtgacagagagagagagagagagagagagagagactctgtctcaaagacaaacaaacaagtaaacaaaaaaacctgatgtatatgggggctggttgccattctaacacaacggggttttaaattatttgggggaaactttctttggaaaataaaacatatttgatcattaaggtgaccatgcatcccactttcctgggaggctcatggtttatgcctgttgcccagtgtaattgttaacagtgcctcttcactctcaaacgtgtcccagtttagatgacaaattatctgctcatcatatttataatagagattggcagaaaactagaatttgctttaaatagatacatttattcagtaatgtgtaagggatgttttgttagattcaattttattgacttcttgtgaatatggaaaaattggaatttaaatgaaaaatggttcatctattaaactaaagagagacacttctgttctttgaagacattattatacctattttagctttttcattagtagaggaagttttgctatattatcctagatcatgctattgcttctacattgtgctaataatcattttaaatctatattctaaaccactattttttttagctccataaggttatacaaactcaaatttggcaaattgtctgttacatgtaagtaaatattttatgtttacttaaatataaatataaaccctgtctcattctgttgcctaggccggaatgccatggtgtgatcatgattcactgcagcctccacctcctggatttaagcaatcctcccacttcagcttccctagtagctgggactacaggtgtgcacaaccagacccagctaatttttacattttttgtagagacagggttttaccatgttgcccatggtgatcttatactccaggctcaaatgatcctcctgccttggcctccaaaagtgctggtattataggcataagccacaactccctgccatcactttttttttttttttttttttttaggatgaagtcatttcaaaatttgctttcaaggaaaattttctgtaatatataccaagtgatgaattatttgaaatttattttaatgcctaaggccaaaataatacatgagttttgatattactttgcatcatcattgtcaactagtgattggttcatttcacaagctgctttaaagagaattttagtggctgggtgcagtgtctcacacccagcactttgggaggccgaggaggttggatggcttgagctcaggagtttgagatcagcctgggcaacatagtgaaaccttgtctctacaaaaaaaacaaaacgacaaaaactagctaggcatggtgatgcataactgtagtcctcggaggctgaagtgggaggatcactcgagccagggaggtggaggttgctaagctgtgatagtgccactacactccagcctgggcaacagagtgagactctgtctcaaaaaaaaaaaaaagaaagaaaagaaaagaaaattgtatatgtaattaccttcctcaactgtggtagacaatttcagttctttctaaagtaatttggcaaatacccccaacactgttagagaaggaaaacttttcatgtggctgattgatggacttcttatgatttgaccaaatttcaatattatgtttatcaagtgggtagagaagagaggtgctcccttttcccctcctgtctattctcctcctgccgctgttctctacctcccctacccgcagacacactgatgatgtattgcaatcttggaactgttggatcctggaggaggttaagaaactagaaaaaggtgccaaaaacatgatttcataaggtttgacttgagaatgaatcaactttcttgaatatcttaaaatcatgtttcatgaaattttatttcacaaagaaagggagtgtagaagacttgaactctgaagaccaacagttatggatcattaaatccaatatgtaaatgtaaatctaaaataaagagttccaacagaaaaatttcagagtgatttttttattgttgtttaaaagaacagagagttacatgggagataactagacctctttccctgagggtttgtttataaaacatgccttaaaagttattaagggatgctgactttaaaaaaaagtagtagatatgattttatttaaatgactatgatatagatgaaggaaatgctatggtgaggaaattcctggaataaaaaaataacaaaatgttgggatttgacaactaccttccaatgataaattttatatttgaagatttttcatgaggtttaaattctaaaatttgaaaatatttatagaaatcacaaaaatgaattatatatcaattatcatctgtgcatgtttattttctattgaataaagaatagtatatgcagaaatcttatatttaagaatgcacagtgttaatttttattactaagtttttatagagatattcctaacgctagctaaatattaataaaagattattataatcagcacttcccttaagggatagtgtaggtatagaaggcattgccactaatcaatctaactaattaacaaaatcttttcttaatagttgattagcttcttaggtacttgcagatgttgtaaaatgatatttctctgtctagttaggaaccttctgaagtaattctatgtccaccactatcctgctgacagttcacttacgcctagttggcaagaaacacgacggggggtgaagcagagccatgtcattgtttggaggcaacaccattgtgattttctgtggtttaccaagttggctgtggcatgctaacataaccaaatgtgggcttcctttaattatcagggagtaagtagagtggtaaacactgaggaatagaactaattgagtaaaggtgaaaatgctatttctgaaagtgagcaagtaattttttttttttttttttttttttttttttttacttttatcagtattacagagagccatacaagggaggaaaagggcaaaggtatgtggaaaatgttgcctgtgaaactgggaaactaccttgtgttttggctcctaacagatgcccactgtgatctcctcacctctcctggttctcacagagggaaactaaacttagcaattcagttttgggggaagagaccagggaaaggagtggaggataaactaaaggacaaaggtcagtttcaaaaagctgttctgccagatcttgctcagaaaactattcaggtatccaaagactgagaataaaaggagatagatgaaattagtccagtggaaaaaaaaaaagcctaatgataaataaacatctggggacaaaaaagaaagaacaaagcaaaacttcctgtatttcttttttaaacatgagtcacagtcacttcccattctccttgtcagattcctataaaaaattcaaaataaaattcaatttttagatgatccaggtctcagatttttggagattttgctcccctgccaactttcctctttcgctttttaggacttgagtcttaaacaaacaactaagtaaaaaagaaatatatttctatttggacatgaaaaaaagctatagagcaaacccattatcttcctttcctttgtaaagctttttgttttgagactggagatagtttggtcagaagaagaaattctaactcatgattctatgaaaaaaaggaaatataaagattcttctcctaattcagtcttccaccacctgcagggagtccaattcttaaaaagtacttcacaaaagaagactgtgttttcaaagcaaactagattttaagaaaccctatgttcgaatgtaaatgaaaaagcaaacgagacattttctaaccttaaagcatactaaaagatttactttttcaagaatcccaatgtatggcaaatttgaattatatttcattaaaccaaggtgtgtaactatctattttaatgagtgagcaaaactgtcatgtggctgtgtactcctgacattccatatctgagttttaagggctatgtaatattaggaccttaattgtaaaagtacaaaagtttcctcttacatctttaaactaacatactttgtaaaagagaccttatcagtatggaaaattctaagattgtgtgtatttcatagatatgtatttgtattttatctcaaaccattttgtggctgttggagaatgtattttttatagtatattcaaattggaattttgtcattcttttttatatttctcttccaaaacactatttcttctatgttgaatctctaatatatatttgtgttcatacataaatgtagatatatatttgaacacacagacacacacacatacatataggattaagataactattttacttatgcctcttaaaatgacaggattttaaagtgacaatatgttcatttaagttcacatcatatgtacagttctttttttggttcggtgtttagagaattcttgataatttagactcttccacaatgaaaagtaaagcattctgtcacaaaagcagggaggatgagacacaaggtcaaagggcattttagaaacaaacagctggaccaatttatttaaacagatagagggatggggaactgacctcagtttgacttatagtgggaggagcaagaatgtcattttattactttgcccagaaggaaaatgtttttgtatctgaattcaccctgaagccatctaaacatggctctgctgtgtgtagcataattccaaagagagaggatgtataaaatagtctgggataatgataaaatacactaaagagaatcaaatgtggagattgtttaaggtcgaaaaggtgatgttgttttaaaaataaaatattttgctatttactttgttgttttcacatagatgtccatcatgaccccaaataattagttgttcatataagtgtagtaattgtaattcagtaacgttctgagagattactacatcctatatgtactaatgatatttcattatattgaattttttaaattaaatgtttcacaagtaagaagttgcaggtagacctactaatgtggtcaaacagctcagaaaaggtgattagtttttctcaggttttcagtgtttttgtttatgttttattttttaattaaaggtttccccctttgatatctacacattctaggggtagctgacatctgtgttcttaataacaacaaacagttcttgccaccaaaaagaagcaaataacatctagtacctgtgggcagttggctaagaggctgtggtattttttgtgtgtatttgctttctacctggggatcagagcaggcctggaataaatgtcgttggtgttgtccactgcaaggcttcaggaggacatagacaaagatcagcctactgagcagagagtggtccaggtattgaatggactcaatatcctagaaggactcacattctagcaggcactttttaagaatcactaatgtttaacctaaggattagaggggagaaggctataaagcataatggctatgtttaactatttgaagggctatcctgtggaagtaaaattagaattgcttacagtaccccaaggagttgtgctgataaaactattaggttgggtgcaaaagtaattgttttttttttttttaattatactttaagttctagggtacatgtgcacaacgtgcaggtttgttacatatgtatacatgtgccatgttggtgtgctgcccccattaactcgtcatttacattaggtatatctcctaatgctatcccttccccctccccctgtaattgttgtttttgccactgaaagtaatggcaagaccgcaattacttttgcaccaacataaatatttttgatctagtaaggcagaaccttctaacagccttgtttatagatggggtggcctcttaagtaaggtggtgagtgctgtattagttcagcagaggttacctatgtacttttgggggacagatatcatataggggattcatgtcagtgaccaaacgaagtgaccattacagcccttttgaaacctgaggtgtaatttttaaaaatgaactcacgactttaatagtcatagactcaaacctgagttgattattatgaattagtttatgggagtctcaatatgtgaatatgatggagacaagttttggaatacagataaatcaagtcactgtattcactctctctctctctctttgaatagccttatctttgcctatacacacaaacagtgcagccatcaaaattttcaatttacaaaatgttcacagtcatgcttcttccttgactaaacactggggttgctgccagtggtaattggcttgaaaccagctaatttttatatatctatttagtctggatattctagatgagtggcactatagttgcggtgctctagtcactgtgccagagcaccagggaggagggtgcttgctaccactgacagctgtgtgtcatttagcaaattattaacatctctttggtaacatgtgacctcaaagaagtcacctaatttctctgagcccaggcttctcatctgttaaaaatgtctcttcctatttttaggtaagtagtataagtcacatccataaaagattatgtttttaaaaagtctggaaaaagaaagttaatagacagaattccttccctctaagagtctgcagataatgaacagtaccatagataaagagatgtttttgctctcttacctacattagttactatgaaaattacttttggtatatgcagaatattaatattaaataattttctaattggtcatgcagtgaaggcagctaatgaaaaaacagattttttttcattttaattggttatttcacatggtgtttgtgctacacctgtgcttataatgagaatggagaattaatctaaccttctgctcacatgattccagttttcatggtttatacaagataatgataacctgatttgcaacacaatttgttgtagacctgtgttttaaatatttttattagcagttcagggacttcatatacaagaactgatataatatgtattgccaacaagaattagcacaaacagtataccttttagttagattctagtttcattatttgtttcaattacttctcagataatgaaagaacacaaggatacaggatattgagaatcttaaaatgttatgaagtatgcatttttgttttgaaaacctgtccctgtctgtttaatggtttggtttttaggaactattttccttcctgaagtgggcagatttacaaactagaattcatactggactatggatcctttaatcattaatagagccttattaaacttttcattgtattttttatgtcctgctcagatttgatctgagttgggaactaaaaggaatttactatttcagaatctaatatgtcctcttcattttctggatttgatacgtaatttttaatattatgcagaacaaacggatcttaagagaatctcatgcgtatgactctggagagcgtatattaatacttttttacatgtcagtgacttgtcacttttggagaggctacaaaaataattgtacaaaactatcttattaaggcacttaaagtaacttaagtgccttaataagatgtttataaattttcagtactagctggagaaagcaaaactataagttcaattactgtatatctgtgaccttgccttgacctcagactttacataaagagcaaaaaaaaaaaaaacaacaacaacaaaaaaagccaccccaagaaatctctacaaggaatgcatttctctgaagtcctaagcagtgtgagttagtggtgataaactccagacattctctcatttgatggtgtgctgccatcccagttcattatcttaatagtgggcattaaaatagaattaggtttgcaagaggtaggggtggttttgataaaaattgtacaaaagaagtcagagaacataagattgaaatgtcactaattaggagaggtaacagatgcccttatgagcatctaactctttacaccaattttctctctttgcaaatgaaaggagtggtggctagtattgtttcctgaaaactctgctaattcccccatgaaaagatgaaatggaagtgtccaactgtggtaaaacaggcaaacataaatcaactcagaaaccccaagcctgtgtactcaaaggtcactgggggttacaggttttccagcacgtgaggctgcacatagagcaatggagagaactgaaggagtcccattttgccaagatctagttttactccaactgcgattcatcttttcctcttcctcaacccccccttttatttttaaggaataacgatttgtttcactttcttggttacaggtttattaatgcccggagaagaatagtgcagcccatgatagaccagtccaaccgagcaggcaagtcccccatagtgactgtattcaagtcacgcaagcgaaaaccatcctcaagccattcaccgggaggtccgctacctggtaaataaactgggagtgagtataggaacgcctggcaattaaaattaaaccagtttcgtttcataacaacactaatcaatttaacatcattataaaacgtttggagaaggtggaaaaaaaaagccaacagagaaaagtaactcttaaataatatgctcagttacaatattctttgtacacattcaatatattaatgttattttttttctgagtttgccttcccagctctttctgctactatgaccactccctggtgcatggcttggtgtggaattgctgtaaactttattacctgtcaaaagggcaaaggggtcaggattgcttgtgggactcagtaaagttcaaagacattcaatgaggtagagcttttgtgtgctttaataacccaaggcagcttacttctgaagcagcttttcatgtacagttaaaacacgggattcaggtagtggtataaatacatggttcttatttctcagaccttctcttgttaatatccatcttctggtgttcgactttttttttttttaataacagtctttttgttttgtttttaaattatgagcttaaaatggcgatacttctatgggatcctggcttgtggatctaaaaatccaagaaacatctctctaggatttgtttttgcattataatatgccagtaagataacaagagtatttgctaggggtgatgtgagtctttactttctttatgaaatactctctcatctcttagggagcactatggaaaactatgttagcatcgcattgaggcaacacacatttactcctgtaactttttttcttccaacacccattatgtggtcaccagacaaaacccaagcagaaagtttccacaccttaactgttccctctttgagctagatgttttaaaaactcagtcacagaggtgtgtagatctagtctgagagaaatttcactttgaatgtttaaaaaattatactagcctgctatgttctgtctctttctctggtatgttctcctcttagtctctcttgggctatttcttttgctctcagagactgttattaaaaaaccacattctgtacttttgtagtaagtcaaggaacaccttataatcctgatggacagcccatgggaggtttcgtaatggacggtcagcaacatatgggaattagagcaccaggtaagactttgtttttgtggtagttcctcatttttgactccaagagtgtcatcccctcatcaacacaggtaaatccgcctcatccttttctgttatctcaagctggctgccttgccttgtctgctatctgtgcatctaagatattgcagaggggaagccaggatctttatgcactgaagatctcactatttctcaaccctctagatcctgttttttttttaagggtcttttggcactatctgttgactttgctcattttctggcctcttcttggatttttatctcccttctaggacctatgagtggaatgggcatgaatatgggcatggaggggcagtggcactacatgtaaccttcatctagttaaccaatcgcaaagcaagggggaagtaagtacaaatggggtctttgttttcactttgtcctaggaatatttttcctcttgcattttcttatgttctccttgcccatagcttcatgcttgttcattcctttccattaaactcctggtttcttgcttccatcattttctttttggttgtgatcaagcttttaagcttataaatactgtgtatgatgtacatttatcctgtgtgttgctattgtacagtactgaccacatgacaaaacaagaagcagtcaggaggtgggggagtgggttgtcatagcaacagactgatttgcaaaatgtaagcagtctgcagcagtgcaaggagagggaagagcatgtccccaaagtgtcataaatctgtctaaccgcagttgatgcatgagttacatttctacactaacctgcaagacaccgaaaagctaaacagagacttcttttaggtaaaataaacacaagctttacttagggtaagtaaaggcatattttgagctccagtcaactaaactttgattttttttcttagtttattcctttgtctgtccatcataatgggattacgtgtggcaatgggaaaagggagaatacaaaatagaggtgtgcacagcaggctgcggggcttagcccaggctaattgactatatccaaattaagtatgccatcacttgcagtgtgacaaatggatttgacttattcagtatacaaaaatagagatcattaatgcaatcatcagtggcaggcctagtgaagtgggcctaggaaaactgtcccagattctcactcttgcattttctctcctataaagacactccagcaattcgagttcaaacaagtaaaactgttttgaacaccaaggctcttgttcacttcctaaattacccctaatagcactgttcttgctttgtttttgaaattaaaagcagttatttcagagtcttgcttgtgtctctgattatatttatgcactatttaaaatcactgctgaggccaggggtaattcgtactggtcatcttctctgggtgtgagtcaaatataagtttaacaattagctctgaaaacattccattgagctggggaatgcaacagtcttattacctcatcatggaattctctagcttagttaatttaaatattgtttcttagtttctgggtcaattaaatttaaatgatgtattttatgcttcgtgaccaattaaattactaggttattacaaaaaaaattatcatcttttttgattaaagagctgtgggtacagtatattttataagcaattttcattagttcaaaaatgttcctttaggctagattaagcagccattcattgttagagcctggagaccttattcgaaggtgttcatcgtattcacagtgcactattacttagaactaaagccaattgaacctacttagcaatagcgttatgcctttcacccttgatgattatggagcttatagctctcagaaacaatacacctgtcagtttccatcaactatagcaatccatgcagaagacaagaggccccctcaaagcaggaggggtattgttttaggtccaatttttcttattgttctcaaaatcattataaggtggacagtgttttgtgaagattttcttttccccagctctaagaaaccatgtggaaagaattcattgataactgttttgatttttttctttttttaagtacaggttttgctaagtaatcacccttagtgagcctgtgtagttcagctgcctgtgagatgtttggtgaccagctcagtgtattcttgtattcttgatagagaatatttcaggagacaaaagtgcttcttcagaccagacctcaaataacaattttattctttttaataaataagacctcagtaggcggacctgataacagtgacaatgaaaggaaaatagtggcaaaatgtgagtttccagcatgatgtttctcattttattttcttctgtatgaatcaaaagaatgctttacaaaaccatgttcccttaatcacagggttctctggcttttataggattgtcatagccaggaccacactattgctttttcataacattttctttttgtttctttcttttgaatttcttacagggctgcaaagtatgccaggggagtatgtagcccggggtggtccaatgggtgtgagtatgggacagccaagttatacccaaccccagatgcccccccatcctgctcagctgcgtcatgggccccccatgcatacgtacattcctggacaccctcaccacccaacagtgatgatgcatggaggaccgccccaccctggaatgccaatgtcagcatcaagccccacagttcttaatacaggagacccaacaatgagtggacaagtcatggacattcatgctcagtagcttaagggaatatgcattgtctgcaatggtgactgatttcaaatcatgttttttctgcaatgactgtggagttccattcttggcatctactctggaccaaggagcatccctaattcttcatagggacctttaaaaagcaggaaataccaactgaagtcaatttgggggacatgctaaataactatataagacattaagagaacaaagagtgaaatattgtaaatgctattatactgttatccatattacgttgtttcttatagattttttaaaaaaaatgtgaaatttttccacactatgtgtgttgtttccatagctcttcacttcctccagaagcctccttacattaaaaagccttacagttatcctgcaagggacaggaaggtctgatttgcaggatttttagagcattaaaataactatcaggcagaagaatctttcttctcgcctaggatttcagccatgcgcgcgctctctctctttctctctcttttcctctctctccctctttctagcctggggcttgaatttgcatgtctaattcatttactcaccatatttgaattggcctgaacagatgtaaatcgggaaggatgggaaaaactgcagtcatcaacaatgattaatcagctgttgcaggcagtgtcttaaggagactggtaggaggaggcatggaaaccaaaaggccgtgtgtttagaagcctaattgtcacatcaagcatcattgtccccatgcaacaaccaccaccttatacatcacttcctgttttaagcagctctaaaacatagactgaagatttatttttaatatgttgactttatttctgagcaaagcatcggtcatgtgtgtattttttcatagtcccaccttggagcatttatgtagacattgtaaataaattttgtgcaaaaaggactggaaaaatgaactgtattattgcaatttttttttgtaaaagtagcagtttggtatgagttggcatgcatacaagatttactaagtgggataagctaattatactttttgttgtggataaacaaatgcttgttgatagcctttttctatcaagaaaccaaggagctaattattaataacaatcattgcacactgagtcttagcgtttctgatggaaacagtttggattgtataataacgccaagcccagttgtagtcgtttgagtgcagtaatgaaatctgaatctaaaataaaaacaagattatttttgtc

SEQ ID NO: 36533 - DNA, 10650 bp, Homo sapiens
tctttcgcgggcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgccttccaggtgccctacccgccgcggcagctgctgcgtgacttccagagccgcctgccctaccagtacctgcactacgcgctgttcaaggtgggagcccgcccccacccggggacctgtctcgggctgggcgtcgtggctccccacagatcggtcgaaggagcgttatcttcacccaaggcacgaagcccgccgtgcgctcggggccgcgagctccggtcttgctgacccgctcccccaccccctaccccccgaccaggctaaccggctggagaaggcggtggcggcggcctacaccttcctccagaggaacccgaagcacgagctgaccgccaagtatctcaactactatcaggggatgctggacgtcgccgacgagtccctcacggacctagaggcccagccctacgaggtggggtggagggtcaggaggaggcttgtagaggagggctagtagaggaggggagatgttgggggcgccctgactccccctgccacgccccttccaggccgtgttcctccgggctgtgaagctctacaacagcggggatttccgcagcagcacggaggacatggagcgggccttgtcagagtacctggcagtctttgcccggtgcctggccggctgtgaaggggcccatgagcaggtggacttcaaggacttctacccggccatagcaggtatctgccacccagaccacggtgggcggtcctctcacccacagggcccggtaaggcagatgtccccttcatgcacgtggagcactgcgaatgcggaggagccagccgggaggaaggccttgtctgttgagaaagacgctgggtgcaggggccccagctgggagtgtccaaggggctggatcagtgagtagaggcagtgacatccctaaagggtttgggaagcttgggttcataggccttccaggcagagggcagtgcagatgcaaaggtgcagcggtgagaagtaacccagcagatgtgtgcagaaagcagttgataaccagaaattacacctagtcttgggatctctaaccctggggtccctcgagcaggggcagaaaggactgtacttggccaggtgtggtggctcacacctgtaatctcagcactctgggaggccgaggcaggcagatcacgaggtcaggagttcaagaccagcctgaccaacatggtgaaaccccgtctctactgaaagtacaaaaattagctggtcgtggtggcgggcacctgtaatcccagctactcgggaggctgaggcaggagaatcgcttgaacctgggaggcggaggttgcattgagcccagatcgcgccactgcactccagcctggtcgacagggcgagactctgtctcaaaaaaaaaaaaaaaaaaaaaagactgtcctttagcttctctgtttggacttctgccccatttctggacctcacctgctgctctcccagaatgccctggctccctctggcttggggtggtggttgagtggcaggggtggtgagtcagcccagcccacagtcatcttcctcaccatcacttgtcatatagtatgccaagcactttacagacattctctcctgtgattgcaacagcaacacattttctggacaagcagcttggcttagtaggcagagattggatttagagtcttctccactggggggacggagatgttcattgcaatgccagcctctcactgctgcctcccaccctcagatctctttgcagagtccctgcagtgcaaggtggactgtgaggccaatttgacccccaatgtgggtggctacttcgtggacaagttcgtggccaccatgtaccactacctgcagtttgcctactataagtgtgagccccctgggtgggctggcttgggcaggggacgaggtgataagggagaggactgtatgggagcctcccagagttgtggggagctttccttcagtattgaggaccctgggtgataggaggaaagtctaggggtggtgggaatatggggaaggcaccctgggagtctggggcaggtgagaggcttctgagtgagaacagacagcagcctcagggagaagaagagggtcttttgggcaaatgactagacaaccaacaactgcagagcacttgacagtttatttttatttttgaaacggagtttcactcttgcccaggctagagtgcaggggcacgatctcggctcactgcaaccgctgcctcccggattcaagtgattctcttagcctcctgagtagctgggattataggtgcctgccaccacacccagctagtttttgtatttttagtagagacggggtttcaccatgttggccaggctggtcttgaactcctgacctcaggtgatccactgcctcagcctcccaaagtgctgggattataggcatgagccaccatgaccggccaacacttgagagtttataagtcactttatcttatgtggtcctttcaccaacaccatgcagctggcattactggaccgatttttcagatggggaaactgaggcttatagggcaaggggctgttggtcttatgactaataaaaagtggcaccaggacttgtggctctcctcactggagagatcctggcatccactggggctggaatggacagcctccagtgttcctgcagctcggagatgccaagattcagacagagccaggagtcagagcagaggggctgagaacccaggggccaggagacccttcctgggtacacatagcagagaggctaagggcctctaattcactagagccatcattctccagctgtgtgagcttgagcaatttatctaacctctctgtgactcagatttcttgactgtaaaatggggatgacagtaataggtaggcatggctgggcacagtggttcacacttgtaatcccagcactttgggaggcccaggcaggcagatggcttgagcccaggagttcgagaccaacctgggcaacatgacaagaccccgtgtctacaaaaaatacaaaaagttagccaggcatggtggcgcgtgcctgtagtcccagctactggggagactgaggtgggaggattgcttgagcccaggaggcagaggctgtagtgagccgagatcacaccactgcactccaacctgggtgacagaacaagaccctgtctcaaaacaaacaaaaacatacaaaaaattagatgggtgtggtggtgcctgcttgtaatcccagctactcaggaggctgaggtgagaggatcacctaagcctgggagatcaagcttgaggtgaccataattgcaccactgcactctagccagggtgatagagtgagaccctgtttcaaaaacaataaaaagacaataacagtgaggcttagatgagttagtcagggcctggcatagggtaagtgcccactacatgctagctggcattatgcttgggtgggataaggagcccattaggtattctgggaggtggctgggtagcaggggtgctggactgaactggaagatggagttgactctgaaggggaagtgccagagcaattcctcacccctgtcctgctgcagtgaatgatgtgcgccaggctgcccgcagcgccgccagctacatgctcttcgaccccaaggacagcgtcatgcagcagaacctggtgtattaccggttccaccgggctcgctggggcctggaagaggaggacttccagccccgggaggtgggcactgctttctggggcacttgctggatatgcactttgtaaaaaatgaactcctggcggccgggcgcggtggctcatgcctgtaatcccagcactttgggaggctgaggcgggtggatcacgaggtcaggagatcaggaccatcctggctaacacggtgaaaccccgtctctactgaaaagaaaaaaaaattagccaggcatggtggtggacgcctgtagtaccaactactcgggaagctgaggcaggagaatggcgtgaacctgggaggcagagcttgcagtgagcggagatcgcgccactgcactccagtctgggtgacagagcgagactccgtctcaaaagaaaaataaataaataaataataaaaaataaactcctggcttccatggaaggcaggatgggaaatggaaagaaagaatatgagttgaggttagagtcctggcttcagagcccagccccactgctgtgtggtcctgggaagaccatggccctttcctaatctattgcctcacctgcaaaatggcagtgatactgccacctcaccagcagtgtccagacgagggaggtatgaaggtacacatccactcctacctgctcccctccctaccttcattaccctcactgctgacctttgtccctctttcccaggaacaccctaggtaaccaatggaggaaatctgttggagttgagggccaggctggcaaatatggggcacatggtgccactcctgccttccttgtcagtggcagacattgctaatcgattgagggactctttgtcaccaaactctcagaatccttaacccagtgttccaagcagccacgatgatctgatgagcttgtgagctgatacctattctctgatccttgagctagaagagggccagtgggcccagatcctaggagccctggcttcttgccatctggcaacagggtatggctcaccccccaccccgtccttccctccttccaggaggccatgctctaccacaaccagaccgccgagctgcgggagctgctggagttcacccacatgtacctgcagtcagatgatgaggtgagtgcctcctgctttccaggattgggctgtgatggggacaccttggaccttttcctggggccaccagtgtgccagaattcagccccagcccctggtggtcagctgtcgtgaagaagagaggtttgcctgttccttgtctagactgtccgttccttccccagccttagtattctcatgtcctccttttgtacatgtctcaatcctgttcctcccaggcccagctcacatggtgcctcctccaggaagcccttgctgcatgccctggctctttgttctgggctagcagtgcccactctgacctgtgtgcctccctggccacctgtggcctggacctgggtgattgcagccctcgtccatctcagccctgggccccttctccagccagtatccaggagaaccgcactgcaggacacagggccacattattccctgttctcccacatcctgcacagagcctgggctcagaaactgagtttgaatgaaccagtgaatgaatgaatgcaggacctcaggacagaaggaccgtattgtattacattgatttattttatttatttatttattttttttttttgagatggagtctcgctctgccgcccaggctggagtgcagtggtgtcatctcagctcactgaaacctctgcctcccgggttcacacgatgctcctgcctcagcctccggagtagctgggattacaggcgtgcaccaccacgcctggctaatttttgtatttttagtagagacagtgtttcaccgtgttggtcaggctggtctcgacctcgtgacctcatgatctatctgcctcggtctcccaaagtgctgggattacaggcgtgagcagccgcacccggccctattaacattgatttcaagtgagggtttgacagccttaatttctctgaggtgttgctgctcagtgctcatttatgtatcctctcctttgttcatgcccccacgcccccacccatccaaccccagaggaggagggcagaatctacaccgtcagcacccaggatgaggaactagccagacctggctccattacttaccagttgggtggcctccaaacaagtgtcaggcaacctctcaagcttctgtttcttcatccattgaatggggagaatcatgcccatctcacattgttgtggtgagaataacacaagatctggccgggtatggtagctcatgcctgtaatcccagcaatttgggaggccgaggcagagggatcacctgagatcaggagttcaagacgagcctggccaacatagtgaaaccctgtctctattaaaaatacaaaaattactcaggtgtggtggtgggcacctgtaatcccagctactggggaggctgaggcaggagaatggcttgaaccagaggcagaggttgcagtgagccgagatcgcgccactgtactccagcctgggtgacagattgagactctgtctcgaaaaaagagaaagaattaagtgagatcaagtatgtttttttgtttgtttgtttttgagacagagtctcgctctgtcgcccatgctggagtgcagtggcgtgatctcagctcactgcaagctccgcctcccaggttctcacgccattctcctacctcagcctcccaagtagctgggaccacaggcgcctgccaccacgcccggctaattttttttgtatatttagtagagatggggtttcactatgttaccccgtatggtctcgatctcctgaccttgtgatccacccacctcggcctcccagagtgctgggattacaggtgtgagccaccacacccggcctcaagtatgcatttttcttttttttttcttggagacagaatctcactctgtcacccaggctggagtgcagtggtgcgatctctgctcactgcaacctccacctcttgggttgaagagatcctcctgtctcagcctccgagtagctgggattacagtcatgcgccaccatgtccagccaattttattttgtatttgtagtagagacagggtttcaccacgttggccaggctggtctcaaactcctgacctcaagtggtccgcttgcctcggcctcccaaagtgctaggtttacaggcgtgagccaccgctcctggctgagatcaagtatgtaaagcacttgataaagagccagtacctggtaggtgcacagtgaatgacagccgagtctcactctgtcatccaggctggagtgcagtggtgcagtctcagctcattgcaacttccgcctcccaggttcaagcgattctcctgcctcagcctcctgagtagctgggattacaggcgtgtgccaccatacccagctaatttttgtatttttagtagagacatggggtttcaccatgttgaccaggctggtcttgaactcctgacctcaaatgatccaccgacctcagcctcccaaagtgctgggattacaggtgtgagccaccacgcctggcgtatggcagccattttgacggctgtctcttatttcctgtggtttgccagacaccagactaggggctggagtaagttagtgaaagtcatggtcctggcggggcacggtggctcacacctgtaatcccagcactttgggaggccaaggcgggcggatcacgaggtcagaagattgagaccatcctggctaacacggtgaaacccggtctctactaaaaatgcaaaaaattagccaggagtggcggcatgcgcctatattcccagctgctggggaggctgaggcaggagaatggcgtgaacccaggaggcagagcttgcagtgagccgagatcatgccactgcactccagcctgggcaacagagcagactccgtctcaaaaaaaaaaaaaaaaaaggaagtcatggtccctttcacgtgccgctcacagtctagtgggggaagcacaaactgctgctggagagggcagcacacggcaccaggggaggtctccagcccagccagagtcaccagcaagggctcagcctggaactgatgcctggctttggagggattagtgcgggctacgcaggcacaggggacagcagtagttcctggcagggaaacagtatgagcaaatattatgcatggactagcaatattcttgccagggtctttatgcttaaaaggtggggctgtgcaggggcgatgtttatgctgacaccaaattctgctggtggtgccctatgcagccactcagggaggggcagtttgggaaaaatcctcaggactgtctcattagatcttgagactggggagggggaggggctttggggaccgagagatgggatgggaagtcccattggccaggaagggagcccatatgggtttgggcgtactgtgacccggtttctcccacaaccgtggcgctactctagatggagctggaggagacagaaccgcccctggagcctgaggatgccctatctgacgccgagtttgagggggagggtgactacgaggagggcatgtatgctgactggtggcaggagccggatgccaagggtgacgaggccgaggctggtcagtgacacgagtccttggggggtggggatgcagcctgggatggaggttggggacagatgcattcacccgctgggctccggagcccagggtgtgtgtgggtgctggggcccatcctccaggggcctccagcctgttggcaacccctgtcccgcttgggggtggtggtgcagcatctcccctggagctgggaccagctgagacctgtccgggggagcctcaccccacctcccatcaggacagcacctggacacccattgggagtgggtgggggagcaaccccagtgctttctcctttccttttcagagccagagcctgaactcgcatgagaaggggacaccccacaccgctcaagcttgggaagcctggtgccgatggccccaccctcaccagcctgggcagcagcaagaactatttattaaaaacttaagatgggccaggtgcggtggctcacacctgtaatcccagcattttgggaggccaaggtgggtggatcacttgaggccaggagttcaagaccagcctggccaacatgatgagacctccgtctctactaaaatacataaattagccgggtgtggtggcaggcgcctgaaatcccagctactcaagaggctgaggcaggagaatcgcttgaacctgggaggcaaaggttgcagtgaactgagattgcgccaccgcactccagcctgggcgacagagcgagactccatctttaaaaaaaaacaagacgggccggcacggtggctcacgcctgtaatcccagcactgagaggccgatcacttgaggtcaggagttcaagaccagcctggccaacatggtgaaaccccatctctactaaaaaatacaaaaattagccaggcatggtggcacacacctgtaatcgtagctgaggcaggagaatcgcctgaacccaggaggcggagcttgcagtgagccgagatcgtgccactgcactccagcctgggcgacagagtgagactccatctcaaaaaaaaaaaaaaaaacttaagatggacacagctgactggacccccatcctgcctcacccatgggtgctgcaccccagacccatcctgccacttctatgtctctggaccacaggatggtggtggcattgcaggttggcaagtgggctgatggggtccgccctcctcactgctgagctcctcacctggacagtctcctggacaaggagtttccagctgctggctggagtctcaggccaaattgcagagggtcctccagggtcctgaagagcactggactaagagtctagtggttccagggccctgaccagtaggtgctcaataaatgtttgttgttgaatg

SEQ ID NO: 36534 - DNA, 64378 bp, Homo sapiens
cttccccggctggggcggctggagagccgggagtcgctgggtgcgtggggctgcctcgccgcgtctcgccacggtaggtggccctggggcggcagggggtggcctcgggttgcaaccgggggcgcgggctgggggccgtgcgggtcggcctcgggcgcctggcagccctccgtcctggcggctgcctccgggcccggcgcgactgctcgggctccggggctgggagctgggatctgggaggcaggcaggcggcgcgggcgcgcggttctgggatccgcacccgctcggcgtcccgagcgctttccgcggggtgcggcatccaccgggcccccgttaccacgcttcccgcttcggacccagcgcctgggagacgctcagcgtctgttggcggggggactgggggggagggcggcgcgtccccgcctccggagtccccaacctcgcccaggcgcgcggggacccccaggcgggcgccagggcgcgtggaagttaacttgcagcagccgtggagttgcgaggagcgtcagaagtggaggcgttgggggcggaaatcgtcggctggggaggtgggcgctgggagcactgggttggggagccctagtgaacttggaggtcactggtgaggagtggagaggaatttgacccgaggatcccaccccaacccccaacctccctccgtaaactccgcttctcggtgtgagctggatgggaggtgcccggaaagccgggactgggactggtagcaggggactgggagcatgggctcagaggctgagcacgcctgacctggcagagtcgttgttagatgggacagaggtcgaggtctggcattcccactcaaaggcccgttccctagggaaggaaccatccacctcagcagagtcattagaaagaaccgtgcctaacctcttgcccccttccccttttacagatggggagactgaggcttggagaggtcacctgcccgtgaccctaggattcacagctaggatgtggcagagctgaaactcactcacaggcctcctgacttaatgtccttggggatgttgaggaggcgggctgttgaactcctacttatcctacagaagccccctcaagcagcacctcctccgggaagccttccctggcattctcctggtattgttgggtgcttcctgttttgaaccccacagagttagccagccctttttctcacttcccaacagacattcccttgcatgtctgtctgccagactgggctgtgggtggacacctctccctagcctccatgtgataaccctttcatctcagcagggtggtctgctggcgagggtaggcttctggatttgaacagatctgtgacacaccggatttagtagtgatgtggcccgggcgacgcattttccttccgatctagtctcagtttccataactgtaaagctgggtttatttcattgtcctaaaggaactgttgggtcatttctgaatccccccaccccactgaaccccaattgtactgttgtttacttaatatacatctttgtatcacctgatttttaaaaatctcatgcaaactttttttataacagctttgttgagatacagttcacatgccgtacaattcacccttttaaagtatatgtttccgtaatttttaggatgttcagagttgcatagtcatcaccactgtctaattttagaacatttttatcatgcccaaaagaaaggctgtttcatggtcactccccaatcctttcttcccctatcccttggcaaccacttactgactctcaaattctctatgaatttgcctgtgctggacatttcatataaatgcagtcatatactatgtggcctttggtatctgatgcttttcacttcagagaatgtttctaaggttcagccccttgcagcctgtatcagtacttcattcctttttttttttttaagtacttcgttcctttttatggctgcataatattctattatgtggatataccacattctatccatttgtcagctgatggatgtttgggttgtttctaacttttgactattatgaataatactgctatgaacattcatgtacaggtctttggacatacattttcagttctctcaggtatatttctaggagtggaatgattgggtcgtaaggtaactttaggtttcacctttaaatatttttttaatttattttattatttatttattttgtagagataggggtcccactatgttgcccaggctggtcttgaactcctggtctcaagcgatcctcctacctcaggctcccaaagtgctgggattataggtgtgagccactgcacccaggtttaacctgttgaggacctgccagactatttttccagaacagctgtaccattttatattcctaccaccagtgtatgagggttccaataatcttaaatacatttagtgttctctgaagcagtcataacccttgaaatcactggctttgatgtgttagttgtaaactattttcaggccgggcacggaggctcacacctgtaatcccagcactttgggagctaaggtgggcaggtcacctgaggtcaggagttcgagaccagcctatccaatatggtgaaaccccgtctctactaaaaatacaaaaattagccaggtgtggtggtgcgtgcctgtaaccccagctacttgggaggctgaggcaggggaatcgcttgaacccaggaggcagaggttgcagtaagccaagatcaatcacaccactgcactccggtctaagtgacagagcaagactctgtgaaaataccgaagcaaggagaggcagtgtaggacccagtggcttacagagcccaccccaggagctggcacacagtattaggagggggtgaaaggaaggtggaagctgctcggatcttcccatcccgggccagcctggagcccccttgccagctgaggctttgtggaggccagggagaccctccatggctctcctagaccataactgaaggggaagacttgtcccttgaccccaaaattaagtctggtcctgcccacaccctatctggaaccccccacgctactctgaaggtgacttctctgggtggccaccggagtgtcctatgtgagttgctgcttatttcaagaggggccaccccccaggcctgagatgagcagtcctgagttacagacgcttcatctgtgaacattctgcacacacagacatcttccccctcctctcagcaccttccccacccctaggaccctgtgtttcttccttcacactctttgcttcagcaagaggctgcaccggaagaactcaggtcagaacccagcgttttcacagaggaagagttccttgagaaggtaggtagttcaccccagcttgaacctgtactctgctggttcaggaacttagaccagcacttatctgcgtgttccagtttcctgacaacttggttcatctgggcagctgctgtttgggaatggtgttaagaccacgcctcccagccgctgtatctggcacctcgtgactttattcttttttgcatacttgcctttccttgtccttttaaaatcctgagttcctgtgcattaagaaagcagcctaggccgggtgcatggctcatgcttgtaatcccagcacttttggaggctgaggtggatggattggttgaacctaggagtttgagaccagcctgaataacatagtgaaactccatctctacaaaaaatacaaaaattagccaggcgtggtggtgcgcgcctgtattcccagatagccgggaggctgaggtggaaggatcgcttgagtagaggttgcagagagctgagattgcaccactgcactccagcctgggcaacagggcgagattgtagggtattaggtcagtacataaaaatcaattaaatattaaaaaaagaaagaaagaaagcagcctagggacatggagacggggtgggaaggctccctaggcaaggaactgccgctctctgggtgtcagtgtaccctactgaggaatgggcatagaccattcagaactaagatgtggtggtgccttgggatcggttaggctgttgaaatgtattattatgattattattattattatttttgagacggagtttcgctgtgttgtccaggctggagtgcagtggcgtgatctcggctcactccaagctctacctcccgggttcacgccattctcctgcctcagcctcccgagtagctggaactacaggcatatgcctgactaatttttttgtatttttagtggagacagggtttccccgtgttagccaggatggtctcgatctcctgaccttgtgatccgcccgcctcggcctctcaaagtgctaggattacaggtgtgagccaccacgcctggcctgaaatgtattattgatgtgactttgtgggtgtatttgtagtaagagtggcagatcagatgtagcttcacagcctggggttggtgaccagaatgtactttcttggaaaaatgcatgtggcttgtgtggctttgatgccccacgtggcaccagggaagcttctctgggtagcagcagctcctgctccccgacttgctgcctattccgattgcttgcaagtccccgtgccctctgaggacctgcatgtacccggtctggggcccctccagagatctgggatgactgtcccctcccgtcacttctcaggtctcccccaccctttactgcagccagaggaggatttgtgggaatgattcattcagagctgcttgagatcttggccagcccccagaaattgcagggaaggacctcagaggcagtgcccacaggccctagggaacgtctggggctgatggcccagggagaaacttcttatcctatgtgctcagatggcgggcagccagcccgtctgccgagtgactttgtatcagtaagacttttgactggggcttctgcagccagaaagcaggcaggcagcccagaaagcaggcagtgtgatagggagctagggggcactggcctgtattagaatccaggtgctccacatctttctggggctgttggctgtttctctatgctttggttttctcatctgttgaatgcaggtataagtaggacctatcttccaggggtgctggatggaagggaatggtggtaaagcacttatcttggtaccaggcaaaagctgaggccctggggttaaacaggctctttggaattttgaacatgttcgtttgtgaaccttagttcctccgtctgtcaaaaggcaacaattataaatacagccaatatcaacagggcttactgggtgccagacactgttctaggcactgtatgtggtttaactcatttaattcccccaacagccatatgatgtgaacaggctgaggctcagagaggtgaagtaatttgcacaaggtcacccagctaggaagtgggagacataggatttggatccagaatctttcttttttttttgttttgggtttttttgtttgtttgttttgagacagggtcttgctctgttgcctaggctggagtgctgtggcacaatcatagctcactataaccttgaacttctgggctcaagcgatcatcccaccttggcctctcaagtgctggggttacaggcgtgagccaccacacccagcccagactctacactctgaattctcattcttactcctccttgatatcccatcttaaggcctagcacatagaaaacacacagaaaacatcaggtgttgttataactattctgaataaatattgatccgctctccatccctctgtccacactccttccctgatgatcagaacatgcagggctcttggcctgtaaagtccagattcccacccactcctccctactcgctctgttcctcccactcccacactctcatgcacagcagagcttggaagcagccaagtcccaactcttcctccaaattgctgtgtgacattgggcaaggagcttcccctctctgagccccagtttccgtacatgttaaatgggtgagttcaccctgctgcatgttttttgttgagctcccatgctacgtgtgtgtttttaaaattgagtcaacattcaaacatttctagagaaaaattctgatttctcatttctcttggaaacccaggagcttaggccaaactggagtggcctgaagctgccccttaggtggcctggactctcccagtcactgtggttccccctactccccattgtcacgtaagtgcggcttttcaggggatctgaggatgccttaggcctgcctcgtgccacctgaataagcagttccattgctttaaaaacaattttttttttttgagacgaagtctcgctcttgtcgcccaggctggagtgcaatggcatgatcttggttccttgcaacctccgtctcctgggttcaagctattcttctgcctcagcctcccaagtagctgggattacagtcgcatgccaccacgcccagctaatttttgtatttttagtagagacagggtttcaccatattggccaggctggtctcgaactccgcctgccttggcctcccaaagtgctgggattacaggtgtgagccatcgcgcatggcacaatttttttttttttttgacacgctccaagagcccttccagctctgtgtttctaggatattggaggttgtctgaggcctcctgataccctgtctgccattttaagccctcaaggcattttttttttttttttttttgagatggagtttccttctgtcgcccaggctggagtgcagtggtatgatcttggctcactgcaacccctgcctcctcggttcaagtgattctcctgcctcagcctcctgagtagctgggattacaggtgcctactaccatgcccagctaatttttgtatttttttggtagagacggggtttcaccctgttggccaggctggtcttgaactcctcacctcaagtgatctgcccgtgtcagcctcccaaagtactgggattacaggtgtgagccactgtgcctggccttttatttgttttgttctttttttttttttttttcctttttgagatggagtctcgctctgttgcccaagctagagtgcagtggtgtgatctcggctcactgcaacctctgcctcccaggctcaagcgatcctcccacctcagcctcccagagtgctgggactggaggttgtccccattgcatactccctgtgtggggagttcctgtctctgggcgctagggtgccgtgccaccttacctggtacaggcccctacctaactgttgttccccacagtgagatatttgttattgaccacgccatttcccagaagccaaggcttggaaatagtcactttcccgaggtcacacaggcctgagattcagcaccaggactcaaagcccatctgcccaacttcagaggctgtcagtggaagtcatgccttgatcccagcactgcacggatagccactgagtgacgtcttccactagaataaggacacatgagaaccctcaactggatgttggggtgcaagatttaagaagcaacgaggtcctagttgtcctggagtttacgttctggtggaggcatcaggcaagaaaaagtaacccacatctctgacgtgagatgtcagcctatgaagttgagtacccaggcctctcagatcttaacatgcatatgatccccttggggaacttgttaaagtgcagattctgtgtttttggttgtttttgtttttgtttctgtttagatggagtttcgatcttgttgcccaggctggagtgcaatggtacaacctcggctcactgcaacctctgcctcccgggttcaagcgattctcctgccccagcctcccaagtagctgggattacagacacctgccaccatgcccggctaatttttgtatttttagtggagacgggatttcactgtgttggccagcctggtctcaaactcctgacctcaagtgatctgcctgcctccacctcccaaaatgctgggattacaggcgtgagccacagcgcccggctaaagtgcacattctgattagcaggtttggggcagagactaagactgtgtttctaaccagtttccaggggcctctgatggtgtttgtctaaagaccacatttggaatagtgagggtctggatcagaaattggcagattaccactcataggccacatccggcccgctacctgtatttgtaaataaagttttatcggaacacagctatgcttatttattgacattttgtctgtggctgctgttgtgtaacaaaagcagagtggagtagttgtgatagagaccagagagcccacattgctggcctttgaagagaaagtctgccagttgcttttctaatcatcttttgagtccctacaagttataaaactttgatttggtgagtgttagatgctgataaaaatagtaatgattgcagttaagacttgggtgctttctgggtacttagctctttacgtttatttttcttagctcaattctatcataggcaatactactgtctccactttacaggcgagaaaactgaatagaggctgggccattggcccagagtttgtggaccaatgagtaggtgaggccaatttgagtcaagttgactgattcttattggacaggagcttctgcctagaactttttcccagagcacagagagggtttagtttagatttccttctgtcccagagtgttctggtgccttcatttctttctcaatccatccttctgtttactcaacaaatacctgtgcaccctgtgctggaagtttggggaccatgctgggttctgagaggatgtggggactaggatggggtccagccctgcacattccatggggttggcagggaagcaacaccagaagccacacaggatgctaagcaccttgggggatactggtacagggacaggaggcagtcagggaagacttcctggaggaaggggtgcaaatgatgccagtaggagttagctttgtagaggaggtcaggaaaggttttccaaggagagagaatcacaagtgcaaaagtttggaggtgtgagactctgtggcctggtatgtttggtagagttcagggcacaaagactatagtgtgtgtgtgtgtgcgtgtgtgtgtgtgtgtgtgtgtgtgtgtgtgtgtatgtatgttgagggttgggggaatcggtggtgttataataaaattggaggtcagcaggagttaagtcacaacagagcctcagtgcgatgccaaaggacttgaattttgccctggaggctgctgttgcctagtatgaagtgctaaatcacagagcgaaagtcttcctccccaccctctgatgactttccggagaaagcctccattaggtgctaacgcgtctttagtgcttctccccagactcctcttgtttaacaaagatcggacacaaccggctcctttggggatccttccttaggctggcggccgtctctagccagaaggcataaaaaaacattgcttccttcgattttatttttgcattaattttttaattagggcatgttttaaatttaatccagtggattatagtttcccttgaaaatatgttttaaaaatattggatccattgaacaaaaatgaatacgattaaagggggttctggatgtaattaacattgggaaggtagtgttcagaagcttggaatttggagagccccacaacaggtgagagggctggagggggctgggccagtagtcacctctctctcaacattccccttcttccctggatacccaggggccttgactgaagggcgggatggctgtgtagctaagatgtgggtgcagggatgtaggtgcccgttgatggtgtaggagctgaggttcctgttccaggctgctgctagtgctcatctctctccttctctgtctggtgattttcttattcttcttttctttctttctttttttgagatggtcttgctctgttgcccaagctggagtgcaggggcagcattgcagccttgaactcctgggctcaagcaattctcctgcctcagcctctcgagtagctgggactacaggtacagaccaccacacctggttcattttttattttttgtagaaatggggtctcactatgttgttcaggctggtcttgaactcctgggctcaagcaatccacctgcctcagcctcccaaagtactgggattacagacgtaagcctctgtacccaacttgtcttggtttctatttttgtctccctgcctctctctccctcccacccatccccccaactcacgtctttccctgtctctgtcactctttctgtcttactcccatctttgcctctcctctgactctctctccccatctacatcctctgtctctatctccctctgtctctgcctctgtctgtttttttctctctctgtcttcttccgccccaatctgcaccacttcccccttccttcccgctgccgaccccaagcccacacaggtgccagcacggcccttcctttctctcattaaaaacttttcatcccacttgctttggctggtggctgacatcctgccacagaaccatccggacccttgcagagcccgggggctcagccagaaacctttggaggtgtgagaaagtggtagtagctacttcccaggtggaagacagaggccctgtggagtcaggcacctggcaaggccgccctacaaggccatggtttcctctcaacccacaccctttccacgcccccagggccctcccttccccaccgggccccagggctgtggggaagaagaggaagcctgggctagcagcaggacggcagatgctgtttttggtttgatttggtttggggtactgggggagtgtcggctacccttcctctgagcactgctggaagctgcatgcagtaggtgcctttgcccttcattctgctacgtggtcattccttgctcaagtgcacagtagaccagcagtgcatatttgatggctaagagttttgggaagaaaaacaaggttagaaactgagtcttgcctccaggctgggcacagtggctcacacccataatcccagcactctgggaggccaatgcgggcggatcacttgcgtgagctcaggggttcaagaccagcctgagcaacatggcgaaaccctgtctctacaaaaaagtacaaaaatcagccgggcatggtggtgcatgctttattcccagctactttggaggctgaggtgggaggattgcttgagcctgggaggtcaaggctgcagtgagccaagatcacgccactgcactctagcctgggtgacagagtgagaccccgtctcaaaaaaaaaaaaaaaagaaagaaagaaatagggtccagctttttcttttcacagatggggaaactgaggcccagagagttgaggtaacttgttctggatcatgcaaatagcttggaaataatggggtctgggtcttccatgcctcagaaactgggaacagtgcacccctgtgttgagctggtggctgctttgacatccctcagcggttgttgtgtagacaccgacttctgagagatgggagattctggttcgaggcctggtttgctctcctctacctactgcgggactctgggcaaaatcttccttctctgaggaccttggggtccccaggcatagtccccatggcacagtcctgaggatcgcagagcgtggtcaggtttgcagggtcggaggttgctgacctcaccgtggatggagggcttcttcaacacaggttgctgtaccccacttccagagttcccattcagcgtggtctccttgagccctgataatctgcattttgtgtaggttcctaagcgctgttcctgctggtcagagaacccacgttgagagctggggtagtagaggtgcagcagacgaagcacacgggcgctaaaacctgctgtgagatctcaggcaacgacttcacctttctgtgccttggcttcctcagctgtaaaatggaatgacagagcactgtcctcatagattagttgtgaggattaaatgagcgattgggaggcggagatgcgcggatcacctgaggtcaggagttcaagaccagcctatataattgattttaattgaaattccttttggtaattcttaaagataataatacattttgatgtttactcatgaacattactgatattccttcctccagctacatgataatgttttctctcctgtgggtgagatctaagaaatgaaactcggccaggcatggtggctaatgcctgtaatcctagcactttaggaggtctagacctcctcctgaggtcaggagtttgagaccagcctggccaacatggtgaaaccccatttctactaaaaatacaaaaattagccaggcatggtggctcaagcctgtaatcccagctactcaggaggctgaggcaggagaatcacttgaacctgggagatggaggttgcagtgagccgagcttgtgccactgcattccagcctgggtggcagacagagtgagactctgtctcaaaaaaaaaaaaaaaaaaaaaaatggccgggtgcagtggctcacacctgtaatcccagcactttgggaggccaaggcgggcagattacaaggtcaggagttcgagaccatcctggctaacacggtgaaaccccatctctactaaaaaaatacaaaaaattagctgggcatggtggcacacacttgtagtcccagctactactcgggaggatgaggcaggagaatcgcttgaacctgggaggtggaagttacagtgagccaagatagtgccactacacttcagcctgggcgacagagcgagaccttgtctcaaaaaaaaaaagagcaaatatttgtaaagtgtgtagaaaaccccccaggcacacagtaagcactatatgcatgttcactttttttttttttttttttaaagacagggttttgccctgtcacccaggctggattgcggtggcatgatcatagcttgctgcagccttgaattcctgggctcaagtgatctcaccctcccaagtagcagggactacaagtatgcaccaccacgcttggctaatttaattttcttttttttttttttttttgcaacagagtctcgttctgtcgcccaggctggagtgcagtggcgcaatctcagctcactgcaagctccgcctcccgggttcacaccattctcctgcttcagcctcccgagtagctgggactacaggcatctgccaccacgcccggctaattttttgtatttttagtagagacggggtttcactgtgttagccaggatggtctcaatctcctgaccttgtgatccacccgcctcggcctcccaaagtactgggattacaggtgtgagccaccgcgcccggcctttttttttagagacagggtcttgctatgttgcccaggctggtcttgaactccttgtctcaagtgattctcccacctcagcctcccaaaatgcttgggattataggcatgagctactgtgcccggctttgtcttactattattgttgttattcttattgccatgattatttaccttcccctcctccacaaagacaattctgttcacagtgaattccttgccattctccaaatttccagtgtgctttcacacttctacccgctgctcgagctgttccttctacttgggacgcttcctctaacttctgcacgtgttaaaatgctggcattcttttcgactcagctcagattccttcctctgatgtctgtgatgacatgacttgcttcccctaaccaagctcttatttcattctgtgaattatcctgttacttgggtgtcaatctcctgtgctgaccctcaggctcctgtagatctgacttggggctttgctggtacagagagtctcccaggaatgttactttcaaagtccagctttgatggtgtttcaagaagaccagctccatcgttgtcagtggcagctgtcagagaagccttccaaggcatatggggtggagccccattgggacgtgggatttccttaattagtaagagtgtgaacttagcactccacagtcccaggttcatgtctgtgttttgccatttagtgtgatgcagcctcggataatttccttaaatttttttgtgtgtcctttgcatcttcattttattttattttattttatttatttattttttatttatttacttatttatttattttgagatggagtctcgctctgtcacccaggctggagtgcggtggcacgatctcggctcactgcaacctccgcctcccaggttcaagcaattttcctgcctcagcctcctcagtagctgggattacaagcacacatcaccaggcccggctaatttttttgtatttttagtagatacggggtttcaccatggtggtcaggctggtctggaactcctgacctcatgatccgcccaccttggcctcccaaagtgctgggatgacaggcgtgagccactgcgcccggcctgcatcttcattttaaaaggatgccatcatcatttacagcagcgggtttttgtgaggattcagtggggtctcatttctgcagcaaatatgagcacctcctgtgtgcctgctctatgccggatgccgggaatccagcagtgagcaggagagaccctgttcctgccctgggagagctgatattttagatggacacaaggggaggtatagaaatgatagtgtcgctgtctccggaggatgcagcaggaaggagatggtctttgagaagtgttctgtgcgtggtcttgcaagtaggaggcccttagcaattggtaagtgtgatgattactgttattgccgtaattatttgggagaggaggcaaaaggggaagggaggcattgtgggaagagggaatagtttcagtacagggtcaagaaggcattcggtgtcaaagtcgtaatattcacagccaatgtttatggatgccctagtgtgtgtcaggtactctgctaaggacttcctaggtgcaaattcatctcaacctccagggaagtgctgtgttatccccattttccagatgaaagacatagggcacgggggaactgaaccacttgtctggggaagtggaggggcgggagtcaaacctagattcttacccctgcatctagggtgtgtgatgggaaatgagactgagtggggacaggtcctcatagggagggctcaaatcttgactgtcctcctgctggagtcccttagatggtcccgggatggacagggtggggaagttcatggcacatctcattttatggtccagaaagccagtggcatgcagcccctccaagagtgggtaggaaaggatggctcctcctggaccccttctagttgggttctcctggttggtggcaagtccctggcggggctggagttgtgggaggtgataggcacagtgcagcccatggttgggagcctacattctgggtggtgaggatgctggtgagtgctccttcattgcaaggatgcagttgctcactgtcgccttttcctcgtttctgctctctgagaccctctctacttaggactgggcatgaggggagcccaggagaaaagcagataatgaggatccaagggacttgtatttgtctccagccagtcgcctcccaaatacctatggcttgctcgttcctgggcaaacaggtgcctcaggcagtatctttatcttttgtgtgtgtgatgccattggaacctcacagtgacccgtgaggcaggcatcaagagaaggcctgttgttgtgggatgatagcaactctcaagtcagacacacttgagttagaactccagctggcttatgcatgagctttgagaccttgctccagacacttctctggtcctcagtttcctcatctgtgcaacagggatcataataatgattattttgtgggtgacagataatagttatatggcatctaatgcatagaagtgctcagtaattcatagcaacgaaaattttgttgttcttcacccattttacagataaggaaactgaggctcagagaagttaagggactctccccatggcattttgcttcctggtaatggccaggcaagtttgcagatggaaatactttccataaaacccaggtcccccaaagccctgcaccattaggaaaaggctgttccccaattgtaaatctgtcccccaaaacagtgaaccatgagatcatgccccttctctctcgtgggtttctccctgtgatgttttaagtgttcatactctgagcagctcttaaagcctttgcaattcttccggttcttcctgcttctaggagtgagtgaaaacgaagaagatatcacagtctgtccaggaaggaaacagaggagcaggtgaatgctcaggaaaccggattcgtagtatgcactaccccagaattggggctggcaaattctgctcttaaaacccccacctagagccaactgctgcccctaataatatgcccaaaatattaccaggacgaaggcctcatgcttcctggatgaaccacaaaaaaaaaggttgaggccatcttgttgaggaacattacatccagcaagtatttatttattgcttgctttgttcttggtcaagccttttcactttttggccatcagccattgcaaaacctccacaacaaagaagtggaaagtcatgcaatcagaaaagccataaactacagctggggccaggggaagagggaagttagctgaagactttgtaagcagaaacatcaggaaaccttctgacatgttaataaagatactctagagtcacatcttgtgtggaaactcaaatccgcattgttggggcggaagtcggagtcagtgactggccccagctgtcaccccgagccttcagataagacggtggaactaggcagggcgccgtggctcacgcctgtcatcttagcactttgggaggccaaggagggtggatcactttagcccaggagtttgagaccagcctggacaacatagtgagacctcatctcgacaaaaaataaaattagccaggtgtggtggtgtgtacctgtggtcctctctactcgaggggctgaggtgggaagattgcttgagcagtccctggaggaagaaggtagagccaggaactatcattaattaaacacttaaccagctctaatatggtagtaaagcccttatgtgtatttagctgctctcccgattcacagatgagaaaaatgaggcccagagaggttaagtgatttacctgaggtcacaaaactaataggtggggaattcaaactcaggcgcatctttctgcaaaacgcattcttttttcactactccctgatatctgaggaaacttattgatgagcaaaatgacctgaaaaaaataaaatgtgaatgcctctcagtgtcaggctctgtgataagtgtaggaaaaaaagaaaaagaagaagaagaaaaaaaacccaccagactgcaatgcctcccagcccgtgagcactcacagtggaatatgggaaacagaagggcaaacagcatttaccatacagaatggtgagtggtaggcagaggggactgtgagacataggagggtagagcttaatctagtcggggtattcagggaaggcttcctgaagaaggagatactttagctgaggagataagcagcccaagataaggtgggaagagggtatggacccatctattagctaggactcttgataaacagagacagaaacccagcttccatagcattgagcaaaaaggtaaatttattggattatgtaagaggtgagcctcaggtatggctagatccaaggactcaagtaattttagggatttgtgtctccatctcggctccaccttcctaggttggctttgctctcatgccagctttgcaggtggtgactagagatggccccacacctccagccctataccctacttgcttagcctccccgcagaattctgtaaaagtctccagttgagtttcattgacctagattgggtcaaacgtccatctttgaaccaacactgcagtctgggaatgaaatgctgtgattggccaggcctaggttatgtgtctgcaccaggggtcgaaggtggactgagaatgaaaataagaaagccagggatgcatggcacccttggggctgatagaaggtccatggggctggagaaggggtctgatcatgacacccctctaagccacgtgaagaaattgcatactgaagacagtgggaagctttgaaagtatagtgaaggcgggggtgacatgccaccatatggggacaggcaggggtggaagcatgatcaggtggcggacagtggggacttggactgggctgctggtgatggagagaaacagttggatcctgggggtgttgagtgtaatgcacaggactcagtggtgattggatcaggggttcatggggaggaagaggttcatgatcttgggtttctggcttgttccaacaggcaagcctggaagagaaaccaagctcaggagatcctattaggagtttaggttgattgtgttgagtttgaaatgctgtcaagcatccaagtgacagactagtggagaattggccatttcacggttgctatgctgagaggggccggtcaggattctgtggccttaggagaaggggtgcagagtgacaactctatctagtaaatattaattgaccacctactgagctgcaatgctccggaaacagagcattcaaggctcccagacaatgaatgcagaatatgtaagtcaatcatatgatgtgttagaaggtggtgagtgctgggggaaaaaaaaaatcacgcagggtgagggcttctggagtgccgtgttggcggggcaggttgcagcactaactggttgatcagaagaggccttgaagaagtgcgatgtgagagaggacaggagggtgagagagtgagccaagtggatgtttggggaaagggcatccgggcagcgggcacagccagggcactggcccagaggagggagggtgcttgtgtgtttgagtgacagcaagggggccagcgtggctggagaagaggcaagggccagtggggttgggggcagaaaggtaaggggtggggtcaaacctgtaaggcaaatgaggactggtttttcctgagtaaagtgggagccatgggaggatgcggagcagaggagggccatagcctgacttccgttttcctaaggtcactgtggctgcttgctgaaaatcaactgatgagacaagggcagaatcagggaagctagtgatgaggtggcttggaccagagtggtaagaagtgaacgcctgaaacaaacgtctggcagtgcgggtggtgagaaatggcggattctggctctgttttaaaggtgaagttaacaggagttgctgctggattggattagggtgagaaagaagaatcaaagctgccttcaaggtttttggcaccagcatgaaaggatggagctgctaccagctgcaggtggggtatgctgctgctaccagctgcaggtggggtatgctggggaaaggaccaggctcaacacccaggtgcagggaggaagagagtgggcaactgtgtccaagtgaggagagagatttgggttcaagatgacaattcaggagatgtcagcctgtggggagcatccaggggcgctagtatctcctgaactggagggaggagagagggccacagtagccaagtgtgacctcctgatacctgtgccagaatggctgggtttggccccgcataaggaaaaaccctgtaaacgttttcatggggctgtagagaaagaggaagacaagcagacataacctccttggcatctgatcaaaagccaccgtggcctggctgctcatttattgagtgtgggtctgggaggtgtccatgccaggagccggggtgtgggtggcatgatcagaggctgaagctcaattgtccttgaagttcctggcgcccaggaccgactagccctgggagagcgccgtcctgcaagtgttgattgaatgaatgcaaagagtcttgtgtgttcctctgcagcagccgggaaaaaaaagtgtgtggggtggagtggggcgggtagcataccccagccagcaacaccattcctcagcatttgacaaagtgtgattaattaatttttttctctctttcttttctttctttctttctttccttctttctttctttctttctgtctttctttctttctttctttctttctttctttctttctttctttctttctttttctttcttttctttctttcttccttttttttttttttttttgacagagtcttgctctgacacccaggctggagtgcagtggcatgatctcggcccactgcaacctccacctcccaggttcaagcagttctccctgcttcagtctcccgagtagctgggattacaggtgcctgcgaccacgcccggctaatttttgtattttttagtagaaacagggttttaccatgttggccaggctggtcttgaactcctgacctcaggtgatcctcctgcctcagcctcccaaagtgctgggattacaggcatgagccaccgtgccaggccattaattttctttttttttaggagacaaagtctctctgttgcccaggctggagtgcagtggtgtaaccatggctcattgcagcctccagctcttggccttgaagtgatcctcttgcctcagcctcccaaagtgttggtgtgagccaccaagcttgctgaaagtgtgattcgttaagactatttttattcaagtctaacgtgtatacagaaaaatgcatatttcatacgcatacagctcaatgaattttcaaaagacgaatgtgtctgtgtgaccagcacctggatcaatagctgaacgtacatagcacccctccctgccccaggacaccttgctccccctgcagttaccccttgccccaccggggtaaccaccatcctgacatctccccctagaatttcacctgtttttgtactttgtatccatggaactgttactggaacggggtcccgatccagaccccaagagagggttcttagacgttgtgcaagaaagaattcagggtgaggctgggcgcggtggctcacacctgtaatcccagcgctttgggaggctgaggcgggcggatcacgaagtcaggagatcgagaccatcctggctaacacagtgaaagcccgtctctactgaaaatacgaaaaattagctgagcgtggtggtgggcgcctgtagtcccagctactcgggaggctgaggcaggagaatggcgtgaacccaggaggcggagcttgcagtgagccgagatcgggccactgcactccagcctgggagacagagcgagatccgtctcaaaaaaaaaaaaaaaaaagaattcagggtgagttcataaagtgaaagcaagtttactaaggaagtaaacaaacaatagaatggctactgcatagacagagcctcccagaggactgctggttggctatatttatggttatttcttgatcatatgctaaataaggggaaaggtgtgggcagttcccagaactgagggttcctcacctttttagaccatatagggtaacttctggcattgctatggcatttgtaaacgtcatggcgctggtggtgggagtgtcttttagcacgctcatgcattataattggcctataatgagcagtgaggatgaccagaggtcacttttgttgccatcttggttttggcggttttgtccggcttctttattgcatcatgttttattaatggggtctttacgacctgtatcttgtgaaagcagtcctgctgacttcctgtctctgtgacaaagaatgcctgacctcttgggaatgcaacccagcaggtctcagcctcatttacccagcccgtactggagagatggagttgctgtggttccagtgcctctgacagaaccacgcgttatggtctttcttgtgctgacttgtttcgctcatcacaggtgttgttattgcgtaaggttctggcttgttctttctcctggctgtttagtatatatctgtttatttgtatttacttgtttatccattctattgccaatgggcatttggatagtgtccagttgggggcaattacgatcatgccaccgggaacattttgatatgtgcccttcggtgaacagttgaatgcatttctcatggatgtataatcagcagtagaaatgctgggttgtagagaaggtgcacattcaggctttgtctcagttaagccagagttttccaaaggggttgaaccaggtttccctcctgccagcagagtatgaaagttctggttgcattacatccttgccaacacttggtatccttttctttttttagttatttagttatgtaatgatcccacaatgtactttaaatttgcatttgtttccccgatggatatgagtttgagcacctttcatatgcttattgaccacttagataacctcttttatgaagtatgtcttcagacgttcccatttttctgttgtgttgcctgtccttttttaaattgatttcacagaactctttatatgttctcagtataaatatttgtttgagatgtattataaatatcttttttcatgcatgacttcatttgatccataagaggaggaaccgggaattttaagcctcaaggtcattggaatccaggacaagcttcacatgtgtgagcctcagtttccctctctaaatcctgtggatattagctcattgactggtgtatagatggaactgtgactgatattagcatcttttgctgggatgaggaagccctgaattaaaatgggcaaaactggccttgcatggctttcaacctaagtcatccctgtttctcaggtctgtataccaacttccaggctaggccttgaaaataaacagtgagcaaggccatttcctacccttggaggggactgcaccagtggtgagcgcagggggctgtgggatcccagcagaaacactaactgggctaaggcattgtggaaagcttcctggaagaggtgagtctcagggtggagtaagcctcttctgttcaggtacaggcttgggcacctttgtgcatcaggcactggacaggtacctgggagatggaaagaatcggcttagtctcaccccctcttaccccgcaatagaccagtgttcttgatggggatgactgcacccccagggggcagtcagcaatgcctggggacatttttggttgtcaggactcagggaggggatgctactggcatctccttggtagaggccggggatgcggctaaacatcctacaatgcatgggacagccccaccccatactaccacaaagaatgatctggtccaaatgtctatagtgcagagactgagaaactccaagatggacaattacaatacgatatgagcgggggaagagaggagagcagagggattgggagtgttgtcctggccttaaggagtttgtttgtttgtttgtttgtttatttactgactttgagacagagtcttactctgtcatctaggccggagtgcagtggctcaatctcggctcactgcaaactccgcctcctgggttcaagtgattcttctgcctcagcctcctgagcagctgggattacaggcgcctgctaccatgcccagctgatttttgtatttttttttctttttctttttctttgtctttttctttttttttgagacagagtcttgctctgtcaccaagttggagttcagtggcgcgatctcagcttactgcaacctctgcctcccaggttcaagtgattctcctgcctcagcctcccgggagtagctgggactacaggtgcgtgtcactacgcctggctgatttttgtatttttaatagagacggggtttcactatgttggccaggatggtctcgatctcttgaccttgtgatccgccttcctcggccccccaaagtgctgggattacaggcgtgagccaccgcacccagcctaatttttgtatttttaatagagacagggtttcaccacgttgtccaggctggtctctaactcctgacctcaggtaatctgcctgcctcagcctcccgacgtgctgggattacaggcatgagccaccgtgcctggccaggagtttattaaccttcatgcccaccacgtcaaccacaaaccacgtgtggctgcagagccctcgaaatgtggctgctgtggctgaggaactgaatttcaagtctttatctattttaatttcagaacagatactcattcccattcttggaaaacttttaagtgtgtgtacaacagtttgggtgtgtggatatactttgttcaactatcaattttatgaaatctctgtacagattagccatttctactgagaatttagcatccaaattgagatgtgctgaaagtagttttaccctgggtttcaaggactaagtaattaaaaaaaaaagactataaactatctcagtaatgtttatattgattgatgataatattttatatatattgagttaaataaaatgttattaaatttacttctgtaacatagctactggaaaactgagaatttgaagtgtgtctcacactgcatttctattgggtggcgctgttacaaactacaggaaggagctagaattctgtggaaggttttaggcaggggctgacatcctctggccaaaatgacaagagggaattccagagaccagggcaagtctggccacagggagactgcatggcctaggagacctgagccacagccgccaagagaagccctgattccccagagaggaggtgcccgctgccagtccacaggtgagcaacaagactggatccagaagagggaggagcctttaggagaggcaggcccatcgcaaggctgactgatccttcaaaggagcctcccagctaaaagccagcaggagagagaccttggccaccaagggtctgccagctcctggtggtccccactccagccacctgccagctcgagcctgaccctcgcctccaccctggctgctgcctgtaccgctctcaggtttgaaacctcatctcttgctgcttggctctgctctctactacttaccagctgtgtcaactagagcaagtggctttccctctctgggggctaccagctttgcatggcctggcccatgttgcagctagagctcaggaaagatcagagatgcccacaggtgacaggtcttcctgggctgggtgttttggaggtggcattatgaagtctcagtggggggtctgcagacagtattctctgtttgcagatggcttcccctctccactctgtgtgttacgtcctcatttcactgctgagaaagtggaggctcagagaggtgaagcagtttgcccagggccacacagctccacagaggcagaattcagatgagtaatgctgactttgcaggtccaaggataccccttccatggctataactcagtgttcgatcaagggcagagcactgcacctctctgggcctcaatttccccatttgtcaaatggggagaataacagtgccagtcagctgctgtgaggctatagtaagttgaataaaagtaacagagcaccggcccaaggcaaggcttcaggtggtggctgctgtttgttgactgatctgtgcataagtgttcactgcagccttctgcagtgagtggtaggagcccatttttaggggaggaaactgaggctaagatgtgcaactggtgagagcaaagttggggactcatctggcttcttggccctggagcactttccctcctctgctcggccctccggcgttacctgttattcatgacggggcaaggcttgcgctgtccccagcctggtcctccgtcctgcatgactggacatgaaggggcatagcagcagccttgccagtggcgctcacagatgtccagcccactaagcctgctccctccctcaggaactctgcttcctttgctgggtgagctgtaacctttcctccttcctgctccaagcagctactgagagtgagagtggttgatcaggaggctggtacgaagacacctaggctgtggccagatcctaaatgtcagaactgggagaggccttagaggtcattggcccctggcgctggttgtctagacacctcgttcagcctcagtctccatagttggaaaatgggaggaatcgtcagcttggcaaaaacggcaacctccggcaacacaaagttggtgcagaaggggaacatgcagactgctggcaggagggtctttgggagggcacttgcagtatctgctgaaatataaagggagagtggcccctgagcccgccgaccccctacaggtagctacctagagctgtgcttctcaaatcgtattgtgcatggaaacgcctggggtctggttaaaaagccggttaagtaccttctaaggcatgggactagcagcctcccaggtggccttactgcttgcaagaccctagtgaggccctagggcacctttcatgcatgggcacaaggaggcatggtcctttgtgatggtatgtcattgcaagaagatgaaagcagcttacatgtctgtcagaaggccttggctaactgaatggtgtgttgttcctgctgggatgctctggaacaattaagaagagggagggagggccgggcgtggtggctcacgcctgtaatcccagcattttaggaggccgaggcgggtggatcacaaggtcaggagattgagaccatcctggctaacacggtgaaaccccatctctactaaaaatacaaaaaaattagccgggcgtggaggcgggtgcctgtagtcccagctacttgggaggctgaggcaggagaatggtgtgaacccgggagacggagcttgcagtgagctgagatcacgccactgcactccagcctgggctggagtgagactctgtcttaaaaaaaaaaaaaaaaagaagaagagggagggaaggaggtccatcaaggtgttgcatgttgatgtgtcttttcttctggaaggatatcagtgccctctggaggctggggctttgtcttgtttactgatttggccccggtgctagaacaaggcctggcacccagtaggtgctcaagcaatgtttactggatgatagaacaaacatgctgacacggaaagacctcgtgttcagtgaacccagtcagtttcaggaggctatgtagaatccaggacttcttaaccttggcactagtgacatttgggactggatgattctttgtgctggggattacctgggcattgtaagatgtttagcagcatccgtgggctctacccatgagatgatccctaattgtaacaccaaaactatctctggacattaccgatggttccctgaatggcaaaatcgcccctggtcccagcactttgggaggccgaggcgggcagatcacttgaggtcgagagtttgagaccagcctgaccaacgtggtgaaaccttgtctgtactaaaagtacaaaattagctggacatgatggcacatgtctgtaatcccagctacttaggaaactgaggcaggagaatcgcttgaacctgggaggcggaggttgcagtgagctgagatcgctccattgcactccagcctgggtgacatagtgagagtcagtctcaaaaaaaaaaaagaaaagaaaagaaaagaaaaagcaagtgtagatggctcccctccaaactaatcaacagcagttacatcttagaaaagggggaagaacataggattggatcttttactccaaagagacttatgccttctccctccagtttgtaatatagaggttgtaccaatgagttgagcaattaggtgcatcttaaaagtagaaatggcacatggactggcttgtagagctgtgagggtttagtgaagttacacacctggaacgttcagcacagtgtctggctcatggtgggggtgctgccaaaggacaccattgttgttttattgtgttgcatctctccagcagcccctaagcatacagaagcagataagtccttctcgcatatgggcagactggagctcagagagggaaagggactctcccaaggtcacacagcaaaggaggagctaggcttgccttcatgactccaaaataaggacagtttctcctctgccaccctgtggcccccgccgggccgctgggcctcctggtctttgtatctgtggattgaggctgtgtgggctgcttcaagtcccccagcttgttgactgcttggtgttcaccagcccggctggcacccaggaagcaaacaaggctggaaatgtcacggggtgtagcctgtgggagttgtgctctggctttgcccagcagcactgggaggactgccagggatttggagcctgcgaggaaggaccttggcaaagatgttccctgtaggtgggtactggactggcggccagccctatgcagcttcaaagtcatgctgctcacccactgctcaaacatctgccatggctccctagtacctaagcctaaattttccttcctgtgcctgctgggatagcattccatgtcctacaaaggactctccgtgagatgctagattccagatactaataatagtaataatgatgataagacctagagcacctgctgtttgctaggtgtggaactaagtgcttcacatgcaatatcttttttttctaataaaaaaattgtatttacttagaagcattcagaatgtcaacaaaacagctgcaactttttctttttgcaattacagagtggtattcagttaacagaataattatttcgtataagctgcatcagagacaactgaagatgaaaaaactatcatccccatatataactaatttgtgctgtgcaccaacaagaacccgctttaaatttccatgccaatttacagcccccatactgtaccaggcaaggttagcggctattgaaaataccatcaggacagggctatctaaagacacattcggtagtgtgttaactatacaaaaaaagacactgtacagtttaaaaacaaatcttacacagccttacatttcaatttttttctttaaaaggagtgagttgtgtacaggggggttaaatgctttatagacaagaaaaaaaaaactgcgctagaaccaacttattcatcatcttcttcatcttcatcttcttcatcttcctcctcctcatcctcttcatcttcctcatcttcctcctcttccttctttttcttgcttttttcagccttgacaactcccttttttgctgcatcaggctttcctttagctcgatatgcagcaatatccttttcgtatttttccttcagcttcgcagccttcttttcataaggctgcttgtcatctgcggcagtgttattccacatctctcccagtttcttcgcaacatcaccaatggacaggccaggatgttctcctttgatttttgggcgatacgcagagcagaacaggaagaaggccgaaggagtcctcttgggtgcattcggatccttgaacttcttttttgtctcccctttgggagggatataggttttcatttctctttcgtaatgggccttgtccgcctttgccatatcttcaaattttcctttctctttagcagacatggtcttccacctctctgagcacttcttagaaaactctgagaggttgactgaagcatctgggtgcttcttcttatgcgcctcccgacaagtttgcccaaaaaatgcatgtgatgacattttgcctctcagcttcttaggatctcctttgctcatgtttagttatttttcctcagcgaggcacagtcgcccagtgcccgtccggctctcacttgccccggcgctgtctctgtggagctcagtgtactgcaatgcacaatatcttatttaatccttacaaaagtcatatggcactgctgcaatatgattctcattttacaaatgaggaacctgatgaccacagaggttaagtgtcttgcccaaagtcatgtagctctgtagccagcatctgtagcctgactccggagccacactttaaccaggagaccatcctaccgtatcttgttaggagagcaagccagcatgatgccagcagagaaggcctctgggtacatgggaagaacccagccaggtgttcaggcctggccgtgccattaacttgctgtgtgaccttggccacactctcctttctgagctcgcccaggctttctccgaggccactgctggctctgcattcccgagctcaaggacccaaagttatgcatcaaatctagaaatcatcttctcttattttatatcgtattacagcattgatatgtatatgatacatatacattgatatgatatgcttctatacccggtctgtcacaccgtgtggatttcctcagaggctcctagaaggccctgctgtccaggctaggaggtttctggcagccccaagctccctggcttctgcgtgaaggtgtgaatagaaccatgctgttaagtgggggtttgcagaaaccagggtttgacctgggagagccctaggcagcaggggatgatcaagtgatcaagataatattttaatgcaaaatttgaaaaatcaaaactaacggatgaaccttgaacagagtgtgctaagtggaaaaagctggtcattaaagaacatgctttgtgtgattccatttttatgaaatgttcagaataggcgaactcatagagacggaaagtagagtagtggtctcctggggctgggaggagaagggggttacagtttgatacgtaagggtacgaggtttctctttgggtgatgaaaatgtagcaaaattgactatgactatacgaaaactctgtgagtgtactactctgcacatactagaaacctgtgaatatattaaaccctgtgattatactaaagaccattgaactgtacactttatttttttattttttttgagatggagtttcgctctgttgtccaggctggagcgcagtggcgcaattttggctcactgcagcctctgcctcccaagttcaagcgattctcctgcctcagcctcttgagcagctgggattacaggcatctgccactgcaccctgctaatttgtgtatttttagtagagacagggtttcaccatgttggccaggctggtcacgaactcctgacctcaggtgatcgcctgcctcggcctcccgtagtgttgggattacaggcgtgggccaccgcgccgggcccatgaactgtacactttaaataggtgagttatatgatatgtgcattgtccctcagtaaagctgttatgaaacaatctaaatgcaaaaatatccatgaaaaacaacatataaaaattgtaaataatgtcaggatcagtattactgatttttttctttctgccttggctccagtgtggcttagcacagcgcaacatcacttgtcctatttaaacactttatattttttgtttgtcatggatttttttccactgatctaaaaaagattgcattgaaacattattgatcttggttactgagttttttggcacccccttgagtttttgtgctcaaggacaatgccctgcttgcctcaccctgttcctgccctgccaggcaagccttttgctctccctagggtggccagggtctcccccaccactctgtcccttccttctctctgtctccccatctgacggctgagaccagcaagcccaccccaagagaagctatgatttgtctgtccagccagtgagtcatgtgtgaggaccacagtagggggctctctccacatcacatcctcctcctgcccacagtgtctcctttgctgctttctcccttctctcccatctccctcctttttaatttttttgttttgttttgtttaaggccaagcacagtggctcatgcctgtagtcgcagcactttgggaggccgaggcaggcagatcacttaaggtcaggagttggagaccagcctggtcagcatgatgaaaccctgtctttactaaaaatacaaaaaaattagccagtgttgtggcccagtgcctgtaatcccagctactcaggaggctgaggcaggagaatcacttgaacctgggagatggtggttgcagtgagctgtgattgctccattgcactccagcctgggcgacatatatatgtgtgtgtgtgtgtgtgtgtgtgtgtgtgtgtgtgtgtgtgtgtgtattatatatatttttatataataatttttatacaatatatatatataaattttatataaaatatatatttttttgagacggagtctccctctgtcaaccaggccagagtacagtggtgtgatcacagctcactgcagtcttgacctcctgggctcaagtgatcctctggcctcagcctcccaagtagttgggactacaggagcatgccaccacacccggctaatttttaatttttttgtagagatggagctttactacattgcccaggctggtcttgaactccagagctcaagcaatcctccctcctcggcctcctgaagtgctgagattacagacatgggccaccacgtctgaccccatctctcttctttgagatggctccctgggtcccccagcagctatcacttggcctccagcccttgtcttttcaggcatcctacaccagagagagcctgtgtcccctcccaggtcacaaccagaccaatgctcacaatttcccaccgtccccaggataactccaagctccttacctggcattcaaagcctggcacagtctagagcttgccaatctcctttccccacttttcctgctcaccactgctgatttctcatcggtagattcagatgggactcacagttattgaagagctgcaaggcattagccacacccctctggtctttcccttattaagcccctatctcacttaatcctcacagcagcatcgctagtaagaattattgggcccattttacagatgaggaaactcaggcccagagagtggaggtgatgctgccaagggtctggggtagatgcaggtgcacgcccagtctggctggcagcatgggactctgaccacctgcctgtgcctcccctcatccactgcggatgtttgctttccctcagggccatgtgtacagtgcctctgccagggtcacccccactttggtccctgttggccttcacactgctaacttagtagccaaggtcacatgccagtgtgtgatgccagcgtggagaggagccatggttcttttataacagttgccatctcctacctacttatatttggggcttgctatgttgatagccgcaggctgggtctcaaattcctgggctcaagctgtcttcctgcctcagctttgtgagcagctgggatcacaggcatgagccgctgctcctggccacttttacttcttaaaataaaatcagaacatgcaaaccatgctccacaatatgccatcaagtgtttctggtgcaaatccctactgctcttgtgtttgatggtggggcgaggaaacgggcaggaatgggaaggaaggtgaatctagactcctgaggcaggaccatggctccctggccctaacagccatagattttgtgtccataacggagccagatgctggcagcgattcttaattggggttccaggctgcattcgggggcctaggaatttggatgaggggaaaattacatctttattgaccctagtttaacatttcctccaggtgacaacataggtgataaatcacagtagtagtggcagcactcgcatcaccagtagaaaccacactttttttttgagatggagtttcgctcttgtcgcccaggctagggtgcaatgacgcgatctcggctcactgcaacctctgcctcccagattcaagtgattcacctgcttcagcctcccaagtagctgggattacaggtggctgccaccacgcctggctaatttttttgtattttagtagagacggggtttcaccatgttggccaggctggtcttgaactcctgacctcaggtgatccgcccacctcggcctcccaaggtgctgggattatagacatgagccactgctcctggcccatatttttatatcacattttaggtgccacagatgtgtctgcttgcagatgacagtgattattctgtctgctactagatcttgttattgattgctttaataaaggagcagataggttacagataatatttcacagcaatttttgtaatcacattcttagccaaagtttactatgttggtttccttttcatcctgtatattttattgtattccatttaaaagcattattctgggaaggggcccatagatttcaccagatggttgaagagatccatggcacaaaatggtggaagaacccattagacctgggtttgagtcctcatgctgccctgcacctgctgtgtgagtgtgagcagagtgtgagcagcccattccgcctctggatttcttattcatgatccagccagagaggggctgtctcccccacagggttgccgtgggaggcctgcagtgggagtcgatgccactttgttgtggtgcctgtctgttgggtgttattaggtcttctgggcaggacgtgacactgggtgctccagcgtgccctgaacgtgttcccaccgcctcctgcacaccccagtctgtctgggcatccatcccactgggttgattgtctgccggctcaatggccgtgacactcattatgggcaggactgtgtccgtcctaataaataatggtacagaattgtagctgatgcctctgagctcacactctttgccagcttcacaacagctccacaaggtaggtgccgttttcagacttattttggaaatgttaaacgttataacaggtgagtgaggctcagagacaagaagtcactggctcaaggccactggtgagtggccacaccaagatcgcctgggtctgtccaactttaggtctacactcctgacccctgcactccacgatgattgcattcctgagcctggcccaggtgggcagccagtgaatagttagctggtgcaaaagtaattgcggtctttggtattactttcagtggcaaaaactgcattacttttgcaccagcctactagaacgctgagttcagtgccttaagcggtgtttcacagagagggagcaaggggcagcgcttgttaaaatgcaaattccctcagctccacgttaaaatgcaaattccctcagctccaccttgcctcttccaaatcagaatatttgagggcaggccccaggaaatctgccttttaaagttttgggctattcagaagcacaccaaagtttaaccactaccctaaagggaaggaataacagtcaggtagtaacaaagctctgttctgagtgctttatgtgagtttatttattgtgagacagagtcttgctgtgtcacccaggctggagtgcagtggcgccatcttggctcactgcaacctcctcctcctgggttcaagcaattcttgtgcttcagcctcccaagtagctgggattacaggcattcaccaccacgcctggctaatttctgtatttttggcagagacggggtttcaccatgttggccatgctggtcttgaactcctgaccccaggtgatccgcccaccttggcctcccaaagtgctgggattacaggcatgagccactgcaagtttatttatttagtcttcacaagtgttaatggcctccccatttcacagatgaggaaagtgaggcacaaagtagttagataacacctccccactgacccccaacccagggctgcattgctaggaatcagccaggtgtggaggattcctgcccctatgctcagtcccctacctctgacagcttctggacagaggagtagagacgggatcccatggtgggtgggggtgagggctcaggaagcactggtccctacaagatcacgctggccctttcctgtttgccttgtttaccaggcaggggccctctgtgtttctgggcaggaagtcctgagcaggggctgtgccaggtgtcaggggcaagactgggagatggtccaggagtctgagccgggcactactctgagcagctgtctgacctggggcacatagcttccccatctgtgtatggggtggggtcgagatttggaagaggtagttaagagcttgggttccggcatcagatagacctgagttccagatcaaactcagccacttatcatctgtgtgatctccaacaaagcacttcacctctctaagcctcagtttccccttctgtaaaacgtggctaataataatagtgcctaccctccaagcctgtcatgagggtcaaaatatattgttggctgtccgtcttcttgggttctgcatgcggggattcagccgacagtggatcaaaaatattcgggaaaaaatgggtggttgcatctgtactgaacatgaacagagcttttttgtcctgtgattgttctctaaacaatacagtgtaacaactacctacatagcatttagattgtattaggtagtataattgatctagcactgatttaaagtatatgggaggatacgtgtaggttttatgcaaatattacatcattttatataagggacttgatgtatactggtattcgagggatattctgtaatcagtcccttatgataccgaggggcgactgtatataaaactgccagccaggtgcagtagctcatgcctataatcctagcactttgggaggctgaggtgggaggattaaactcagactggcctgggcaacatagtgagaccccgtctccacaaaaataaaaaattaactgggcatggtggcacttgcctgtagtcccagctacttggcaggctggggcagacagatcatttgagaccaggagtttcaaggctgcagtgaacagtgatcactccactgcactccagcctttgagacagaaggagaccctgtctctttaaaaaaaaaaaaaaaaactgccaggcatgcacaagcctctctgctagtccttacgtggcaacagacaggatgctggatgattccctatgcatgagtgtgcacttctttttcttttcaatcaactatttgttttcccgaattgtacatttttctcttaccaaaggctggccacctgggtcctcccacagtccctactgagaaaagtcccagaaccaaaactggcttccacctcggctcactgtatttgtgctttgtgagtttgcccaggttgcactgagggcaggtgctgctgatagtgtcttttttttttttttttttttttttttgagatggagtttcgctgttgtcacccaggctggagtacaatggcacaatctcagctcactgcaacctccgcctcccgggttcaagcagttctcctgcctcaggctctcgagtagctgggactacaggcgcccgccaccatgcgcggctaatttttgtatttttagtagagatggggtatcaccatgttggccaggctggtctcgaactcctgacctcaggtgatcctcctgccttggcctcccaaagtgctgggattataggcgtgaaccactgctcctggctgatagtgtcttttcgtgatatagaccagggggttggcaaactatgcccacgggacaaatctagctgaccgcctgttttcgtaactagtcttatggaaacgcagccacttgccttcatgtatgtgtcatcttggttgtttgcattacagttgcaaactcgcagtggagctcttgtggcccacagagccaaaaacatgggttttatgacttcacagaagcttgcctacccccaagagagatgataaagcagggtcgtcgaaagttggggaaacagtttgggttctggcatcagatagcctgagtttcagttcaggctcaaccaattaccatctgtgtgacctccaacaaagcatttcaccgctctaagcctcagtttccccttcggtaaaacgtggctaataatagcgcccaccctccagggttgtcattagagtaaaaatgcacagttggccctgtacattttgactctaaatgacaacgaacagggagaagaagtcacccctgatcccacctgaccggaccacgcgttccttagtttgtgtgtatgtccctgccagtctttatccatgtgctgtaatgactgatcctaacatcaaaaggcggccaggcgtagtggcccatgcctgcaatcccagcactttgagaggcctaggcaggaggattacttgagcccaggagtttgagaccagcctggacaatgtattaagaccccatttctacaaaaaataaaatattagccgggcatggtggtgcactagctacttgggaggctgagatgggagaatgtgcttgagcccaggtgtttgaggctgcagtgagccatgattgcaccgctgtattctagcctgagcaacagagcaagaaactgtctcaaaaaaaaaaaaaaaaaaaaaaagaaaaagaaaagaaaaggaaaagaattaaatggtaatagttttcttatgctggctctgcctggcttgatggaagttacatagttcccatgacactcttccaggtgttattcccatttctcagatgagaacactgaggctcagagagctgcccaagattgacccaggacacccagcctttgagtgggggagccaggatgtgacccccagcctcatcagtccccacccctggctagtccctaacagagtgctgaactgggcctctgaacgggagactgggacagtgtgtgggaccctgctttgatggttttaggtaaaaaaaaatgcaaagcaagacagggaggagaacacaggctctggaaagagagagacttgagttttccttctagctcccctgcctcccagctgcatggccttcggcaggttcctttacgtctctgagccccaggaaatggatggttaataagggagggtcaaatagggtcaatggttaagacaaaatgcaatgatatatgtaaaacccttagttcagtgcctggtatataataagggctctaagtctgaactaatgtttttttgtttgtttgtttgtttgttttttaggcagaatctctccctgtcacccagattggagtgcagtggtgtgatcttggctcactgcaacctctgcctcccaggctcaagccatcctcccacttcagcctcccaagtagctgggactatgggtgtattatcatcaagcccagctaatttttgtaaagagagggttttgtcttattttccaggctggtcgcaaactcctttgctgtagcaatccatccccctcagcctcccaaagtgccgggattataggcatgagccaccatgcctggcgtgagccactgtgcctggcctgagctaatatttttaaggctgcatgccagcctccctgccctttttccctcttgaaccactcttcatgctttttatgctcaagcagtgtccagagcttcagaattatttttcccttactcacaccccattggaatctggagggctttcttggctggcttccccccgcaataggtcagaggtccctgattcccagggaccctgcccaagagacctgcgtctccccagctctgcagaaggttgaggcgtggtgggtgggagttggtgtggtcagcgtggtctggtagggttgggaatagccatggcaatggaatgttgggagctggttcccatggggaggaattgcagggctgatggctgagcctgagcacgtgggcactgggccctgctccagggccactctgtaagtgcagtgacctcctgagctggctttgtgcactgccagctccccgctgttgtcccctccctgcccccctgccgcttttctcttgggaacctcctgatctgctgagcttggagaaatgatgatttagaaagttcctatagatttgagccaaaattcagtgtggtctcaatgcaaatgtcactcccttctttccttctttaacccctggggaatgcctccacctctcatcatgggcatttgcttctgagcctttatcactggtgtcattgtctcacatactggtttcttggctccccactggaatgtcagctctatgaaggcaggaacctttgtctgttgcccttgatgtatcccagtatcttgagcagggccccgcacatggtacttgctcagtaaacattggtggaatgaatgaatctgagtctaaggggatctcttagattgattagcccctcccttccagggacatttcagggtcaatggaaagagggagcaaagtttcctcccatggtctcctgctgcccatttgttttttttgtttttttttttgagatggagtcttgctccatcacccaggctgaagtgcagtggcatgatctcggctcactgcaacctctgcctctcaggttcaagcaattctcctgccttagcctcctgagtagctgggagctcccaagcgcgatcccccacacccggctaatttttttttttttttttttttagtagagaggggggtttcaccgtgttagccaggatggtctcgatctcctgacttcgtgatccacctgcctcggcctcccaaagtgctgggattataggtgtgagtcaccacacctgctgaaatgaaaccccgctgtttccaacaaccgattctggcttaatctgattattttttttttcttttttctttttctttttttttttttttttttgagacggagtcttgctctgtcgcccaggctggagtgcagtggcatgatctcggctcactgcaacctctgcctcccaggttcaagcgattcctctgcctcagcctcctgagtagctgggattacagccacgcgccaccatgcctggctaattttttgtattttagtacggaggagatttcactgtgttggccaggatggtctcgatctcctaacctcgtgatctgtccaccttggcctcacaaagtgccgggattacaggcgtgagcccctgtgcctggctgctgcccctgttttatgagccgcatgacaccacgctagggttggcaccttggaggcagaaccgcatttggaaactggcctttcctcttacttgttgtttggcttctgctaatcactccatctcttggagcttcaatttcttcacttctcagatggggataaaaatctccaccatacaaggatttgctgaaaacaagagccagcaggcaggtagcacttgctctgggccaggtgctgttccgacatgccctaatttatttatacctcccagcactcctgcaagactagtttctcatttgcgctaggcacatttcaaagtgcccttctaggaggtgttacaggctgcgtatccctttatctgaaattcttgggactagaaaggttttggatttcagatttttttttcttttgaggcaggggctccctctgacaccgaggctggagtgcagtggcatgatcatggctcactttagccttgacctctggggttcaagtgatcctcctgcctcagcatcccaattagctgggactacaggcaagcaccaccacacctggctaattaaaaaaaaatttttttttgtagtgatggggtctcactttgttgcccaggctggtctcaaactcctgggctcaagcgagcctcctgcctcagccctcaaagtgctgggattacaggcatgagctaccacacctagcttgaattttttccgagtttggaatatttgcatcatactaatcagttcagcatccatactccaaaatgtctgatgagcttgcttgcttgcttccttccttcctttttctttctctttcttctctctttctcttttttctttctccttccttgcttttcttctttttcttccttttttccttccttcctttcttctttctttctttttccttttctttctcctttccttacctttcccctttcctttcccatgccctacctggtttcatactcacatcagcccaatcaggcgggtggtgccatgtcctcccccttcccctcccccgcctcctttccccctccctctcccctccccttccctttcctttcaagatggggtctcgctgtattaacagcccaggctggtcttgaactcccaagcttaagtgattctcccacctcggcttcccaaagtgctgggattacaggtgtaaaccaccatgccccacatccgatgagcgttttctgtgagcatcatgttggcactcaacaagttttggattttggagcatttcagattttgaaattttggattagggctacttgacctgtattatcatccccattttacagacgagaaaaccaagtctcagagaggctaagtgacttgccaaggtccttcagccagtagctggtgcagcagaatgttgaacccaagcagtctgggcccataacatgtatggcatacaattcaaaaattactagtcactttattattttatcatatggaaagacaataagatgacaccatcaagttatgtttttaggagaaaaatatcacctaccacccgagtaccacccctggtagcaatgttttttgtttctttgttttgaggcagtctcattctgtcatccaagctggagtacagtggctcgatcatagttcactgcagccttgatctcctgggctcaagcaatcccccaacctcggcctcccgagtagctgggactacaggcgtgcaccaccccctgcttggttaactggtagcagttgagtcatatttccttcttgtcttttttcttaagtgtggtttctatttgttggcgattttgctgtgtggtagagtcgtgctcaccctgcacccacgtgggcctttcttagcttaaaatggagaacatgccaccacctgcctgactgggctgatgtgagtatgaaaccaggtagggcatggaaagcccttgctttggtgttaaatacacaggggtgctgtgtatttaatatattcctcctacaagaaaaggaggggctgggtgaagtggcccacacctgaaatcccagcactttgggaggcacaggcaagagtattgcttgagtccaggagtttgagaccagcctgggcaacatagcgggactccatctctacacaaaaatacaaatattagccaggcatggtggcatgcacctgtagtcctggatacctgggaggctgagatgggaggatctgggaggatcgcttgagctcgaggaagtcaaggctgcagtgaacgaagatcatgccactgcactccagcctgggctggacagagtgagaccccatctcaacaaaaaaagaaaaaaaggagagctctttgactcctacctctccctctcatttgccctctaatcagcactgcccagcagaacactctgcagtgatgggaatgttctagtgcagaggtcagcaaatttctataaatgtccagatagtaaatgtttccaattttgtggtgttcatgtggtttctattgccattgctcctcctcctctctctcctcttcctcttcccttcaccctcttcccttgataaaatttacaaatcattcttagttcaagagtgatttgaaaacaggccctgggttggattgggccatcattggcctaccccatcctaaatgtgcactgtccagtacagtagccactggtcacatgtggcttctgggcacttgcagtgtggctagtgcaaatgagaagctggattcttaattgtatttaatgttgcataaggtgagttcaaatagttacatgtggctggtagctgcatgttggatgcacagctccaaatgactgacagccctgacagccctgttccattgctctgaaagggcctgtgttccctggagggggatggctgggctcgtgggccatgggagctgcctggctggcaggcctcttgggctcgctggcatttcaagagctgtctgagggcagctgggcgagccatcctgcctctggaagagcttcaagtgcctggttcctaattggttttgtttattccaagagagcaggcctcacatcattgaccgcccatgtcccaggagtgccggggcttgagtatctatagtttgggggtggcctgctgtgggggggtctagttgctgtggttacaccttggttcccttttccatctgggtttagatgtcctaattggcctgatatttcaggaataggaaaatggtatggagaaaaggagtgagtgaataggaaggaatggaggaccaagaaatgcagtcaacaccctgcagccggtttattgccatcatggcacaaataataaaagctgagttttttttttctttttttttttttttgagacgtggtcttgctctgttgcccagactgtagtgcagtgatgcaatcacagctcgctgcagcctcgacctcctgggcttcagcaatcctcccatctaagcctcccaagtagccgggactataggcaggtaccatcacctggataactttttattttttgtagagactgggtctccccatattgcccaggctggtctctaactcctgggctcaagtgatcctcctgcctctgcctcccaaagtgctgggatcacaggcgtgagccaccaccccaggcctggctgagatttaaaaagctgacattttaaagtgttgttaccctggttaaaatctcctgtttacagaataggaaaagtctgagaggagtgatatgtatactcaaggagttggccaactccagagctgcattccaaactacccacctcctgaaacaggactgacaggtgggaggtttagcttcagactcagtatgtgagtctgtaaaatgatttttccttgtgggcctcagttgtcccatctgtaaaatgggggaaggtttgaattggactaaaaatcttccctaccctaaatggtaaggacacagcactgggagatatatactccctgccctaaagctataaggatccccttgattccactttggcctggttctggctacatgccaggactcatcgtggacacagcctcgttcctgtaaccatgggagattaagtgttaggaaggtcttacagatctggatggtgaaactctttccatccattccttgggtaagttgctcttcctcttggtgtcatgctttctcatctgtaaaattgggatcatcacactttccttttattggggtttaaatgacacaggtatttgcgtggtcagcatttggtcagtgttaggtggtgacagtaggatgttgtgttcaattccaggaagcagcatattccttgtaggctgggcctgtggtaccatttggaattgtgcagtccacaacctgatcaaccatacccagccatctcaggtggcaatagtggtgtgtagtggtggttgttgttgcttattgttatatttacttttcctggagtccaaggtccctaggccaagaggaggggagaggcctggttggcataaaccaggggctccctaaggcagcggcgccttagctcagacttcagctcacacctctctgcctaagaagtgagccagttcattccctgtaggagtagataagttgagactccagctgtggtatcttgagctgaagcagcctcccctgcattccagagtccttctcccaaatgtcactgtccagtgctcttgggagcctaaaccctcactctgcctctttgaaggcttggcccctctccacagtgcccatccctgatgcaatatctcctttgcctctccagggctctgccagcagacagccttggcacacaggcacaagggctggagcccagagatgagagtgcccaagggaggtaagtgcacctagaaggaacttcccctggagtcctggcccctcctgagaccgccctccaaaagtcccctccatgcccccagcctccatgattgggtgcctgggcaaactcccctggctggttttcacctttctgttcagccagcaggttggaaatctggtactagaaaaagctgcatcccagcaagcatcatagagagatgagcatcttccttgtctattaggaagacgattctccaggtgataggagagagaaggctgagtcccaaagtgggcgggggacttgcccagtgtcacggagcagattcaagccagaacccaaacgctgttgtgtcccgttctcctaatgttagtgttttaggtatgctttctcagtaccccacaggagttccttggccttctgaatagcttccttgagaaaagggtattattattccttttttggagaagaaagtagaagctcagagaagtgataccttttgtccagatcaccagctggcaagtggcagcagaagtgagatttgaaccttggagtgtagtactccaagttagaagccctcacctatcatcctcactgcgaggatgccaggatacctcccttgccagggtccagcagggtgatgagggtgttgggcaggcctagttccctgggctgggccctctagctccttccacagtggggtccctagctctgggtaaccaggaagctactttctgctttgtgggttccaggctgctttctgtgtcccaagtcaccctgctttttcttcttaagccatcgtgcaggtcattgctgtcttctgctcacttctgacttgcctgctttgagctgttttcttcagccttggcctggtctgatccaggattcctgccctggccatgcaaccttgggcaagctgcttcatctctttgagcttagatactgcagggaaaatgctttagcagagtttatgctccataatttcgaacacctttgctgaacataaaatgctgaagctggccgggtgcggtggctcacacctgtaatcccagcactttgggaggctgaggcgggcagatcaccttaggtcaggagttcgagaccagcctggctaacatggtgaaaccccatctctactaaaaacacacaaaaaaatcagccaaggtggggatgctgtcactgaaatcctaataactgacaggattctggtcacaggtctcaggggagaatttcactgagcacctgatgaagacaaagggtcgttgcagggatttcggaatggcttcatgtcctgttcagcctgcctccccgcaggaagtagctctgaattagctttctccatcacagaccctgaatcgagggtacaaatgaagccccaacctcttcagcagaacttcatcagcacgtttttctgaagagagggaaattatccaatgcacagagaggccggtgaccccagcctgagatccatctctggtttgtcagctgcttctcatattttcacagcagcctctgaggtcagtggatccaccctgattttgcagctgaagagactgtggctaagatgagggaagtgactctcccaagccacatggccaggaagtcctagcctcttagcagtttccaccccaggcctgagactgtgttccctccgctttgatgtttattttccacttgctatagcctaagaaggcccaggcagcccaagcccttgcaggtggataggcccagctgcagactgggcccttgggtggttttgggtggaacctcacatccaaagaggcatgctgtcttcccactggcttccaccaaaccctccgttcactaagtcacttgcagttccccagtcgtgctgcatcctttcctgcctgtggctctgcgctggctattccctttgctggtaacatccttgtttcccttctccacctgcctgtttcctacccaccactgaaaattctgcatgaaggctacctcctgcaggaggccttccctcacctacgcaggtagaacccatcaatctctctcaggcacaggtccatggtaagagtagactttggaggctgaggctcccagcacatagcaggtgctcattaaatgttggaataagtaaataaccaatgattatgatagaaatcactaatattcttgggccagatggggtaactcatgcctgtaatcccatcattttgggaggctgaggcgggaggatcacttgaagcgagaccctgtttctaaaaattagccaggtgcggtggtgtgtgcctgtagtcccaggtacttgggaggctgaggcagaggattgcttgagcccaggagtccgaggccgcagtgagctatgatctctcaccactcaatgcactccagccttttttttttttttttttagacggagtctcgctctgtcgcccacgctggagtgcagtggcgcagtctaggctcactgcaagctctgcctcccaggttcacgccattctcctgccgcagcctcccgagtagctgggactacaggcgcccgccaccatgcccagctaattttttgtattttagtagagatgggatatcaccgtgttagccaggatggtctcgatctcctgacctcatgatccgctggaccgggtggctcatgcctgtaatcccatcactttgggagacaggtaggaggatcacccaggcccacgagttcaagagcagcctgggaaacatggtgagaccccatctctttaaaaaaacaaaaaaaattgaaaaaagtgcccagcagggtgccaggcacacagctagtgcttatgaaaggtgccctctgcattcatgtcagcagcctcttgtttgcagttatagggctttgcagttattggagagctcacagctcacagacctccctgactatgcatgtccccctctctccccagatgtgagcctggcgggctgcccgctaacctgtcgctgaagccccagaagcgggccctcaggccaggcctaccctgcctccggcccagcatgcgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagtgagtggagcccctgatgcttccactcagactctggccctggagtcagaggcgccaggcaagaaaatcagcactgcctttcttgagctgtgtggccttgggcaagtcactatatctctctgagcctccgtttcattatcccaaaaaatgacaacaattactcctctcctttctgagagaatctgcaaacttcgtgggctgtttgtttgttttttgaggcagtgtctcggtctgttgcccggctggagtaacagccgccacctccctgttcaagtgatcctcccacctcatcttcctgagtagctgggactataggcatgcgccaccaagctgggctaatttttgtatttttggtagagatggggtttgccctgttgcccaggctggtctcaaactcctggcctcaagcagttcttccacctcagcctcccagagtcctgggattacaggcatgagccaccacacccagcctagaatctgcaaactttgaatatgctttgtagtaaggcaatagtgggtaaaggttaagagcacagattccagaacaaggatgtctgggttcaaacctcagctctgccacttcttagctgtgtgaccctgggcaaagcgactcaacccctgtgcttccattgcttcatctgtaacatggaaatataatttgcctaccttatagatacctgtgggcatcaaataggttaataaatgttaggtgctattattactattttagtgttgatactgcttttattgatggagtacccatcctcaccattgtcatttaatgagtgcctactgtatggcaagtattgggttaagcccccaacaagtttatctcctttaatcctcacagcaacctgaggacataggaacacctcttatccacattttatagaccaaaaaactgaatctcacagaggagaagttactggcctcaggctacacagctaacaaagcatggtgctgggattggaacccaggtctgttttttggggtttttcttgtttttgtttttgtttttttgagacagggtttcactctgttgcccaggctggagtgcagtggcacgatcccagctaactgcagcctcgacctcttgggctcaagcaattctcccacctcagtctcccgagtagttgggactacaggcgagcatctccacacccagctcattttttttttttttttcctagtagagatgagatctcagtatgtcttccaggctggtctccaacccctgagctcaagccttcctcctgccttggcctcccaaagtgctgggattacaggcccctggcctattgtgttcttaaactccccatgtccagaactcctcccatcctccccttcactccccctcatcctttcctttccttcctccctctgtcccttgctccctgccttcttccattggaaaagctgctgtccctatcctgagacccagagcactttgaacaatgctggagcagaatatgcagtttccacgctttcccatcctgatcaggctctggatagcctgagagctcagtgaaagggtggtccttcccatggctggtccttcccatggctggtccctgctgggccccttcccaggcccagagcagagctagaggctcgcagctgctctccgctagcaacaaagttcctacatgccgggtaccccagccagttggtgctggagctaggattttataaattattatgacaaaaatattagattaccaaagtaatacatcttgactatagaaaattagaaaagatacaccaaagaagaacggagaaacaacccatgatctcaccacccagatcttgatgtgtggcctactgcaccattttcagggcctgttgatgaaactggagtccaacgaaacatactcctctgtagcctttttccacggtggtgtgggagcccttgccagtggcagccagcactctttggtagcagcatttttgttgttgttttgttgttgagacggagtctcgctctgtcacccaggctggagtgtagtggtgtgatctcggctcactgcaacctccgcctcccgggttcaagcagttctccctgcctcagcctcccaaatagctgggattacaggcacccgccaccacgctctgctaatttttatatttttagtagagatggggttttgccatgttggccaggctggtctcgaactcgtgacctcaggtgatctgcccgcctcagcctccccaagtgctgggattacaggcatgagccaccgcgcctgacctgcagcatcattttgaatagctgtgcgacaggctgctacacggattgccatattcgacttcacattccctattgttggacacttcggttatttccagttttactgatatgtatcaagcattgccctcattcatgttctgggatgtgtccacctcatttctgcaccataaagtcctagagacacaaggattttggcaaaagccatgcacatactcaagatttttgacatattgggtagagttaagatttaaatccaggtttgcagcctctgaatctgtgttctacccaccagtccacaccctttcaccttcccctgttctcctcacctcacgcccggtcttgtcttccttttgctgcctctttctgttctttcccaagtcacctcttagttgggatgaaaacatttagaactaggcccttgatcctgggggttccccaccattcatcctgtcaggcccctgagttataattggtaagatctgcatcattcaggtggcttgggaagcctgttacagggagagttaggaagcaggttgaagatgatggttattccatggtagctgtgaaaagttggaaacaacctaaatgtctgtcttcaggggaatggaaaaataagtgatggaggaaggctacatagctggcaaaaagagtgaggtattgagtggggaaaaaaaactagcgtatttgttttacagctgcagacgcgcgtttgtgtgtgtgtgtgagagagagagcgtgtgcacaggagagagagcatgctaacccttattaaaaatttacaatgtgttggccaggcacagtggcttatgtctggaatcccagcactttgggaggccgaggcgggcagatcacttgaggtcaggagttcgagaccagcctggccaacatggtgaaaccccgtctcttctaaaaatacaaaaattagctgggcgtggtggtacatgcctgtagttccagctacttgggaggctgaggcatgagaatcgtttgaacccaggaggtggaggttgcagtgagccaagattgtgccactgcactccagcctgggcaacagagtgagactccatctccaaaaagaaaaaacttacaatgtgcctacgctcttctaagcactttctttgtattaactcatttactcttcagacaaccccagtgaggtaggtactactatcattgccaattacagaagaggaaactgaggcccagagaggtgaagtaactttcccaaggccacacagctggggaacagctggcgtctgaacccaggcaatctggctccctggtttgctcttaactactctacaagaaaaggttagagaaggtggtgtgctccacagtgcaaagactgagtgcctgtaggaagccgatgggctggcagtgatgaacacagtggctttcagctttatcattagtgttttataactttttttagggacaaaatattcatgttagtcatacacattaaaaagtgtttcttttttttttgagacagggtcttgctctgttgcccagtctggagtgcagtggtgcaatcacagctcaggctcactgcttcttcaacctcccgggctcaagcaattctcccatctcagcctcctgcgcagctgctgggactacaggcgcttgttaccatgcccagcttatttttgtaatggggtttcaccatgttgcccaagttggtgtcaaactcctgagctcaagtgatccttctgccttggctttctgaagtgctgggattacaggtgtgagccactgtgcctgacctaaactgttgttattttttaagctggagaagaaagcagaatgtatgtaccaatggtgtatactgctagtactttcttctgacttctcactgcatgctgtgttcccattgtacaaaggaggtatgaggaggcaaaaatgactcacctgccatctcacagttgatggggcagagctgggtggaggccaggtttctccagtctttcctgctgccccagagtggctgagcagggaatccgctcaggcgccatctgggtctgccctaccctctccagcgtctcctctctccccaggatcgagcggtccacggaccaggtcatcaagcctgttaacctggaagcgctctccaagtggactggccacatccctggggatgtggtgcgggacatggcccagatcgcccccatgctggctcagctcggctatgacccttatgcaaacccccccaactatggcaaccctgaccccttcgtcatcaacaacacacagcgggtgagtgtgcacctgtacttgtggaagtgtactcttggggatatggggcttctgcagatgtggaaactccagccacctgaggaaatgttcagtctctcaattcctggtcatctgatttgttcctgtctgatggacacagtgaactacatgattgcttgtatttccattttgcttgggctgcagggaagctcaaagccaactggtagcctgtctctcatactctaacatctaacagcaggccagcttgtacactaatttcatcttatttctctaattttatttacatttttacccctatttccctggctatttgtttatctgtttgtaaggcacctcaagtctttgttgagagggggtataaataaataaactattggtccctttcttgtcttataaggtttaatgtggatttctcagacaaatgtgagtttagggctgtttaaattatgcttaaaattctccttagttaagatggtgaagggaaatgacttttttgttttgtactgttttgtttgaggcatggtcttgctctgttgcccaagctgggtgcactggtgcagtcatagctactgcagcctgatacttctcggcttaagccatcctctcaccccaggctcctgagtagctaggactgcaggtgcacgccaccatgcacagctaattttaatttttataaaggcggggtctcgctacgttgcccaggctggtctagaactcctggccgtaagggatgcccctgcttcactcttcccaaagtgctgagattacaggtgtgagcctccagtgactgacaaaatgcttttgaagtgttaaagtaggctaacacccactgggtaaaagaacagttaacaagttgatggccttatttatacgtttccattacagcttctagtttactttaagtgctgtgttctaacttccttataggcaaatatttgaaaatgggacccaggcctgaggaagagctttcacagcccttacttcattaagacccagagtctttaatttaagctaagctcagcatttctgagcgtgtgctgattttaggaaataaacagttatcgtattgaatcacaacggaaaaaagttaatcgtctcttagttccgtaactcttcagttggctcaagaagaaagtttccatttggtgctaaaaagtcattaccacctctctagcactcactgatctctctttaacaaagagaatttactaacgctgagctttgggggctgtgcccttgtaattgaagtgtaagctttgtctgtgggtctcgtgagttcctcttcctcttgacattagttgattttgcagacatctatttatggaaatactcagagattcaacgtacataccagccgacattgacaggtgaatggctgcaacccagatgtggtttgttatttttattataaatattattaatttttattttattattctttaataatagtaatctttaaaccctacttatgtgttttacatacttttatctgcctgtgggttgtacatgtattatcaaaataaaaaattaattaactggattaaaaagatggtagtgatctcacaatccagccccaggtgcttctcagaagcagaggcgagggccggctggggacactgcagtagtgggctggatgttgcttacttcactgttctcagccaagggcccagcagtggctcctctggggtctccttaaaaggtggctcgctgcccctggcttgccccaggctatgggtcggacgttcctggagtaaagcctgactttatgtattttataaaacacaaataattttcatgagcactggtggttaacatcaactctttggagctttttgtgtttgtttatttaaaatggaagctgtctctcattttcatccaaagagatttcttccctggggcggtcaacaagtcttggcaagtgctagatccctggtttagtttttgccatagcttggctgttactgcaaagaaaagtcctctcactaagccctgtgagtttgcatgcatgcctgtgtgcttctgtgagtgctgtggaccctgtgtgttccaataatggatcctggggctcagtaaacacagtggctaaaaggacatctatgctgatgaaatcgtctctgcctgcagtgtcccatacggtagccactagccatgtgtggcccctgattctgtaacaggaggctagtccaaagtgagaggtcctgttaggtgtaaaatacacactagattttgaaggcttaggacaaaaaagtatgtaacgtttcttattagtcacttttatataaattacatattgaaatgttaatattttacataggctggacatgatggctcatgtctataatcctagcacttttggaggccaaggcaggcagactgcttagcctaggagtttgagaccagcctgggtaacatggtgaaacctcatctctactaaaaatattgaatattagccaggcatggtggcacgtgcctatagtcccagctactcagaaggctgaggtgggagaatcacctgaggctgggaagtggaggctgcagtgagccgtgatcgcaccactgcactccagcttgggctatgggagtgagaccatgtctcaatagaaaaaaaaaaaaattagctatatcaggttaaataaaagatattgttagaattaatctcccttgtttcattttattttaaaatgtgactactagcggaaaggcctgaaatgttgtggttctaacttcagggcctttgctctgttgcctctgcctggagtgctttttcttctgagcttagcctacctatttttccttgtcgtttgggtctcagctcaaaggttatctatttcaagaggccctttttatttttatttattcactttcttagagacagggtctcgctctgtcactcaggctagagtggagtgatgtgatcatacttcactgcagcctcaacctcccgggctcaaccaatcctccagctgaggctggagtagctccagagcagctgggacgataagtgcatgccaccatgcccagctaatttttaattttttagaaatggggtttcagtgtgtttcccaggctgatctcaaactgctggactcaagtgatcctcctgccttggcctccagaagtgctgagattacaggcatgagtcactgcgcctggcccaagagtcccctcttgaccacccactcaaaagaagccccctggttactcctaatcccacctctttactgtacttttttcacaacagttcccatggtttgctatgtccttgtttatctgtgtttatttttcttgtatgttatctggtgccccctctagaatggtagctccaggggaacaggaatttccattatctggttaacatcatgtcaaccagacacaatgcttagaataatgcctagaagaagaggagcttaagcaatgtttgttggatggagggatgggtgggtggcgaggtggatgggtggatgactggatgtgttgggaatgactaaattttattttttggccattttcataatagtgatatttctttttctcttccttaggtcttgaaaggggactataaaacaccagccaatctgaaaggatattttcaggttagaaaccccaaggggaattccgaattctgtctttctcagctataccaccatctggctgtatgcccttagatgtgtcacttctccactctggttgatggttttcccattataaaaagggggatgtgagctggctgcctgtaatcccagcactttgggaggccaaggcaggcagatcacgaggtcaggagttcaagaccagcctgaccaaaacggtgaaaccccgtctctactaaaaatacaaaaattatccgggcgtagtggcacacacctgtaatcccagctacttgggaggctgaggcaggagaatcgcttgaccctgggaggcagaggtcgcagtgagctgagatcacgccgttgcactgtagcccgagcgacagagcgagactccatctcaaaaaataaaaataaaaaataaagggctgtggggatgcgtgctggaccagagggtctctaagcactgatccagctggggccacatctcagtggcccttctgccaggaagcagcctctcacttcgtcttccggcttgaatgcagttggagggacttcgtggggactttttcttgggctttctttcttgttgagactggagtgcagtggtgtgatcatggctcactgcagcctcaatctcctgggctcaagcaatcctctcacctcagcccctcaagaagctgagactacagacacacaccatcatgcccggctaatttttgtgttttttgtagagacagggttttggcatgttgtccaagcttgagttgtattatttataataaacaggtagcagttagtaaagtgttttccctagtgtcttgtgagctgttctagtgaattatcaaaccagagtgggggttgtgggaacctccagatttgaagttggctgggaagaagtgtggatagcctgcgcaccccattgcagctggcatctaaagtggggcagtcgtggaactgggcccttaatctgtggcagctgatgctaagtaagtctgggagctggtgtcagaactgaactgaattgttgaacacccagttggtatccagataatcagagaattggtcactgatattggaaagcacccataagccaatatctgaaggattaaaactaggtctgccacacaaagatctggatagaaaaggcttcccggcagagggaactgtaaacgcctgaaagtggggagtgtggccgaaacctctggagtgcgtatgcacttttgcattcgttgcaattatatttttctttgtttctaccccaatgtgatttacaggaatgttcattgcaattttcatgttcaaactgccttgttttgctttcttaatattttcctatcttttgagtttcaccggcaccattttggatggctacgtagtgttctgtggaatgcatgtgctaccatttactaaacagcttcttcaagaccatttccagtttttacaacatccagaatgacattatgtgcacagtggaggacagtagggagatgagggttggaaatagaggcttgacaaaacttatctgcagggcagccctcctgagcgtgggggtatgccattccttcatattttgttcctaaaagcaacaaaaaccagtcccaggtcagctagacatcttgcatatgtcatacacggcaggaagtataaactggcccaacccttttgtttttgtttttgtttttgtttttgagatggagttttcctcttgttgcccaggctggagtgcaatgcggtgatctcggctcactgcggcttctgcctcccaggttcaagcaattctcctgcctcagcctctcaagtagctgggattacaggcaccggccaccacgcctggctaatttttgtatttttagtagaaaggggtttcgccatgttggccaggctggtctcgaactcctgacctcaagtgatccacccacctcggcctcccaaaatgctgggattacaggcgtgagccactgctcctgaccccaacccttttgtaaaacacttttagccttgttgttcaagagtcttcaaaagatctgaacccttccacctgctcctgctgattcctttttttttttgagatggggtttcactgtgtcacccaggctggagtgcagtggcgccatctcagcccactgcaacctccacctcccgggttcaagcatgattccattttttagaagtgaattctaagggaatgattcagtagagcttcagtacccaacagaagagaggcagaatcaggatgtgatgtcatttaaaatactgcaaaaattggaaccattcttaggtaagcagtcagtaaacggtggtacatgcactccacagaatatctgtagccatccaaaatggtgctagtgaaacccaaatgatgaaaaaatagtaagaaagcaaaacaaagcagctcatactatacaattgcaactaatgtaaaaatgcatattcaggtggacaaaaaaaggcaacacgcaggagttgggtgcagtggcatgcctgcagtcccaggttctcaggaggctgaggtgggaggatcgctggagcccctgtctcttaaaaacaacagcagcaacaacaacaacaaaaacgaaggcaacgtgcaaaaatgagaagtttcagtttgtggataattctcctcatccccactgtgttgttctgcctacatcatctttttggttaaaacaaatactaaattagtgctcactaattctggctactttcttgacgtcagcaaaagatagatctctgattcccacaaagggagtgggacctctccccaaacaaccaggaaatgctcaaaagccatggtccctagctctcagatcgcattaattttttttttttaaattcaaggccaacacagtgagaccccatctccctacaaaaaagagaaagccttagctgggtatggcacatgtggcacatgttcgtgccactgcactctggcctgggtggcagagtgagaccctgtctcataaaaaagaatacaactcaggtacagtcaaatgcaagaagcgtagggtgaggtatgggggatgggtcacagaacatccatgccctttcccggcatgacaccctcccagcctctcaatgtgtttaccaaccaggaagctttccaaattctgtcatttagagatttcatcatagaggcatgactgattaaatcatgggtcatgggtgattgcccaatctccagctcctagcccctagaccctctcccctctcccctcccaggaggtcagggaggggagaaggcaggtggggcttaaagttccaaccttctggctgggtgtggtggctcatgcctgtaatcctagcactttgggaggctgaggcaggcagatcacttgaggtcagcagttcaaaaccagccgggccaacatggtgaaaccctgtctctactaaaaatacaaaaaatattagccattcgtggtggcacacgtctgtagtcccagctacttggaaggctgaggcaggagaattgcttgagctcaggacgcggaggttgcagtgaaccaagattgcaccaccgcactccatccagcctgggcaacacagtgagactccgtctcaaacaacaaaaaaagttccaaccctctaatcatgccttggtctttctgagaccccttcccctaatcctgaagctatctagggacccccagccattagtcatgtcattagcatgcaaaagatacgttttgttttttttttgtttttgtttttgtttttttgatacctagtctccctctgtcacccaggctggagtgcagtggcatgatcttggctcactgcaacctctgcctcccgggttcaagcgattctcctgcctcagcctcctgagtagctaggattacaggtgcccgccaccacacccggctaatttttgtattttagtagagacagagttttgccatgttggccaggctggtctcaaactcctgacctcaggtgatccaccctcctcggcctcccaaagcgctgggattacagccatgagccatggcgcccggccaagatacccttattccttcagagattccaagagtttggggagctatgtgccaggaactggggacaatgaacaaatatttattattataccacagctgaaatgccatcttgtagagtcctttcctggccaccgtttttgaagtagcacagatactgatcactcatagcagcctgtcatattgcccaagtttgacattttcttgcatctgtgcgtgttcagtaggctttttcttcaactcgaacgtaagttccgtgatcctaggtttgggtctgtcccgctcaccacgctatcccagcacctggcacatagtagatgtacagtaaatactacgtgaataagcatgtgcatgactcagtgatgctgaggggtgaccctcaatacagcaaggcatccctcacctggccgtgaccccttcttctgtgtattgtctttctccaggtgaaccagaacagcacctcctcccacttaggaagctcgtgatttccaggtaagcctgtggacttcactgggggttcccgctgcttctgggtggccccggagccacttttctgaaaagccacttttctgtccttccagagcctccctggggtagacatgtccactagggtgggctgacccagccccatcagaggtttccatggtgacagactgggggtgctatttatagaatcaaggcttagttttctagctctggatcaaggacagggagagggattaacgctgaaccaaccagaaaaaggtttgtctgacactggggacagggcaggaagcaccactatgatgggggagggggagattctggaaccatttttgcacagaatgctgtctgccagtctggcttctaaaaacagcatcagcgttgggccagagcaattaatgttctaataacagtcacaagtcgttctgttctaagaataacccccatggccgttgggccaggtactggtcctgtgttactcatttaaccctcagcatccttgggaggcggatgacatgatcattccattttacagaagagaaaaccaaagcacagagaaggaagggctttgacttgcccaaggctacacagccaccaagggacagaattcctcccaggtttgcttttagtgaatgattttaagtgcacatttatccatccatattctactaaggggtggggaaagggatttttttgaacttggtaattcaaagatttaagatctccaggtttaactcccttcagcccctgttttcttcatctggagaatggggattcatcattgcccacctctgaggttggccatgagatggcgtgagctggcccaggtgggagtgcttggaaaccgtgaagtgctgggccctcgctgtggacttgggcactggagttaaggctgcatgagtgagctcacttccttctgtcccccagcctctatgatcaggttaaaggaaacctcaagagaggttattttacatggaaacaccttccagcttggactcttatttttagtctctgtatctatttttaaacaatcagcatatgttttagtttttctttcaatttactttgctccaacctgcaaggactctgtcattattagggttcccatcttgagttgcactaagatcccagagtttttgtttttgagacagagtctcaccctgttccccaggctggagtgcagtggcacgatctcagctcacagcaatctccaccttctggggttcaagtgactctcgtgcctcagccttccaagtagctggggttacaagtgtgcgctaccacacccagctaatttttgtatttttagtagagacggggtttcaccatgttggccaggctggtctcaaactcctggcctcaagtgatctgcccacctcagcctcccaaagtgctgggattacaggcatgagccaccacacctacccaagatcccatagttctattccaaagaaaagaaccctctcatgaaaaacagctttcctccctgttcctcactaactgttccctcgctgcctttctgcagatcattagtagaatcctggaccttctcattgacaaaagcagatttgttacttgttttactgtttaaatgagataccatatagaggtgctttagctgaatcctgggtacagagttggccttgaacaaacatgagtccttctcttgcctccaagaattcatcagtatttatcacataatcactgtcatttgctctgtgtccataagaaaagtgtatatttgaggtcaagtggatgcaagatgagatgtggggaagaacccaggaaacgtttttaaatttaaactctctctggccatctgggatgcattcttaaaacattacatgcttatgcgaatggatgaagacagtatgttctgcaatcacatgtataaatataaatgatctatttcagaattgttactctgagcctaacacagtcttccccactttcagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgccttactttactgaatg

SEQ ID NO: 36535 - DNA, 634588 bp, Homo sapiens
atgaagtgggcaaaccagacagctgtgacggaatacgtcctgatggggctacacgagcactgtaacctggaggtggtcctgtttgtgttctgcctgggcatctactccgtgaatgtgttggggaacgccctcctcatagggctgaacgtgctgcaccctcgcctgcacaaccccatgtacttctcagcaacctctccctcatggacatctgcggcacctcctcctttgtgcctctcatgctagacaatttcctggaaacccagaggaccatttccttccctggctgtgccctgcagatgtacctgaccctggcgctgggatcaacggagtgcctgctgctggctgtgatggcatatgaccgttatgtggctatctgccagccgcttaggtacccagagctcatgagtgggcagacctgcatgcagatggcagcgctgagctgggggacaggctttgccaactcactgctacagtccatccttgtctggcacctccccttctgtggccacgtcatcaactacttctatgagatcttggcagtgctaaaactggcctgtggggacatctccctcaatgcgctggcattaatggtggccacagccgtcctgacactggcccccctcttgctcatctgcctgtcttaccttttcatcctgtctgccatccttagggtaccctctgctgcaggccggtgcaaagccttctccacctgctcagcccaccgcacagtggtggtggttttttatgggacaatctccttcatgtacttcaaacccaaggccaaggatcccaacgtggataagactgtcgcattgttctacggggttgtgacgccctcgctgaaccccatcatttacagcctgaggaatgcagaggtgaaagctgccgtcctaactctgctgagaggaggtttgctctccaggaaagcatcccactgctactgctgccctctgcccctgtcagctggcataggctaggttgtgctgtggtcatgacctcaaaccttgagaggcttaaagccattaaggtttgtttcttgctcctgatgcaggtccaccagaggctggtggggcttctgctccgcatcatggtcttcacccctctgggactcaggatgacaaaacagctaccattgggaacactgctggtcaccatgacaaaaagaaaagggaaagtaacaaagcctacactgactcttaaagcttctactcagaagtggctgtgttgcctccacctacatttcagtggccaacacaatggcaacaggaaggcacaggaccacacctattgttaagggggaaaagcacactatcgtgtgtctggatggcaaacgagagggacagagagatttgtgaatggcctaatgactaccacaccagctgacagtgtcaacccaagagctatgggaggtttggctttctttatcctgaccatctatccttcacgggctgctgccaagttaatcgtcccaagaaagctctggttagctcacgtgtggtagctttatactgagtcaaccaaactaggttagagggtgtgggttagggttggccacagagaagtttgcatgtgatttggaaggcaaaagtgggccaggtgtggtggctcatacctgtaatcccagcactttgggagaccgaggtgggaggatcacctgaggccaggagttcgagaccagcccgggaaatgtgatgaaaccctgcctctactaaaaacacaaaaaattagccaggtgtggtggtgcacctgtaatcccagctactagggaggatcgcttgaacttgggaggtggaggctgcagtgagctgagatggcgccactgcactccagcctgggcaacagagtgagactccgtctcaaaaaaaaaaaaaagaaagaaagaaaaaaaatggaacagcaccagacacagtgagggcacccccatgttgctcatctgctggctccccattagcacagcctgtccagtccccaccaggtcacctccttccactgtgctgagtgctgggccaagtgcaagctccatggcaaaggtgacagcttctcctgcaggtcaccagtcactgagattgaaggcataagagccaggcacaggttccagtttgtccttctggattctagtgtgcccttactgcccctcacttcacactcagccttctttcctaactgctggcccagctgagctgtaacagcttcaggcccaacaccaaatgcagaagtaacagttttgcacagatttctccaactgctcccatgactgtaaaggtctaatctttttatcactcatagtggttctgttactttggtcaaacctggattgattcatcactcttctgatcaaggacttttgacagctcccattaccattaagtccaaattcttcagttgaatcctcaaggccctccagaatctgcccccacctgcttcttcagcctgattttccactatgcccttcacatggctgtcccctcgctacattatctgtactgccgcacccccatgtcttcgcacccttgtatgtattgtgctgttctctgataatagctgggactagttttcaaagctaggttagacaccatctctctcatgcatcctttcccattgcactttgagatcgctctctttacatcctacagcactttgtcaggatcttccacttcacacttgtcccatctaacttgcattcatgacacttcaccaccgtgtgagctccttcagggcaggattcagtcgggtctggctcatctctgtagctcccacagcatgttccctatggaaggtttgcgggactgaattgtcactcagaagctttcagaacatcaccctgtggggattgagccctgtgctgctgaacatgccccaggcagctgcaagtgctcaggggtctcagtccagtcgtatgtacagatacatgcaagggtacagcaatatctgccagccacagccctgtattcaaggcaaggaagggctgtttgaatcttgggatctcccccactgagacaagtcaggagacaaccaaggattcccattttgggagcctggagacaggcctggttcagcggctacgtccagcactgtcatattgctggcccccttccctccgggaatcccacatgcacctcaaactgtccaaagtggagctcatcttccccccacccaaagtggtgtcaccatctcagggaatggcaccaccatccccaaatcagaatatcaccatcatcctaggctctctcatacctcaccaccccacacacccaatcagtcaccaagtcctaaagagttcactcctaacagctcttaaattggtcccctcctttccaccgatattgctttaagaaggcttcaccatttctctttcaaatgttccaatagctgtggtcactgcactttgtcctccaaggtctcccaaagtccatcctctgccccagccatcaaaaccccaatctgatgttcctctcctgcttaatctctccaatggctcctcatttcccatagaataaagacccaacctccacttatctatctaatcatatcattggctgcttacctccaccaccccactccacacacaaaagcatgcgcacatgcactggcccaggcacactgaactattcagtgcccggagtaaatatcagtctttcctgcctctgcattcccccttgctgttccctctccatgtccaaacacgtggtgaccttaagctaacatatattggaccacatcacataccagactaggcactatacaagtgttctaagagctttactgactgaagaccacagggagtgatgaaaatctcagggaagggatgccatgtggacactggtgaccacaaagaacactctcccattatcttagcatcatggcaactcagctaatcctagttcaaatgtccctcttcccagacgcccctcatgacccctcctcactgggagggatgcaccccagctccgtctcccacttcagagccttctgtactctgctgactctgtccagaatcccagctatttgggttcaagcatcccagtgacctggctctatacgtcttaatgtggtatttctgatgtaggaacagtattttctaaaatgggaacagacacctagctcacacctcctcactgcttctcactactcacttggccacaccattctctgctcagtgccccatggaagagacgtgattgcagaaagcagataacaaaggcatgttttcctggcttttgggtttcaaaagcctaggtcctgaagggaacagaaaaggcttaaggcatagataaaagattcaggagaggccaggcgcggtggctcacaactgtaatcccagcactttgggaggccgaggcgggtggatcacctgaggccgggagtttgagagcagcctgaccaacatggagaaaccccatctctactaaaaatacaaaaattagctgggcttggtggtgcacacctctaatcccagctactcgggaggctgagacaggagaatcacttgaacccgggaggcagaggttgcagtgagctgagatcgcaccattgcattccagcctgggcaacaagagcaaaactccgtctcaaaaaaaaaaagattcaggagaaaacattaagtaaggcttcctcacctccaatattaacgaaagggggaaagaagagagaggaggagaggatgtagtgagaatactgacacagagggtcccaaaaggaagagtccctgagctccacaccccaggccaagatagatttgcagttttaacagatgcagcaactcatgccttgtctgtcaaaacccagagcagaaacagcttcaaggtgtgtctgcatagccaaggccttagacaactttacgggtctccacatatggcccagaagtggcagagagaaccttaggactgagagagtaatgcaaatgggaacaagaaatctctctgcatcccagatgaactgtctggacctctgactggggaccagatggaatgatggaaatcccggggatggatgaagtatggacactggtgatcagtgagaatgctctcccaacttcttggcattatgtaagaccctcagaactcagctatgaccctcatggaaagagaaggaatcccaaatggacaaatgatcttttctggcactcaggaaaaatgggggctcaaaacagaagttacattcttgtgatatttcttgcacacctgagacgtgtacctgctattccaatttcctgggacctcggcttccttctgtgttgggtgtgggcatcataaggaaagtctgtctcactgatttaaatcatctcagcatacgtatacatacataaacacacacacacacacacacacccctcagatactgcaaatcgggctcaataggaattggggaataggcattagaaactgtttagaaatgaatgcagggcccagatgagcgggatcagactgtgtacagggtgtgacaaaagcctccggcagtagctcccatcagccctgctgattccctgaggggccctctttccccacttccccacacccctgaccccagggggaaaaaaggcatcacagaaccattctgaaccaatcaatcactggagacacacagactccacctgtatcaaacgaggataccagccacccagacagccccagtcccagctccatccatcctgcaatccctcctccacagcacagcacagcccagacgctgcctctgggaaggaagcctgaggccagagttgctgagcctctgggaaaatctggaaatttggtttccccaagatagactccacctcctctggaaagatgctgtgctcctgacagggctttgtctccctgggaaggaatccatgtcttgggaaggctctgcatcccaggaaaggctccacacctgcaggagggactccttggtcctgagggactctgtgcctgcataggctccagtccttaagaaggactccatgatgcagggggactccaggccctcaggaagttctccatgtcctgggaagggctccaggtccctggaagagttttgtgtccttgagaaagactccatgtcctcaagaaatacagcctgtctccttctaagagggctccacacccccagaaagaactctaggaagcattcatatcccctcagggccaggcccaaagcccctctcagctggcacagatgctgctgacagtggcccctcctgggcccacgaggcccagctcctcctgctcgttgatgcatagctggtaaccacagccccgggcccgggctccagatgggaccccgtggtcagtcttggcacgagggggcagcaggaagcccacactgcccgcaatgagcatatgccaaatgctgtgaatgtagaagtagttgtcccgggtctccacaaaagcataaagcaggacggcactgcctgcaataaggctgccagggcacaagtagaaaagccagcggcgccacgtgggtgggtagcagtgccggcggcggacgctgcgtactgtctgggggagacagagaagtggggctcaggaatgccaagccctggaacccaagccagagctggtcactctcaggtttcctctgtatcctggttgtgacctaaagacacctgccaagactggagcggacactgccagcagcaggtgatgacgacagagccaagcccaccttaaactggggaccagatacctggggcccagcacccaagtcctgctgggaccctccccccacatccctccccacccttacccaggctgtggccaagatccccagggcgaagagactgggtccaagcaggttccagagtccatgtcggtcaagctgcagagccatggacagcagcatagctcccagcaaatacagcacctagagaaagagactcaagggctgggctagggccaggtgacagacagcactccagggcctgggtcagaatcatgagaggcacttggaaatgcccccagggagaggtcaggagtggatttcaaggagacttggccatggttgttccccagggcccactctggactgacctgcttgaccacgggctgtaaacgagccatggcaatgacagtgacccacacggacattaaggagcccaggaaatcacagaactgcagcacatcgtagtccatgatgcagaaaaccacgatgcctggctggtcacaggcatgatagaactgaaggaagaaatgacaggcattgagagaacttgaggcagaggtccagatctacaaaaccggaggggtgggcccaggggtggtgtgctgctgtcagtgcagcagaggtgaaaggtcacagatgagaagatctgggaaatgcctgactccccaaatcctgagaagaatgtggtaaggaggtccagtctgctacataactaatatgtatctggcagccctgaccctgaccctgagcttcctaatcttcctgcttctggaaggtgctgtggagagtgccctgccagggggttctgataccctcaagctgaggccaatcctgtccctgtctcctcatgctcaccatggatcccacctataatccccatccctggcccaagctctaagctacccagaaaccaaatctccccactatgtcccagtttcccctgctagctcagactctgaactgggcttcactctcagggcttccaccaactgaccctcttcatcccttcccaacaaatgcggggagtgtgtggcaggtaagaaaaaaggcagtccctaaggccatggagagaggcatggcacttcacaccatggggaagaacatggagaggggacagtgtccacccatcctacactctggagaacatagtgaagagtggactattgaggaggttcaaaggggatgcagggagcagaagtggaatcggatcagactcaactggacatcctaattaaggaaccaagcaaagtctgccattagctcccttgtctgtagttccaacccatgtccagattgtctctctggacaatgccatggcttccagcatcctgtgttcccttatttgtgaaaaaagttttctaggcataactctttagtggcagagatgccaccaaaaaatctggaaaacatattccaaagtcagtctctagagacaaaagatgaaaaagaaatcgctaatgtttcctttgaccctactgaagatgtcatccaatcatttaaactgcaaaaattacaacttcaacagacaaatttggaaaggaagaagctaggatcttagaaaaagaaaacaaaatgaagacgaaaacctgggatataaattggcatcaggaaactttgggtttgattcctttaaattttaagctgcaagactcaagcttgcgtatctatcttctttcttttccttcactttggaggtaaagaattttgctcctgcaaaaagagactgcctaaggatgaacatgttttaagtgggtgttccaggctttcgaaagggcttgttattttggggacatggttccctcttaatatactgttaaattgaaaaagtgagttctcaatgggaaattttcagacttttcatgtaggtccatatcaacattagaatgaatttttttaggttgggtgcagtggctcacgcctgttaatcccagcactttgggaggatgaggtgggcagatcacttgagcccaggagttaaagaccagcctgggcgacatggtgaaacccccatctctacaaaacacacaaaaattagctgggcacggtagcgtgtgcctatagtcccagctacttggtggggaacagggaattggcgggggtggggggcagaaggggctgaggtgggaggattgcttgagcccaggtcaagactgcactgagctgtgatcatgccactgcactctgccctgggtgacagaacgagaccctcaaaaataaataaataaataaaaatggttaagtaattaatgtttgaatacacctaagagactggtttatttttcaactatttgtatgtgctgattcattgggagttaatttagttcctaaacaaatcaatatattggtctttttctattttagctataggaaattgattattctttgcctccaagaccagacataagtactataggccactaaattacccaatactgttttatgacttggattttattttaaagaactaattttacatccagccttaaccaagcactggctccatatgcttcactttcaagtatatagaaagaaatacccagaagtttctgggagagagatttgtactatatttcagacaaaggaagatatatatcagcagaaaaaaggcaaagctgaatcactaaacattgaagacacatctaggggaataattgagggctgactttctcctaggaatttgcactaaaagaagaataaagaaaaatggagatattatctctagagtggagaggatttgaagaaatcatttcactaatattttacgactaattattttccaggtatactaaaaggtcaaagagattgtttaaggttgtgaaaaatccacaggggtagagttaaattaaaattgtagtgtgagggaattagtccactaaaaaccgtggactaatttttagattggcattccttttgtcaacagcaataaaaagaagtagaagtgacatagaaaaatcagggaatttaagaaaaaaaaattagactacaaactgacttctattaatataattctaatctaagttgataactttctcagctttggccattatttatgaagcaatgtagggaaattatcctgcaaggttttttttctgtggaattttacatttttgtaacagtgcatctaatgctccaaaatgggctatccaggcactgcagaatgtggactataaacgcaaacgtagttaatccatgcccagattggaatataatggaacttgctgttactcccttatttcctgttttctgctttcattttctcttggaaacagttatgggattttgccaagagacagtgagaatgacctgggatggtctgagggatataaggcgtaatgagaaggtgggcttgtagccaggatgccagcaatcagcaaggacacctgcacagccccagaatgccagctctgtctgggtcttctgagatctaattacaaggattcaaggagcactgtgatggatacacagtttgaacagtacgggttcaagttgcacaattaaaatgtttgatatctttgtcctgatggtttcttatatttggcttagttgtattttcagatctcttgatcggctcttatcttttaagaatttggtgagaactactaaactggggccatgcctttttctacatactccaggacttaagagaaactgaagttgggttaaaagcatatcaatgcatgctcactgccctggtgcaaagggagcaatatcatctgttacatgtgagggatctggagtcaggctcacccagattctaaggtagatactcaccttctacctcaggcaaaatatttaactttcccttatctacaaaaaaaggatgacaagaataaaagcatgtatcaactataacagtactattgtgaggattaaattagcagtgtctgaaacagcacatattcagtgtatgtcattttgttgtaatcattatctgaattgtttgcctatatacaaaaatcaaatgctaagtttgtggcctgtttttgttttttcaaaacatattttacatctgtaaactcctgaattataaacctactgtctgctcctatgttccagataagaatggattactactcccaagtgtagactgtcctggattatttgaagacaaggaagaggactgttatctcctgtcctagtactgacaactgcaatttgaccaatgggtccttaaatggacactgctgcagaatgaaataagtctacgaatggcaaggagggaccacagagaacctgcagggaaaacagaaaacatagttttatgttctggcccatgtggaaaagaacaggagtgagagcaggactttaggcaacaactcaaagccagtagcttttccttattgccttatttaagaaaatgtgagattttggcccggcgcagtggctcacaccagtaatcccagcactttgggaggccaaggtgggtggttcacgaggtcaggagatcgagaccaacttggccaacatggtgaaatcctgtctctactaaaaatacaaaaattagctaggtgtggtggcatgcgcctgtagtcccagctactcaggaggctgaggcaggagaatcgcttgaacctgggaggcggaggttgcagtgagctaagatcgcgccactgcactccagcctgggcaacacagcaagactctgtctcaaaaaaaaaaaaaaaaagaaaaaaaacaaagaaagaaaccgggagctttttatgtggtgccaggcacttgaggctctcctagtactcctgctacagggaaggtcttttcaggctgacagccactgtatccagataaggaagagtcatctagcactgaacactctggagccaatcaggatacttgtgtcaagtccagagagtgaatatgctctccctacatgcttcaggctcctgacacacttaggtattcttactaattatgaatcacattcgatctgcatgtagccgagagtgggctggtagaacagctgttgctggaggatttggtgagccacagtagaaagggcatctggcaatacgaaagagaaacagtgtctaacataaaaatagaatgaggcactgtgggggcaggcctaaaaaggggccaatcaagcaaaactggggtatatgcttctcacccagcttaaagggccaagatctctctctgcagcatggttgcagactcttcttcctcatctctggatgaatctccaggaggacccaggcccctcagtttcagcacatttgcccctgctttctcccagatgagaactatgatttttctaatttagacatatgtctgacctagtaatgcaggatgccaggaaggcctgtcttgctttctgtgatatccttgctgacaaggcctgagcagtctgaaaccatctaagagtttttgcagtgctcacatgcatgtcacatggtgccaagagcctagagatgagttgaaaagattcccagatgtgacacttcaggggtaaaaagtctacttgggggttaagtaacattagcaggctcacttctctacctttccttatagtttctggacgcttgcttataatgaacttttctgattatggaggagtgaggaaaacacaggaaagagattgtggcaattctgcaatgggaatggaggggttttaaactatattaatcttcatcaaaatgcactcctttgagctgggatgtgatatgacactgccacttccgacaatgcctcaggacatagttgagtctgtaaagcttctcaggactctgagagtcagattgtcctataatcccccaatagagagatcccctctatctttccaaagttctcatgagaaatcaaggtggcatggtgactgaatgggaacgccatttcagaccacaggaacgaacgtgctaacgatgtgcaggtccccagtgcgacggagaaggggagctcagagtagctagctagctctcatatcatggaagaatgtggtgaagatgaagacactgtgtgcagaggtgtgggggaaagcatagatttcctgcccccatacagagaacatggtgactgtgcagacacaaatccatactttaggccagtttcttggcccatgatttgagtaaaggtcccctcagccctcagggtggacagagtgtggaacagctggaggcccaaacttactttattaagttgcaaacagttttgttcatttactccaatgtgtcttacaaaaatgaccattatctatgcatgacagtttgggaagcactgctgtctctgtctgtagaagacacagtgaaggcacagacattcccaaaccctcggagaacgtggtggaaatacagactgtgacccaccaccatgcacaagcacccagtgataagatgcagacaccaccgcataccgtggagaagaacatggtgaaggtgtagactgcagcttccagcacatatcgactccgaatggccaggaccacaggtggcagaaacatgaggttgctcaggcagagcaggagtgtggacagcagctggaatccataggtgagcgcatctgcactgtcggtgcagccccagcctctccaccctgcgggtggggaaggcacagaatggaagagaacagacggcagctatgggcctacgccacagcttgtggagggtggtctcaccccggctctgccaaacccgtccccaattcaggctgcgcactcccctactcccgccgcctgcccacaggcccagcaggtccacctccagtccaccgcagcccgctccctcgccagcctgctcaccggccttgcactcgcaggctgcgtacagataattgtgtgtgcgcagcagcttgcactggccgtagggcccgcagtcgtccacgcatggggacaggaaggtgcgcatccgcacctcggccgtcgcgttgcggcaccgcacgaacctgcgcacaaactcgcagtcacctggggccccgggccacccccgccaagtcccggtcccagccctggccccgccccgcaccgctcaccgaggccccaccccgcacagggagcggagggccaggaaccaggtccccgtctgcgggaatgggattcgcagcctggcaaccctggtggtggcactgacagagaggaggaagccggccagggactctgaagggagaaggaaggagtcagtgagagggaggaggggtcagaacccaagaaccctcacccacctgctcccacttcccggaaccctagcctatcattcctccattccatccctccccaccttcacctctgcccgccaccaccacccccacactgcagcttcctctcctcccccattcctcacctcacctttggaacaggtcactgctgcatcccccaggctcaagggcacctcgtgagtcaagcatccaaacaccgtcacgttttcctggcgcacggagctctggggagggcaggtatggaagtgaggccgccacatcctccatctccacccaccgccaccctcagactcccacccctgttaacccacaccttccaaggacagcccattcctcccggcgctctccacgccaaagctgctctctcacctccattctcagaacagaaaaactgaaaaacaacagatcctccacagcagaaatctttcaaggactgatgagacggcaaggcccaattttgaatctgttctttgggcagaagtgtttcaattctgtccaagcaagagagaacaccctctttttcagtcctatctagctcattaaggagaaggagggctgttgccagttatagaaactaattgtggacaaaggcaattgtaaggtttcccatcatcttcacctggaccccaagacaggtggagcatgaagacactcactccaactcaggtgaaatgatcctaggtactgaacagtggtaacagaatgcccaagagattaaatgtagcaacctggctgggattaaaagaaaccagatatctgcaagagtaaatgtaaggtgttgtctacaagaataaaggcaacaggatgccataagctcacctcattcaagaaggatttgaggcagcttacataaaatagaatataataaatgcctgagggaaacttaaaaatcaggacaggaaaataaagtctgtccctaaggtaggccatatatttgatactgccttccaagcaaccaaagcaaaggaagtatcatgagttaccagatttgcaactacataatataaaagctaatcagagtctctggagaatcacagcatccaaaggggaagttctgagataaattctcatcaaagcggcactgtgtgttgtcatgcatcctgtcctcagccacaagagtgagtttcatacaacttccttatataacttccttcaatgcaagcccggggcaatatgccaaagtattactcagtgaaagtctttctaggagggagccaaagaaaaaagtatatgcagttctctgatccaaatgtccagttcttgatccaaggggagaaaaaaaaatcaaaatatttggaggaaatacctttcagaataaacagaacaggctgaggtgcttagcacgcgtcatagaatgcagatggatggaatgtaaacagatgctcattaaagtgaatggatgggaatgcagagagggaaagggtgaggggctgcaggagggctaggcttctattctcagggtactgaggaagaaagaacaagtatgcgtaaggctgtcctctaattcagggtctacggtttcaaggtcgaatcaagatctcactgtcattgcccagaggcatggcaataagcaaacacaaaatacatacagtcttagctagaacaaagagagaatttgattatgtaaataagaaatatcttcaggttgaataaatggctctaacaggacgactagaaagttctaagccgtgtcccataaaagaccacatgaagccacagaccaggcctcaggttggctgatgggaaagcggtccctgctctcagggctggaggatagtagagttaaaaggatccctggctcagggaacagctaagctgaagatattctctaatgggccaacatagggctccgccctcatctcagtcttaacgctgacagtaatgactaagaagtacaaaaagttggctttgcaagtgtgtgaattacacaaagtggagaaggcccgagttccaaaccagtattaggcaatacctcaaggagggacataaattcttccattcaggttcaaaaattcactgcaaaaatgcaagatgcgaattggcaccaaaatgtatatgccccttgattacaactagataaacaaagtaattaatgtggaaaagacatgggaggacataaaccaaaaacagctgtgggccaggcacagtggctcacacttgtaaacccaacatgttgggcggccgaggcaggcggatcagttgagtccaggagtttgagaccagcctgggcaacatggtgaaacccagtctctactaaaaatacaaaaaattagctgggtgtggtggtgcactcctgtaatcccagctactctggaggctgaggcacaagaatcacttgaacctgcgaagtggaggttgcagtgagccgagatcacacccctacactccagcctgggcaacagagtgagactccgtctcaaaaaaaaagggttaaacagttgcattagggagatattttcccctattttccaaagtttttatgtgatcctattactcttataataaaaaagtaaatgtatacaactggtttgaagaaaatacaaaggaagtaaagggaaaagacccagggatctcagttcaccacaagccctaggtgatcccacagtgtaatgcagctgctgaaaaaggcaactcaatctcaggcagcacaaatgcaagtcttgttacctggtaccccggtccgaccacctcagatcacttatttcagagacacagtgaccactagaagtatgaccaggtgagatagtgaaggaaggggagagatccaaataccaagacccctaagacactgaggttcttcagcttttgggtggttgcaggtaacatctgaagggctgtaaaaataggactgggatgtaataaatatatcatactaatgtaagatattaataataggggaaaacgtgagagagtgggtatatgagaactttgtgctttctgctcaacctaaaactgctctaaaaaaaattaagtctgttgctttaaaaaagaacaggacagagatagatttactggaaatggcttctggatatggcttttacccactgaatcaaagatgagtgggtaaaaaattcatggagacagattttgatgggatgtcaggaatgcctttggcaatcagcgctatccaaacatgaactgtgtggcctcaagaggtggtaaactccccatcaaaggagatttgcaagaaaaggttaacaactaccgtagtgaaaggccagtaatgagcaggaagtgagcctacaaaactgggaaaccccagacactgagttgacctggttgacccgcccatctgtagcagagtgaatactcaggacatgtttgttgaccagaattgggctgagccatggtccctaattgtcaggatgggtgggagcaacctggacaggcttcctggaggaggtaaacaccccaacacccctgacaccttccccttcaagctccctggcagagcaacctccccactctccataaagagtaccgcattgagctggagctccaggctgaggacgcctccactgtccagcactggcaacagcctcatggcgaacacggctgggcgctcagggggaagggccacacttgggccaaagaagatgtagaagtggacagagaaggtgtccagctcgttgcgcagagtcgggcgcactggccagcagtgctcgggtggggacgtggtcccaggcccctccgcaggggttccaagggatggcggttctgggggcagtggctggttgcccagggactggggcatgttcatggcagctccagggaccagggctcggagcaggccgggctgtgggcactctgtggggcagaggaaaccagagcttgggcctgcagcctttacagtcctgaacttactcataaacacatctgagctagacaggatttcgcaaagagtggggaaggatgagaactagaatgcgatgtcccttgggagtgtggggcatccaggtttataggggtttcctaatggtgacagctaatgcaataccacactggagggaactgaggtcatctatccctccctaaaggcattgaagacactattgaaacagatactaagtatgagaggctgtctcactgacttgcaagggctttggcaaggacagtgtcccagaggtcctggatgtccctgcctaccccaggaaactgagagattaaatcaaagaaagtaatgaggtcctttagttgtctcaagtcagatgcaaaaaaaaaattatctaaaggccttccaataacttggagctccaagtgtgatggcttcagggagcatgaaggagcttgggatggggaggggaggttgtagggatatggcagagggccactgaacacagccacccaagtcacttcccaaccacagatgtctacacagactggggcaaatgcaggggttctgaccttgcaaccgcacacacagctggaagcggatggtcctaccagggccccgggatgatgtttccacacgcacgtagacccagtgcccccaggggggcagtgccagctccagctggcatcctgaggcacctccacaggccacagagcttgagttgtgcaggggtggggctttgggacgcagacgcagtgacagggggcaggcagataccccacggccccccacacacaccagctgtgctgaaaccctgtaagtgaagctgggcacaaagaccctgggcagaggagaggttgggggtaagaaggcacaaacagaggcgagaggaacacagggcaagggaagcactaggaaggagggggcatagggtgggaaggaggcctgttcaggtctcccgctctgtgctgggagggagggaggcagggatcccacccagggaccaggcaggtaggtggagaagccaagagagaaccctgcagcctgtatgaggccacagaagagggaaaggaccaggtgtggggagtctttgacttacttgtacagggctgagcgattgtgtggggagagggtttgctctgagggccggccaggaaccagcacagcgacgtccagcaaacgccggacaatcagctgcggctgaaggaggtactgacactcatcctggagaccctgggacaaaagcaggggtggcaggagagggagagacagcaggggtgtgactaaaccaaggcaaacagaacctgctgggcgggctggggagaaacccccgccccggccaccactcccaggcctctaacccaggtctctctaaattccaggtccttcctgcctgagcagtcatttctggtcatctctgtcccacctcagtctgcaaggtctgctgggatcctcagcactggctgaggttttgggattcaaacccaggccctcctgacaatcaggcctggcttgccccttctcccaatctaacccctccccctgagcattctgggccagcccagcagcactgtgatctccaaccagcccattccctgagcaggctcaggaacttagaacactggctcttttaggcaaagtggggtggagtggaaagctctttcaaggcctccaatccagccccctcactctccccgccaccaatctcaacctttaatttcctttagtcctcaccctgccccgctcccacgtgcttgtccagcctctgctttcacactcattacacccaggtaatgagcggccctacacaggtaatgagtgcagggccactcattacttcccaggcaacctccagactataagcagcttgagaacaggaaccctgtcctatttgatgtttgttcctccagacacagggcctcacatagagtgcatacctcacagatgaatgtttgctgaattaatcaatcagtaaatggatcatcccacctgggggaagcgctgaccttgctaaagccaaatcctgtcatctttgatgcccctgccccaactctgccttcaagggacccactgatccgtctggtccctcagcctcagactgtgtttcttctgctgctaaaggagatcaaccacgtctcccccagcttctcttctggagaaaatccccagctccttctctgttgacaccccatggctcgcagagcctcatcactctccagtaagctcagtcccatttgtcgcagttcctcttctgcagcacgtgcagctatatgagccctacagacctcacagttaaggggaggtgggggctcctaattaggacataccttcaaactctgttctgggacaaaagttccaggccctgacatcccactgagttccatggctcagaacaagccagccaaggcactgacttccagcaaagctccaaaaggctggaaggtctgtgccttttgcatccccagtgtctagcacaccacctggcacacactaggtgctaaaatagctgttaaagaatgggtgtcaaaaagggggtcccttcagagagctcctgaaccaacctagatgctcaggtttggtgtcaaacccgaagaaccaaaagactctcataagtcactgcactgaccccacctcctatggcaagaatcaccaccacaataatcttgtagtgaatgagtcccaagggtgggggctcatgctccagtggtggcccatttccttgctagacagtccagggaaggaacactttgctccacgttttggagttttacttgcgtttgattcaatgaaagatcagtggacatgacctgtttggttaagacgtgctccttccttcaactgtgtaacgtgcacagccagtcccccctcttcatgcagagggagtgtttagtcagtggagaccagggaagatgcagggaaccgtcacccagtgatgggaccagagaaagagcaccggaagtcaggtcctcaagagctgccagggcagacaccaggtgagagagtcccagctgagccaagaggccagaagaacatcagcagtcggggaggcccagggcacaggcaaggaagctcaagaaactaggagaggcaaaagtgagatgtggatgggctacaggctgaaagatcctggagtctaaggcatggtagatagattcctacaatgtcctcgtatgtatgggctgggtttcttcagaaaggcctgagtgggctggccagtgccaggctctgggtggggcttgcagactgaagatgcccaaagacacttagccttctctgcgggaatagcaagtgcacagctgagcccatgcccagaggcagaaagcaccaatcagtgtagaagcaaacgagtgctggacagatttcagggggcaagggtgaaagcaggaagaccacttatgaggctactgtggtagccctggagaaagcagagaagctgtgctagaagtggaaatgaagagctggagaagccttcagggcatgcctcagaagtagcgtcaacaagactttttctttacgattgcttgtgaggaataaggagacaagaaaaatcaaggatttggggcatttaatttggggcttgagcaatgggtggatgacagtacaatttcctgaggaagatcacaatgactagagaaagaagcatggactgggagcagtgaaatggaaattaaagagttttatacttttagcttcactttgatttgattttactaaatactgtatgagacatttcttagacatccagttggagatgtcaagtaagcagtgggatatagtctgagattcaaagaaattaggactggctgaatactcgtggaagcattaacatatagatggtattttaaattattgtgctggaacaccaagcaagagaatagaaaagtgaaaaaggaattgttcgaggaccaagcattgggccactacaacctggagatcaagcagaggagaggccaggaaaggagacagaggagtgggcagtgggaaaaccaggacagttctgtaaagtcacagaggccaagaagggaaggtgtttcaaaaagaaaagagtaatataggggactagttaacagctagttactagttaactctggggcggggaattggagactggaagaatggaagaggaaaacttactttccactgtatatcttttgtaccttttgaatgttgtaccaggtgcatggattgcctattcaaaaaataaataaactaatgtaggaggaggaaaagcagctgcactattagcagattctaaccacctcagctgagatattgagtcacgtgtggtcctagtcggtggattcaacagaatcctttctcctgtacagtcgacttcttcactttcctcgtagttgctttcattattttacctactttttcaaatcttagacacaggaagaggaaggatgagaacctgcactctagacatttgggagtactttcccctcatgagccatttgggtgccaaatggtatccacaacccaaaggccagccccccagagcagactggcaactgggcaccttagaatgaacacacgatccaaaacaggaaaggcaaggagatggaggccggggacaagacagagtggctgataggaagaaagggacaaggaaaggacgtgaaaaggcatcatgtgccagactctgcactggaggctaggaatacgtagtaaataacacagacacagggtctggcagaagtgtgggactagagttcacgagggtggcccggaccaggtaagtcacttcttttttacaacctttcagggctccctatcacgctcaggatacagttcaaatgtcaaggcccttcgtgatctggcctctgctcaaccctctaccttcctcaccaccccaacaccagcccacactgagccacttcagttccttctaaactttgggccatgctactcccaccacctggaatgcccttccctgccttctcaacctcagacctcaccgcttaacagtttccaataccacctccaccacgctagcaagctgagttagccatctcccctttatcctcctaaaacatttcctatatccgacatgcatcttatttttctctgtgtccccagcacacaacccaaggcctggcacaaagcaggtactaaaggactaaggctaaagggagatctgagctcatccccaaagctgagaaggaccctagaaacacactgccttcttatcgctgggactcttcagttcccaccaaaggataaccctaaacccacataaattcctgtgttcaagccttacaggaagcatgccatagtaggggaaggaaacaagttgagaagatggaggaatgctctagacaattaacccacaggctggaatcctggaaattaaccaggatctggagagctgaagaaccctttgaggaccatataagactacagaagttaatctaattcttagaaggaccagacccaagatccttgccccatcaacctctcaaacagggctgatggaagcactacatctctcacggcgtccagacccactgccactcgtgggcacggtgggatggtcctcttctgtctagcctcaccacacacctggggaagctctgaccagggttccagtttggtaccaagttccccaggccccgcttcccatgtctagatgcaaatgcacatgtcagacctagttatttcctcactgcccagctcccccttggtctgggcacttgaatcaccctttagggtctgagcagcttttctctgcactactatctctattccccattgtcccaatctggtagccataagcaatcctgaccacttctaactgggcctcagctcccacaatcccagcccaggcctaggccctaggttcctgctcacctagaaaggtttttggataactagagccaggcttcaggaggattttccctgtcagttcttacaaagtgggtcaaggatcagagttgggataaagaacatccctgttgggattttgccaaagacctacgaaggcattccttctaacagaagaaccctcagttctgatgagagtcaaggcctacctagaacctagggccctttccaagctagctcccaacatgctgtccttcagcaggctcacaggccttgatagggagttctcttgcacatccacatcactctcaggaaaaacggccctgtcactgaggcctagagacactacctcagccctacttcccatctctgacaatagcagtgccagcacccttgtccttatgtgagtctcagctcattcaaaggcactattcaccccatttctgagtgctaagagtcctcttctttaaatcctcactctgttcttgctcgtttcttcaccctcaccacaggccccatgcacgtggccatcccactctgacaacagccagctcagcacaccccctgcttctcctccagtgaacaggaataggagacctgtctggcctaatccatgagagtggcaggaaaacattgcagcatttccttccactccaaaccagagagacatctgacctttgaacctgcccttcagtctttaacaacctctgtgaaataagtgcttggggtggctgatatttggagaaaagtgaggcaaaggccaggatggacactagctgcccaaagcctccttttagcaggaaagagcttctcttgtggtcttctgaaaggtgtaggaagctgtctgaaattatgatgcaagaggaatacattctcccagatggactaaatactgggccgtggcctaagagagtcttcagggctattgtcaatcaagatgtaaaataaaaccagtcctgggtgtgtgcagcagattggaccagcccatagctggcttctgttcaccttgattaacatttgtgccttccactaggaggcggcactactcccctgtgccagagcctctgactccagattctcaactttcccttcagcttacctggacccagcatgtcctcctggggctgccaagttgcctcctccagatcatggcctctgacccactgggtgacctgctggcctttagccatgccccgccccagccacccttgtgctgctgcccaccctgacacaaggctggtgtgccagagagcctgtggggggaattcagcagagatggaagggcagttctggacccccgagcctgggcaacatcaacccaccttgacagagatgtggccgtgggcctggggaaggtgggcagccaagaaccagtccccaggtaaggggctgctgacgttaaagatgcctgaggtgcggttgggcagtgtccagctgagggtcagtgagaaaaccccaggcacagctgtgtcccctgggaagtgtgtatgcaggggattgatgacagggggtgccccggaccggaaatacctgggggaccagaattaggagaggaggaaagcagacaatggggtgggaggcaggaaatgaaagaaagaaagaaaagaactgtcactcttcaccgataaaacaaatagattccctatactgacacattcaacaaagtggttccaggtcaggggccacaggtgagagatcagctcaagcacttgcacagtcatacagtagtccggaagtggtcatgtgacagaggtcatggccctcactcagtcacacttcaatctggacgcgggttggggtcagggtcgggaggtcagttaaagtcacactttagtctggaaagtggtcagggattggaagtggggttgggaaattaactcagacactcacacagtcacactttggtctgggcagtggtccccaaaagttcccccttgctccttgaagatgatgaggttccaaacagccaggaatgtgtcctcaggaacatggaagtggaagagctcggtgctggcaaaggagcggaaaggactcagcttgcggggtgagcaggtggagtaatcagtcaggaaaaggcctcctgggaagcaggagagagagaaaggagcagggcaggacagagggcatttccattaagcaacaggcatgccagtcttcctcaccaatagcatcaactccacaaatgctctcctctgagccaggaactgggtttcaggctgcagatctgaaacctagccatcatctggtttaatccttacgttaatcttatttaaaaaaaaacaaaaacaaaaacaaaaaaaccctccttttacagataaggaaactgaggctcaaacctagaccaaactgaggatgcaaacctagctctctctaaatccaaaactaagaccctttgacttcacagctgcctcctcacttaggagccattttctccacttaccaaacctaaaaaaaacagatgtgtggaaggtgtgtgtgtgtgtgtgtgtgtgtgtgtgtgtgtgtgtgtattttggcatggcgtcttaagccactgagcaggctgaaactccacctgtggggcttgggagtcagcatggaactgtgtaacttccttgttgattttcttcccctttctgttcccctgtggttaggagcagtaaaaaccctcagcagcctcacaagcgctgcctgtatactggctcagggcaggagaggggaggggaaagtgtggtacggctgccaggggcctgcttgggtggcaaaagcaaggacaggagctggcaggccaccatgagagtccccaggaaaggagagtcatcaggcctcccaggtcagaatgcacagctagtaggtgggggccgggggaatgttcccccaaagggaagcccagtgaggcagtgagttagtgacccagtggatttcaagccccttgggaatattcagagcaggccgagttgggaggtggggaggaagtggtcatccctcattaaaatgccaagatacctgatcatgattgtcaggagcagagccaaggtgagcagaagttgtgtcagcagctagccaggcaagggactagaatagctgtcacagtggaggcaaccagtagcagacaggggaagagggtcccaaatggcaggcaaggtctctcaaagtaaacctctagggaatctgactgctctggagacttcggaccagccagaaaagaagcccaagatgacacctccaggacaggtgagaaggtggggaactcagcagcttcaggacagacccggggctggaataaggactactctggaggggcattttcagccaagcaggaaataccctcagggctaacctagtccaatcatctccctctctggagatgggagagattaactccaaaaatgaggtgtttttgaaataacaaagaaagggaaggggaggctgctgaaggacgaacactgaaccagagcaaccccaggagtcaccccagagagctgccctacataggtgggggccattggaggccacggttacactcaaggactagtctgtccagttcagaccacatgatcagtctcaactgtcaggaaggaaaacctgtcaccttgcaagctgagcactgcctaggaacccagagaggctaccagtgcagcattcagagagtgatagagatgcagccgagagggataaagggaaatgggaccgactgatggaagagacgggtttcctaggaaccctagctgtgctaagtaggaggcagaaggctaagaggtgaacagcctggatactattgttagaagaaatcagaactctagcgcaccttctgctggggttagggaagggctgatcctcctcaaagctggtaccagggatgggtcatctgatcaaccattgctaccgttaggagaaatgttggtcagtccctcggtgcagaccctcagatgagggctagtggtgaaaagcagtttaatgacctttgggaaacatggacagacaagcacaaagatccttgtaattcaaaggatcacagtatggcctggggaactggggaactagctaagccatccccacagtggccaggggctacagaggtcacagaataggccagtgagataaaggagtgagcagcagctgggaatgctaggaggaacttggaagaagttctgagggcagatgcttgagaaagggtccacagccccattcactccaaactttggtttgcggtttgaacagggcctaccagagctgtgtccagaagaagcatgagtaaggcccttaccgagttcagatgaacttattccaggttccccaatatttctatgatgaagctagggtaattccgaccatcacccaccccatacacacatacacatacacacacacacacacacacacacacacacacccctacacctacacacataggctgaggctggccctgctagtaatagcactaggtagaataaaagcccatttttttttgaatagcaaggcacgtgtgagtcctcaactaagcccaaggaaaagatccaaggatcaggagtgggaccactagacccaagagataacttccattcctgaaatgaaaccgaagcaaccaataagcactgtgcagccctgtgccatgatggtcctatgacactgccagcctctcctcagacaaaacccatcaccaccattaggtcacagagcaccctgtactttggtccaaaattgccaaggcattcattattaacagcactaaaggcagccctgcctccatttgggtgtattggtactcttttccaacttcattacaattctccccaaagcacctgaacctgcttctgggcaacagtgtttttatccacaactttcagctgtatatgctctgtggctgtcggtcaccctgctcccctcaccagcccaatgcttgctcaatgggcacatgaagaagccatgatggcagaggatggaagctaggaacttggcccaacagcataaacttccccttaccaaaactgaaaacctgactggctactgcctctgcccagtgtccaatttgccagcagcagtaatcaacacagagtgcctccacagctccttccttcaaaggcactggctggggatggatggataacttatattcgttatgggaggcatgcaacactgccctcacccttggaactgctgagaaagggtctccagccccattcacagcttcagtgatctgtccatatgaggaggaggcagagctgaagaggaatgtacatgggccacaacatgtcccctccccttcataccataacacaggcgctcagaagatacactggctcacatgcaccccacacacatgcacgtgtctacacttaacaacacacaagcatgtacacatgctgccagcctccccacaatccctcagttacacacatacacataagtgaccagacatctctgcaggggttgtgacctttcacgtgcattcgtctccttaagtttgtacactgaaccaggcccccagagctcactgatacccattctccaccccccagctgttctgttggctgttatttccaaagactccatcaggcacatctccatcctatctagagtgacacccaccagaggtggctacagacttgggccatgaagactacagtcactccatgatggagccatcttcatggcacatcccctagaccaggacaccccctcctcctcccacattccaaccattaaaaaattggacctctctctcttctgtccaagtcacttccccaccggagggtggcccttggctgacgcctggcaaataaggaacagtttgtggataaagcacccttgtgggcagaccggggagaagggaggttatgctttgagcctttccccacttgggtctatttttctattaagtatacattgcagtggataaaaaaaaacacactagtatgaaataggaattaggaaaccttttttctagccccagcacactgccattcacaagctctctgactttggacaaattgctccctccctgagcctcagtttccccatctgtaaaatagcctccgagtttcagccctgctctaaaagtatcaggaattattcctaggcaaatcaatcttctttggaacaagaatcattacaagaagaaaactcattataatggcaactaatccatattcatctatttgctacatattatctttaaaactcttcttcatgccgtttgaatgcatgcccaatatctcaaaggtttgggctatatattcccacactacactaggggcttctggtgtgggactgtctctcccccatcaaactttgtgagcaggagcaaagcccacaacatttccctggaaaagcaagagtcaaagtggggtcaggacagacaccagaaaaaatcttggagtctctgtgctagaaactgtaagccacctgctgagcctcaaacccaattaattaccactcttttgaccctgccaatccctgttgtgtaagacctctctactctctatttctcccacttgctccccaatgatctagttccccaggtcccacctctcctgaatctctccagcccacccctccctgccggaaccccattcctgcctcaatcttccctgcttctgcactcaccagcccctgggccaaggacagagaacagcaacagcagcaatagggctggcggcagctgaaacccagacttgagtctaggctgggagaggggcagagtatgagagataggggggactagagggagagacttgggtaaacacagagatgagggcaaaggctgagataatgggttgggctgggctggacactggggcttgaacaagggcagggagtgggatggaaggaagggctgtgatggggactgcagcaagggacggggttgagccagggccttaagcaaacactgggaatggggctgggacagggcctgggctgggatttgtgacagggggtggaacgagggccgaggccgggatgggggccaggccaggggcagagactggaagggggtcctggatggggacccaggcaggggctggggccgatgtgggaagcggggcgagggcggggctgggggccaaggcggggattgggataggacgaggggccgggacaagggctgggccatggcccggggcgggggcggggccggacaggccagcgcggggcgctcgcagagctggcccgcggctccgctccccacccccggggggtggcctccggtgtcctcgcgggcccggggcgggggccggggacctgggtaggagttcaggcctgggcgactccgggctgcgctgaaccggcgataaccaggccccgcggcggcggcctcgacttgacgtcggcgtgacgccccgccccccggccggctcgattggtccctgtcagtaaagcccgcccccgccctactctattggtccccaacttagtcctgctgggcttcgaggacacacagactccgcccccgcctcagctacccgagaccctgcctttctcaccccaagcacagagcccgaggtcccctcagatcctcacagcccccaacgaccgccccacagatgtctcaaaggaaccctatcctcacaatcccagactcccccggacgtacgcacagatctccgcagatcctacccaaacactcgctcacagagatcccgcaacacacaccccacttttcagaagtaaaccctctgggctcgccccctcgaggcccaatgcaagcccctcaggagaccttacccaccggggaggtgaccagaccgccgttgccacggagactactaggcgttccggttgccctggtgaccggcgcctactctcctggcccgggttccggaggcttcagtcaagaccctccctcattggccctagaccccttgtccctacccacttccccaggtcatgccagagctcctttgcgaagttctgcagatatccaagtccccttcccagatagcagactttcaggcaaggcatttcaacactcagcacctgcagctgaggcacatccacaaccaagagcctttcctccctgaggatcaacacctccccctgccatcctaagtcaaggtcttgacctaaggacttgtaacaaccaagccaaagcccagagggtaggtggtttctccaacggcccttgccctcttccctcaaagacatctgtctttctcccacccctcagtcccttcacattgttgtagtagtagtagtagtagtagtagtagtagtagtagtagtagtagttgttgttgttgttgttgttgttgttgttgttgttgttgtttgagacagagtctcgctctgtcccccaggctggagtgcagtggtgcgatctgggctcactgcaacctccgcctcccaggttcaagtgatttgcttgcttcagcctccccagtagctgggactacaggcgcctgccaccatgcccagctaatttttgtatttttagtagagactgggtttcaccatgttggccaggctggtctcgaactcctgacctcaagtgatccacccgccttggcctcccaaattctgggattactggcatgagccaccatgcctggcccacattctgtacttttcatccttactctcctcctccacccaatttcctcctccccttctctttccccttcctcacctcccatcttctggttctccactcttaggccccttttctctctagctgactctggtcatcttcctccctgtaatcctacctctgcccctaattcccttcccaaacatccccttcaaaaaggctctgatgcatttaaggagtgatatatctagcgtctctggaacatgggggtaaagtagggagcacggaaagttaaggcaggaatcctcaggctgtgttgaaaatgatgacaggccttgaatgccagggccaagaaatttggacttaatcctttagactgagtcatggaatgtttttaagccacaaagtgccagttgttgggcttgcactttagaaagatcctgattgggtcaggaaggaggactacatccttgcaggataaattaggtatatccccctccccaccgtatcctagactcaccccagaacaacatcaatttatttgtattgccattgttggttaatcggtctctctcctagactcaactcaatctagagcttagcacagcgggtcagtaaaagcatcagattaggctcattgtaaaagtataagttacataaatccatgaaagaatgggtgaatggattaaaatgctgtggatggaagtagaggggcaaagttattacacaaaggctgaagatgatgagaacttgaataaaattggaagggagaggagagaatgcatttggggaatatttagaagataggaaatagagttattggtgcctatttgaagatggagtctaagggaaaaggaaaagactaggataattcccaaagttcagttttgctgtctgtggaaacactcagttagaaatgaccagcaggggccaagcacggtggctcactcctgtaatctcagcactttgggaggccaagcagggcagatcacctgaggtcaggagttcaagaccagcctgaccaacatggtgaaaccccgtctctactaaaaatataaaacttagccgggcatggtggcacacgcctgtaattccagctacttgggaggctgaggcaggagaatcacttgaacccgggaggcggaggttgcagtgaaccgagattgcgccactgcactccagtctgggcaacagagcgagactccatcacaaaaagagaagagaagagaaggccagcaggcaggtgggtatgagtgtgaagtacagaggttgaaaaaggtctgagctagaaatgtgaatttaggagtcattggtacacaactggaagtagttaaagctttgaacatgaatgacatcattaagggaggaggatgtgtgtggtgcctagacaaaaccaggctgcgtgcagtgtcttgccttatgtgacagcattcccctgcactctcaggagccaaccccaactttggcttggtattgccagtctctagaactccatggtctgacctccagggttttaagatatgccaaggaccctgctcttggactgcccaagtggtgttgttcagactccctcctgggacatggttctctgctaccatctactgatgggattcgaactacttcagtctttcaatctttaagttccagctccctaacaagccacagcagcatgccatatgaggtctggacacatgggtgaaccttttggcatcacactctaggacccagagttcatgttgtttccctcttatatctcagctgcactgatatccttatccaaattccataatgcactgcgaaccctgggctctgccctgacttgccggccctctatttccaacctaatgaagcctgtaccctgttctaccactagatggaagcacatgagatcatagaagagcctcatatcaccatggatgcagagaagcaccccccttcaaaggacccctctgctgaggacttacaggagaaccatatctctgaaagcttcttgaagccttccacctctgagaccccgttagagccccatacctctgaatcccctttggtgccatccccttcccagatccccttagaggcccattcccctgaaacccatcaggagccttccatctctgagactccttcagagacccctacctatgaggcttcattggatagtcccatctcagtggtgccagagaaacaccttactcttcctccccaatcacgagactatgtctgtctgtcttcttctgatactctgaaggaagacctctcctctgagtcttcttccaatgaggtcccatggacaaggaggtctacccatctctctgaatctgagagccttccagaacactgtctttcaggcccttcatcccaggtccaagtggacacaaccgaaaagcaggaggaagaagcaggagaggttgaaaagggagtagatgccagtgacagcactgctcacacagcccaacctggacaccaactaggcaagaagaagaagaagaaaggagttagctgtaattgtacctgtcctctcccctgtcctgttctcactactattcactgtccttgacttgccccaggaggaggagactgggttactcttggacatggccccttctcttagttttagggccttctcacttccccctggttactcatcctctcccatcctaggtaacacagcccgcccagtgttccctgctaggcagacagagctggtggaagtggctaaggcaatgcatagagaggagtttggtgctcaagtgaacaatcttttccagtgggagaaggatgcagccctgaatgccatccagacaggtgagcccatgtggcctttcagaggcctgtgacaggcccatgggcatcctctaatccaaaagatctgggaacctgaacattcagcagatagcttccccttttggaaatggctataccacctgcctggaaaaggagcaggcaagtgggccaaggaatacaagggtggatgcagacaaaaagtggggagattcatataaagcccaggtagagacaggtagctgaactaaaattattaaacacagaagggtcggctgggcgcggtggctcacgcctgtaatcccagcactttgggaggccgagatgggcggatcacgaggtcaggagatcgagactgtcctgggtaacacgatgaaaccccgtctctactgaaaatacaaaaaattagccgggcgtggtggcaggtgcctgtagtcccagctactcgggaggctgaggcaggagaatggcgtgaacccgggaggtggagcttgcagtgagccgagattgcgccactgcactccagcctgggcaacagagcgagactccgtctcaaaaaaaaaaaaaaaccaaaaaacaaaaaacaaaaaaaaacagaagggtcatggcccaccccagatatagggcccagagagcctacagaccctaaagcagagatggcccaggaccctggacagtccccaggagacttgctgttctgacatgacaaagaccttagtccctttggtggaactccattaaaaggctgtcacccctgcatgccaggcccatgctgggtacccaaaagctttgagttctgttaccaaaggggagacctgtgtcctctggccctgctgtttccaagcctcagcctgtgattagtactcttgacagtcctgttagtggcatgctgcgtacagatgaacttgcaaaaacatgccatcctatgcatgagcatgcctacctgtgttatggaaattcatgtctatagggattaccttcagtaagagggccaccctgacctgctataaggattctggtctttctagactgaattcaatagatgttatgacatttattttggtccttcatacttcctttccctttatgatgggaatagagctacgatgacaggcctaaaacataaagacaagcaggtaattctaaatgcttatccctcctccatgaaatttactttcccctttcccatgcagggaccctccacctccccacccttgccctcccgccccaccaccaactttgtttgcttatgttaacatattcggttactcttattttcttgcaaattctggctggcaaggtggctcacatctgtaatcccaaaactttgggaggctgaggcaggaggatcacttaattgcccaggagttagacagtgaggacaagacagtgagaccctatctctacaaaaataaaataaaataatccagacatagtggtgcacacctgtggccccagctacttagtaggctgaggtgggcagattacttgagcccaggaggtcaaggctgcagtgagccgtgattgtgccagtgtattccagcctgggtgacagaatgtctcaaaaaaaaaaatgcaggatgtgttcagtcctcttattcccctactcagaacctcctgtctactccctactcctcaagcccactgtatttctttttcttcttcaaattgaacttcttcatcttcctgtttaaacaggaagttttataaagaaattcatgtcattcaaccccgaacaattatatttgaggtcccctcctaatagtggggatgttgagtcctgggtagtccataacagtatatgtgatgtgtacagaaatatcaagtgtaacctttgtttttattcattcgacaaacatttattgagcaccaactatgtgccaggcattgagctagctatggaagtggtaatgctgatgggggttcaaagacaaaatacttggcactctaatgagagataccaataagtacaaggacaattataattcactctaataattgctataatcaaggttatcctagactgctgcatgagcagaaaaaaaaggggcatcttatctggagtgcttgaggaatagtaagccttggaaggaatgacttctcagctgatatctgtaagatgagtaagaagaggtggccaagtaaagagtgctgtaagatgagacatgacagggcaaggcacagcaggaatctatagcaatgcactatgcctgatgcatagagtggtggggagaagagcccactctgctctagaagggcagaattgtgcaggaatttctgtgccaagttaaaagctagaattatatcctgagggcaactgagagtcactagaaggttttaagtaggacaataacatgaacgaatttctgtttctgcaagatcactctggcaatagggtagactggagaaagacaagactggagttgtgaggctaagagaggaggtatggaaaggcaagtgaatacattgtgaggcactggtcataaccaggaaagaagtagatgggcttaggtggagagaagtggacaggttcaagaaatgctaacaggccgagcgcagcggctaccacctgtaatcccagcactttgggaggccaaggggtggatcacctgaggctaggagctcgagaccagcctggacaacatggtgaaaccccgtctctattaaaaatacaaaaaattagccgggtgtggtggcggacacctgtaatcccagctacttgggaggctgaggcaggagaattgcttgaacccaggaggtggaggttgcagtgagccgaggttgcaccactgcactccagcctaggcaacagagcgagactctgtcaaaaaagaaagaaaagaaacaagaaaagtagggaaaagaaaagaaaagctaacaaagtgaaactgaccattggaacagtggatgtataggataagagagagggaaatgcctggagtgccaccagtttttggcataagtaagtggtaggataatggtgccattaactgaatgcctagaaaagggtagatgcttggtaggcatgtgttggatgaacagaggacaaaggatgagagccaggtttggagggaataattgggcataagacatttgaagtgcttatgaaacatgctggcccaagagtctagtagacagctggctatatgggtctgaagctcaggagagagggctaggctggagacattgttcctgtaaagacagccatgtgttttatggagacatactatgcataaagagatgtcatcatgcaaatgtgattatgtgattgtggaactggactgtgttagacagaatcaaaatggcatcccaaataatgtctcctcccccgccaggccttgtccacccacaacaggaagggagtttggaatcaggacagagagtagagggtcccactggaatccacagccaccttccaattgtcccactttaagagcactaacacttgtaacagaatctgaagtatagttgccagtctccctgttcaaactccagtcttcttcatctgaatgctgggcactgattcctacactagtgcttggacttgactgccccccggccctccgagcaggccttgatctttgggcctcacctcctgcttttttaatgtatcctgctactccagacagaattcggaactcctctagtggaatcctggctcccgcccacctgcattgtgactgcctataccttgctctctcaacaaagcctccctggtgtaagggggcactggcactacaggcaatcagcatcaagacagaagaagcaaagccaaaagccacatctagacaggctttagatcctgacagactatgggtaagacaagaaaacttaatctgaggcacggaattgtgaattgtggccctgaccacagtcaaagaccagatgatgccactctccttattcatgttatggaacctcagggttatgcctgaatactggctctctcttcctcttgaaggaatgagctcaattgtttaatcaggcaatctacgttctctcagcaaccattttgtgccaggccttgtgctaggatgagagatacgggtgaaaagacagctcccttgaagaactcatggactaataggaatacaagggaatgatctattataatgcagtgtactgcaacaggagtagcacaaggagctatggatggcaataggaggggcccagacagacaggggaagtcagggacacctttttggtggaggtgacatttcagttgagcctttaattgggactaagaatcctacacctggcagtcccactgcatggggcctcatacaggattcttggctagaagttggggtactctcagttctcatggagaatgagaaaatctgaattggaggtgccatctggttatcctccctcagttgcacagcaccaccctcacctcaagactagtcacgaagccagggattcagacctcactgctgaacaccagctctcgagggttgtgacctcttgctggtgcctactctcagggacacttcttagcctcactttcctttccacgcctccttgcttagcctcaaaatatataatttttggtcttcaccactcatgactgctacctacccctttctcctgacccttgaagaacctttggcagcccttcttaggtacacagagagcattggtacaatagcaccaggaacacagagggaggtattaaggtaccaacgtggagacgtgagaggaagccctcctcctaccttccagcaccagagctatccaacctccttctcctcttcaggaccttcaataaatatgctccttaggagccaatcccattgtctgtacatctggccaatcatcttccctttccctcaccttagacacttcaagaaaacaaagcaaagttgggctttagtgggatgaggagaggagatgagaatccctgtggtcacagagaactcagtgagattcatgttcatcctcaaacaaaatttcatctataatcttcctgctcagaaaccactctcttgagtcatctctggcaggctgacaaagatggagtagatcctgggtaggaagagaactgaagacacttctggggtaatgagaaaaccctgaggaaaaagaaaatctaaggggtagaggtgaggacttccaggtggagataaagatacctgggggtggggagaggtaagttccccccaccccctcacctccatcaagggataggtaagaacacttcgggggagcttagaatttttttacttctcacttttaatcctgcatacctaggtctctacattggctggcgctgcccccattacctatgggactgtttccggattggggatgagtccagatgcttttgtggacacttgttgagagagcaccggatcatctcaggtaggggagaactgaccagcccctctcgagtgtggaggaataactgtactctgtcatgtcttgggaagtatgagagagagcatgtggctgggcacggtggctcacccctgtaatcccagcactttgggaggcggaggcgggtggatcaaaggtcaggagatcgagaccatcctggctaacacagtgaaacaccgtctctactaaaaaataaataaataaatacaaaaaatttagccaggcatggtggcacgcacctgtagtcccagctactcaggaggctgaggcaggagagtcacttgaagccaggaggcggaagttgcagtgaactgagatcatgccactgcactccagcctgggcgacagagcaaaactccatctcaaaaaaaaaaaaagcatgtctgcgtgcatagggggtggtggggatggaggatggggttggcatgagaaggcaaggtcctatcagattaaccctaccatccatccccaatcccacagacatatcggtgccctgcaaggtaagccagtgccgctgcttcatgttctgctttatcccatcacgcccagaggaggtgggtgagttctggctcaagagacgggccacctttgaccccaaggcctggagggcccaatgtcgctgcaaacacagccacgaagaacatgcagccactgggccccatccctgcaggcatcatggtaacttctagggcaagaggtgtattgggagcagggtaggtggggataggatgcaatctggggataatgatggagagcaggtatgagagccttgggcatgcggtcactgaggaagagatgagaatgtggtcagctcctggggataccaccatttcctaaactcttcttggctgcacttttgccccaggctgttgctgcggctgttttgagtctaatttcctctgtgcggcctgtgaccggcgctgggaggaacacgagactttctttgacacccagaagacccggcaacgaggaggaaggcctcgcggtgaggcagaaacctgggacagggggccattccagggtctgtagtcagaaggccaggcaggaaggcactcccatcctcaaccatcccttccaggactagcgcgctccctcagcccacctccccaccacccacctacctgcatcccacatctgcactggttttcacccccaggagcagactatgtaccttttgcagagatggctgtgctccgagaagccatcctcagcaactctgacttctaggccctgcagatacaggggccctctggccttcccagctcccaccctagtcccccggggctccctggttcacacggtctccagcctggcctcccttctgacccccatacctgaccctttcacctctgctctttcttcctccagggacagacactgtcagcaactggcacaggcctttgtgagtctggcccagatcagcaataaaagaggagtcattggaacctgacttggctctatatggggcaggtagatcccagcccagggagagactgcctaataacttagagttgacacctattagacacaggagaaagcctggatctggccatctgcctccatcacactcacattcaagctgcctgttgaaggaaagtggcttcaaggaagtcaagaagggaggaagtttcaagaaggatagagtgggaagtgatgttagatgcagttggggcaccaataagataaagactgaaaagtgtccattgggttttgcaattagaagatctttgggaacatcggagagtgcagtttcacactggtgcagtggaggcaggagtcaaacagcagtgagtttcaaggagtctcttaaagaagcttggatgaaaagtacaaaagtaaagtcagacaatatccagagggagttgtggagtcaaggaagtacttttgtaggaaggaaaaggggaagaggccagtagactaaaggaccttgaaggacccagaagagagagaagagatgcctggtgagacaagatcccagagatggaggaaagggatgaggtcaaagcagaggtgaagggattttctctggacaggagaaacaccacttcctatgaccaagacgaaggaagaggatggagccttcctagagtttcagggaacaagaacctgtggaagttcccctctgatggcttctatatgccctgtgaagtaggagataaggccaatggctggggtccaggggaagagggataagagtagggagcaggagacaagaagagaaaggggaaggtttgggaaggctaatgtagggaactggagaaaaacctcatcagtgggtagttcaggattcgggcacagttggaagtgagaacctagttagagaagcagagaatccaaatatttaatgggttgatgatgtgagggtgtcagggaggaagatcaggaaaactaagcaaaagaaggcatgaggatgtgaagggagcatacagcaccaatagggaaagaaagtgatgccaggaggcaaatgacagattgaaaaagggagcagtcaaaggaagagaagtctctaatgaggtacagtagcagacgtaggggcaggggttggagtacaagagacagtgttcagaggctgcagagcataacatctttcagatgagggcaagtgaaggtgataagtgcttgaagtagagaaaactgtgggccaaggatcaaaatcagtgaatgtgggaagtcacaagggagtccataggttcttatgggagtaggagattccagcactaatgggctctgtgaacccaggcaagtcactgtccctctttaggctgagtttctggacctgtaaaacaggaataacctctgtgttgcctactttctatgagaaccaaagaaataactaatttcaaagtgctttgtatccacctatcctccagactggcttccttcctcttcctagatcccagatccacttatctctcgcccttctccagggcaactctagggtctcccagtgtcccagaggcaccacagagaactgcagcctctggggcccagagaagaggccattctacatttcctcacaattaggggggccatctgttcctccaagggaaggaatgcaatctggactgctaggatccctggggaaaatcacagaatcaaatgtctgccctttagaggagaaaggattttctaacaataatatagctatacaaaagagattgttatatctctagaagcaaagttccccaacagtggttatatgccccatgataaccattcacctaaaactaattcaactaatagtcaacaatagagttaggattactatgataaactcattgaaggaaataataagcagccaatacaaactatatttacgtagactgtaaaaatatgaaaaattgattacacatgggttagtatcatatgcaatacatattacatattatgaaaaaaagacaggaaacaccaaatgttattcattcaacaattactgaccacctatatgtatcaggtcatgtgtttaaaaaaaaaaaaaagaaaaaaagaaaaaccaaagaaacagtggtaacttgtcctatgtgatatcagactaaaacttacctagcgtctgagaatattagtattttgtgaccccacgtttcttatgtcaaaaatatatattccagcagtgcaaacctgacttattggtgcctcatacctgtaatcccagcaccttgggaggccgaggcaggaggatcacgaggtcaggagatcgagaccatcctggctaacacggtgaaaccccgtctctaataaaaatacaaaaaattagccgggcgtggtggcgggtgcctgtagtcccagctactcgggaggctgaggcaggagaatggcgtgaactcgggaggcggagcttgcagtgagccgagatcgcgccactgcactccagcctgggcgacagagcgagactccgtctcaaaaaaaaaaaaaaagaaaaaagaaaaaaagaaaaaaaaagaaaacaccaggcaccgagctaactgtatcacacaccttttccgattagaaaagaacaatgaatacatactcctttgcttattataattcttgtgcggcaaatataggacactcttatctcctcctgctcaaaaaaaaaaaatgcaaaaaccacagactttttaatctatggagtgaatgcgttaacaagaacatagaattaaggaagaatttcccttagataagtacattaaaatctccaaaatgctcaagggactgaaactgcccttgtggagaaaatgctgcgcatcagccccgccagttaaaacaaacaaacaaacacaaaaaaacacacctcatccccgttcacctttagccccaccccgggtggttcttggagccaataagcgccggatgccctcagagccccgccctcctcctggccaaagcggtgagagggtctaaaacagccctttctgcagcaggtggcggagccccgcccccttctccccgcgcaccaataggaaccagacctgaagaggacgaaccaagaacgaaaagaaccacccactcgggagccgcaacctagaagccagagttgtgtatcagattcaactaggagaaaatcccacctccaggctccattaatccttccaatggagtggaagtttctctcacagagaaactagtaaggggatccaatgggaaaagaacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtgagaggttcccgcggctcagggaagatggcggcagccgtggtgctggctgctgggttgcgcgcggcgcgcagagccgtggcggccacgggggtgcgcggggggcaggtgagaagtggcgcgggagcgagtagggggtcctgcgggctccgaagccatccggggccagggggtcccgaaggcgcgcagagccgcgcagagctcctgcctgtggcctctgcccctccgaggcacaagctccggggctgtgtggtgaggtcgaactggtggctccggagaacgagctggtgctgattcccgccctgcgcaggccggggcgccgaggtcgggacagggtcagtgcagcggctgccgccttctttccactgcctgcagcccagctggcccgatgccccctgcaggaaatgagctttctcttcttggagccagtgctctgccctcctcaggcttctggcctcctaatgagcactagtgttaacctctcttctgcacttgccagaagcggctcggaggtcagagaattcattccgtcccgttctcccccaacgtgatgcaatgacatcagccttctctgaatcccttacccgaagttccctggggctaggggagcagaggtcacttagctgaactcttacctccactcattcaagggacaagagttaaaattcacagagtcacatgtgacacccagatgaggggtcaactagtgtcaaacagggcgattgcattaaaacttaaataaaacaggcgacaaggcttaaagatcagaaaacaagtaacggaaataagtggaaatgtactaacaaggtgagagtggaaagagattcaagccatcgcaagagattatggaaaccatccctttattttatattagaagctgagagaaggaatttatctgaggtaattcagtggtatggtaaggtaggaactgagaccaaaatccccagtctctcattctagatcctttccctaaacagtgctatatttcgtggacacatgagcaggaatcaattgcactgctgaatcctgataataataccgcctgttatctaaccaggtccagcaccttctggccctaccctttgctgctggtgctctgaaattcaggaactttcctcctgggtgggaacgatgaataggttattagaaggacgaaattaacaactatcagagcccagcttctgccagctccctcctttgaatatggtcgatccaccttcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcaggtggggtgctcttaggacctatccccttaggaatgttgtagataccatccaacctgttgaagtaacgtggcctctggcctgtcacttcccccagtgtcttgtgttccgtgatgtggcccctcaggctcctgtgcacttcctggtcattcctaagaagcccattcctcggattagccaggctgaagaagaagaccagcaggtgggaagaacagggccagggtttggctgggaggagcccctggacccagctagaggtcttgctccctatgaatgaagccacctatgtccctccgctctctctatagcttctaggacacctactccttgtggccaagcagacagcaaaggctgagggcctgggagatggataccgacttggtgagtgacttttggcccttggtccctcacctatgaattctcattcctacttctcaatatgatcttcattcttcgacctctgccatgatcctgactccctaaccccaagctcaatttcagtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaattatgctctcctgtctttaatataaaattttataccacaaaggggaaagaaaactgattcagggctatgatgccccttgactggtctgagtgaaagacactgaggaggtccaacctgtggttaaatgttgcctgcagatatgtaagtcttcttgacaagtggtccaccctaggtcaagcttctagaaaagtaacagtaggaatgagcctaaatgagtaggaagaaactgaaagccaatcctggcccttcttcagaggtcaaaccaggttctaagggcgcttaggaggagggtggtcaatatgagggtcttttattagaggaggagtaatcacacccaaacaaaagcggctgccttttcactattctacgtctcaccattttgctcaagctagtttgtttattttcatccttaacatttgttaaagaccccactcacttttgagaatgaactaagcaaactaaggggaagctacttgcctctcagcaaacaccaagtaggctgtaatctaatgccacaaccctgtgcctgtttccaacatatccccataaagcatcatcttagaaaaccgcacgcaaagactgtttggacgtggagggcgaggtcttaagccagcggaaccctaaaaccccgtctgaggcggaatgccgccgggaccggaaagcggacctccctaacagcactaggctgaagacttccgccccgcagaggacttgcctccaccgccacctgcaagtccgcccagctgtacttctgcgcaggctccaggagttgtttgctgtctctatggcaacccagtagctggagtctgaagatggagaccaacgagtctacggagggatcgcggtcgcggtcgcggtgagagccgcagctctggctgcaggcataaggggacgaggaaggtcagctgacttcctctgctgcgcttttgacagccatgtcgtgtttgctttctttcagatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagaggtattaaagttttggcctgctcccttttcttgaaggctgccctcagtttcttaggggaggcagtagtttacatgagggtgggtaccagaagggatattatagtcattcaacttgggatccacagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgaggtgtgaaatgtgagagggtaggccagaacgagcccattactcagagggaagaagaggaaggaatttctggtggggctgtggattctccagtggatataagggcggaaccccaaggttcttcttccttttctcaagttagtttcttctgggcctccttcttaaccagaccccaccttgcccaccccccaactctctcacagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaaggtgagaacccaccccccatcccccgccacttgcaccagctgggctctgacaggctgtggccaagtaccaagcccagaggttgagagagagggctgaaggccaggagttactcagtaccctccctcacagcctcacgactaccgccaggagcaacctgagaccttctggatacagagggcaccacagctgccggtgtgtgagggtgactaggtgttgggggcagagcggggcaggaaaggtagggcagagttgttttgttctggcttggggagagtgggatccatcctcatcctggcactcctccagggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagagagggacaggtatatgtacagggctgagctgcagagggctacaacttccatataaggtaggtttttttgtggctgttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccagtatgttcgcatctttccttttccctggaagtgggagagtggacatgattcagatgcttcgatgttagtccctttgtctccctctctttccctatgattcccataatcactttcaccctccctttccatgcccccctccccatggcctgccatcaccttcatttccacatccccccgaagctctagctggaagcatcctagctcatctagggcatccttggtggtagaggagacatggatcttcagcgctggggtgggtggaatggggaggatggtggaatgaggaatcaaagaaaaggcaatcaaataattggtgatactgtatagcaccgtgcccgaccaaccatccctgggaagctcccaatgcatatctattaggaccaaaatatgcccaacctcccaatgcatatctattagaaccaaaatatgcccgaggatgcgacactaaggaactgtggtctctcagattaagaaattggagggattatgaaaagaagaaaagggcaagataaattgaggccaacagtggggttgagggctaatgtcttaccttgaccattagactccattcgagaagcagtgttcactgtgtctccaaaaagacaataacggggcatcttcaggccaacaaccccagcacagactggccctttgagaagaaacaggttgggagagtctgggaaaggtggagactagggctggagtgagagtcagccttaccagtatggacccctatgcgtagcctcagctggtcatggggtcggtggcggatgcgaaaggaagaaactgcatctagtaatgctagggccatacgagcaatttctggtgcatggcgttgaccatttcggcctgggaggccagataccaccatgtaagcatccccaatcgtctccacctgattgagagggggattaaaaggtcacctctatttatatccatggggatgggaaaaagtagagggagacaagcttgacaccatcattaatcatcctgacatgctggagaccagaatattgactagaaaataagtgccatggtcctgagtctaggggagaggagatgtctagggaatctttaagtcttctttctccacccagcacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaatacacagtgaagtttttaggaaatacacactaagtatttagggataaagtagttatccctaaatagtagtctgccacatgccaaacaatgttaggtactttccatacaacgaatctattattcccatcttacagataaaacaactgaggctcagggagattctgtgacttacctaaggccacacagttagcaacaagccaatattcaaatccagatgatttttactcccaaggacaataaatccaactcaataacttcaacaaaaagttttactttttaaaatatattttccctcaccccactaaatcagtctggacccacatcctatatgattcttccatgtctggagaggactggagagaaatgttggataggctgtatttatactccaggaagataggagctaaatctcatgatggttctgattagggaagtcaaaggattcacaagaaattcgactggagtgtacaattatagtgctggagctacatctgtctacgaagtacactccagcaccaggatgctgagtaccctggagggaaaactgatcatggggtgggtaaggtgtgtggggttcagggagactgagtttcaaagcgggtctctattaaagggtcttctattgaacagcggccccagctctcaccttgtagacatcaaagttgtcaattatggcatcaaagcaggtatacaggtcattaagaagtgtcactacctaaaagggatagaaaagcagaggccctgagacttgtgcccaattttctaagaattcttaacccacaagccatcaaaagatgtgggaactctagaacaaactcatctttcctattatcaatgaggcttccccaggtccctacccacccaaccccacccgccacctctcacccatggctctcacctgcatgggggtgctctctgctgacaatgctgtgaagccaacaatgtcactgaagtagatggtaacactgtcaaaggcctcagcctgtacagtctctccccgttttaactgctctgccactgaactaggaagcaagggtgccgtatgagccaaactccaagagagcaggagtggaagagagagggaaagtgtatgtggctgcagcagagatgagctgtaacaagaaagctaggcttttcaggtgggagggaggaaagtggctgggaagacattacagtctaatgcaaggtaaggcacacaagtggcgggggggtttgaggggaatccctgtgcatgggagctgtctcaagttgggactgttttacatacacttgctgaagcaagggtgtggtagagcagggtcttaagaagaagggatgggcagccagtaagaaggcagcatagctgatgtggagacagaatgacagcaaataatctataagcaggggtgctccctgtggccagcagggttctgagggtggggaggcgagttctcaggtgcctgatgaggcagagcccaacagagcagaatcccaaaagaaaatacaggaagggggacaaagtctcactggggtaggatttggtagagcagagcttcagccttgcgtttttcctccagataggcctgtgtgcgttcctccaccagcttctccaagttattggcatactgttccatgcgcagcaggaggttgtccaatatgctggtgccaccctccctagagggaggccaggataaggcacttgctctaagattctgaagattcccaggacttcctatccaacccaccctctggtcccacctgccccacttcatgcactaggactaatgagtcttctatccctgggaagcccctgccccataatgccctctcacttgttaaagcgccgaatgaagcccttaatctgtccaaagtctggccgctcagctgggtcctgagcccaacatcgctccatcagcaaaactagctcttcattcagttgggtccggtcaatgcttggccggaaatatggccgctgaccatttcgtaccttctggacaatctctgagggtgatcaaaggtttggatgaagaacagagttcccccaggaagaagaggctgtgggtagtggattgactcttacctttggggctgaggtccaggccctccaagtagaaaggaccactgcgaagtgctatctcctgcaggatgatcccaaagctatagacgtcagccttctgcatgcctgtggttggcaaggggttcccactgagcagttctggggcagtccacagcttctctgaaaagaggaaaccggctggccaggtcccccgaaatggggcacccccaagcccacctgggctcatccctatattactgtcactccacctccctctcccaccatccctaggtggaaagaggagcaatataaaaagtgggttgtgggggtgggcctcactggcatagagggcatggctgtcatcaggttcagcagttgatcggaagctggccaggccatagtctgtgattttgagcacaaaacgactatccaccacacagttggaggacttgagactcccatgcgatgaaataatgctgttgtggagaaaggccatgccctgcagggtacagatcaagtcatgggattggatcatatctggcttagaataccctctctccatgagatgggcactggctagctgtctacagatcttgggtccacaaaaataataagctgattttggaaggcatcctttgcagtttccacccaaggaagcaggaagaacagaagagtcatctgttcctggtatcataagcaggacacaggcacccagccaccagggacagggaaaatgcttaaaaagagggataagtggagctacaaatgactaccctggagagggcagtcaatcttcttgattagtgaagagaacagaacttgggtgaagaccaaaatgatataacacccatggtggcctcagatacctggctactaattaggaagacatgacttgagacccaggtatcaagagtagctggatataccaaggaagaccagttgtaaactttaatgcataaccaggcgtaggtgggcaagtcggggtagaggaggaacaagatctactagagggaggtgggcaggtcggggtagaggaggaacaagatctactagagggaggtgggcaggtcggggtagaggaggaacaagatctactagagggaggtgggcaggtcggggtagaggaggaacaagatctactagagggaggtgggcaggtcggggtagaggaggaacaagatctactagagggaggtgggcaggtcggggtagaggaagaacaagatctactagagggaggtgggcaggtcggggtagaggaggaataagatctactagagggaggtgggcaagtcggggtagaggaggaacaagatctactagagggaatgctggatcagagagaaagtgcagaacatcataaacctggaaaatggacaaaatctgctaagccagtgcagaagcctaaaactgctggctctgtgggtccagagagggaaaaacctttgcctccgaggagctgaaagacagtcttaaaggccgggctcagtggctcatgcctgtaatcccagcactttgggaggccaaggctggcagattgcttgagcccagcagttcaagaccagcctcagcaacatggcgaaaccccacctctaccaaaaatataaaaatgagccgggcactgcagcacacgctgtggtcccagctactcaggaggctaagatgggagaatcacttgagcccaggaggtcgaagctgcagtgagcagtgacctagccactacactctagcctgggtgacagaataagaccctgtctcagaaaaaaaaaaaaaaaagtcttaatgatgctccccaaaaatgaaaccctaggagccacccaagtcagttcaggtgagacagaaagaggatacaaggttcaatatgctaacaaaaaacatttctgtctaaatgtttagctctggacttaattcataactctaatctctatgaattcttcctttttatttattttggtatcaacaaaacttttgggaatctctgaagttgtgaatttacttgtgtggaaactgtgcaaaggatgccttcaacaatcacaggattaggcttctggctttgttgtaaatcacttttccaccaaatcactgttctctcaagagtcgtgtcttatgtttatcatcacacctctagttgagcatgacattggctttactaatatttttatctctcatttgatagcaaattttcacacacaaaaaaatactttttaaataacttcatgagaattcagcagaaaaccaaagctagtttcagatacagtgtggggtgatccactgggatgctcattggctatgagacttatttcagaaaacctgtccaactcatgcaagattctattttatgctccacaaatccatgggcctctgagtcatttgaacatagctaaaacctagtataacagaagagtaccaaaggtttttagtacaatcttccttggtttctcttagttctactagtaaatgttccttttttaaatttcagttttctgaacaaaagggcagacatgccaaatattggtcagagagtaaaataatgagaggaaaaacaggagataaatatgttcggagagtaaaataatgagaggaaaaacaagagataaatatgttcaggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaatatgttcagagactccactcattttatgagttcttagaggtaaaagagatgatggaaagagacctgagatatttaagacagaaagatagaaactctctacaggcacaggactccttgtggcaggtaaaactcactgtcccagttataagccccagactccttgtttacccattattaccagaccatgggaataaggggagatgagagaacaggacttcagaggactagaaggagaaaaaccacaatcaaagaacagtggaagtgatttaaagtggatgaacttttaaggagtggggaagactcaccttaacaaggtcattaatgagtgaataacgaaacatccagtccaagttgatgctgtcattttctagaatatcctggtaagtgacatggaatagactgtctgtcctggtcccaccagctatcacccagcatagagtcagtataactttgggtctatccttcccacccctgccataatctcctacacctatccctcacctgtaaactcccacgaggacagtattcagtgacaatgcaaatgttgggagggtctatgcaggcgccaatgaagcgagtgagatggttgaactgaacatctctcatctggcagaaaaaaacaatgggaaggataagaaaattgaaagagttaaaaattagatacagaaacttaccactacataagaggacctttctcttagttgtatctacgattttaaaatcatttataaatcaaccccttgcccatctagccaattttactatttcatagttttccccactcctccattacatacatgttagagtccatcctctgttacatacatgtttgagttcaaacagaacctgccgggtcagctcaatgcgcttcttattcacatgtttgatggcgacaacatttccctgatggtgggagtgaaaggggaaaggaaagtgaatatcagaagttctgggtacaaggaaatgctagagagcagtggaagcacccaggagctcagctgggcacagagagtcgggtatgagggacagaggttcaggggcagaggtggcagatggggatgagacaggatgaaatggtggggaccagaacaagcaaatgactgttcaccttgaagtgaccggtgttggcaaagatctggtatttcccatgggctgtcatgagcgagccgtaactggatccccgctggggccaagggcaacatggaggcggaaggatgaaaggaacattagatgatggtggtagtgcaggggctatcattacaagccaatgtgctgggagagatccagggtaagaagggacaggaactcagagggaggcagaggaacagctgagacaagggctcaccagcgacagtgtgaggcgactgcctgcacctttgtgataacgctctgagttgccaaactgcagttcttcccagcgaatacgccacaacatgctagccagctccttctccagcatcagctttctgtaaggactgcacacctcagttgactggcaagccgaatcctgccacccccaagccaacagcagggttgcaggggcttccctgcagctcctgaagctgcaactgttacacctgagagacagggctggaagataaggctgcattctcggcatatctggcacatgccctatgctcactaacaaacacagagactgggggtgaaagttctttcctaaaagaagaccaatggaaaattcacctttgatcttaaccccactgaaaaacactagttagtatatccagtctaggaccaaaagtggaacaaacacctaggctaagcgacaactaaagagaaaggctagagaggaagacgctgttggatctaagagacaaccagcaaattaagaaacctactaccctatcccacattatagggaccacctggcttcagccagaggttgtgtggcaatgggggcagggagtaggtcagcaagaaacccagaactcaccggaaaattaggaagctggaaacaccaaacatgatgaaggtgattcctgtgcccagagccacaattgccagggttgaaagtggagctgaaggggaaatagagaccctgaggaagactgtgtgcggacttggcagaatggagaacggggtgcataggtgcatagacagactccttgggagtaggaagaaatgaggagggagggatgcagacgtaaaggcagaagcacagttaagagtggagggtcagtgagggtggaggccatgaatggaaagcaaagggaggaaagctgctcccagtccctgcacacacccacttttatcacaggatgggtcgtccaagtcaaaggcacaggggggattgtccgagggaggagcccccttcacccagggaataggccgtcccgtccaccaaatctgcttctcagctcccgagtagtgggctgcaggctgtaaggaagcaaaaagctgggcccacaggcctgctcccaccagcctcctccccagaccccagctgtttcgctgcttttctccccagcctaccacccagccaggatgcagtgccagcagagaaaacaaatccctcatctagtagttttggttctgccccgactgaacccttgaaagctggattttgcagggccacactctcttccctgcctcctcctccatcacctgaaagtccccagaatccaggtctcccatggcccagaggacaaagtcagtctctcggtcattgttcttgtccatgacaaccagcccagttacacctaagacagaaaagagtgtcctttctttgaggtctaccctgggctcctctcccactcactcatgcctacggctccctcagagtctacccttccccgatcttgaggtgtgggcaactctgccatattcactaacccccactaaagctgtggtgatcctgacatctgtttcttcttcagcccactctattcctgacatcagccctcagacccccattgacccctcttcattaccgtgatatcttcgtccctgcatcttttccacaattcgaagtccatcctcccgggtgcctccttcctgtattgtctcattcaggacttcagcatatagcaggatcccatcatagaagcagccagcgatgaggttcatctgggggtggcaacttcagcagtactctccaaatgtcctgcaaggccccttcccctctctctggggtctcccttctacctattctctcttctggtttgctttcttccctcttattcctaaagtgccatcccttcctaactactccatagggcagaaggaaaaatcctggacagaagcggagaccccccaaagttgggcttgctccacagccaagacttgatgctgagtttgggagagaagcccttccccaaagcttgacctgactctcaggaagggagagatctacttaccagggaagggcccagctccacaccaaagtcttcccgggctcttatcagcagacgattctggaattcctgatactcaggatttgggggttctcggtacgtgatcaccaatacagtctgtaccagcagcatatggggaagagtgaacaggattcaagataggcattatgggaagagaagatgcaggacagggaaacttggtaaaatatacatgatataaaatatacacaggtgagtctgaaggctttgaaagggctactaacctctctctctctgcgtgtgtgtgtgcgtgtgtgtgtgtgtgtgtgtgtgtgtgttgtgttgcatacatctgggaagagggagtggcactcctcctgaaaggtagataggactggttctgggaaggtggaaactggcaaataatagtcaaccccatccccaaagcccagcccaacatcttccagagctcccttccagcatccaggttcctgccaggccaccacagctcacacggctcctctgtcccatgctttctgggtatctgcttatgatcaaggacaacacccactaacagctcctctctgagatgttaatcactgttaatgtcatcagtaaaatactaacattgtcatttcggccacttgaacacagtgtctccgcccagtgaattagagagatttcaggccctatgacaactgagggaaatactttgagacagtgattccacctgtgaaaagctgtgtgctcatccatttaatgtgtggaacacctaccacaaacagcactgtcctgcttactgagtaatagatgtgtcacagggacaaacacacagtcacatgcccacacacatttcacaggtaagcaaatgacacatgtgatctcagacatgcacacatctcactggcgcatgagtcagcatctctgtctctcaccaaagtgcctgcttggctcccattagtctcacacatttccccttcctgagctgctggacctcccagtctcaggccctgcctcaggccacatagtcactgagaccaacttctgctccaacaggaaactggcatcacaacttcaaggaaagacttcagttcaatatattttatgaaacatgactttgtgaaatgataatttaaaatccggtcatttctcccagttttgtttattcttgtcatagaaagtacatgtggaccatagagatacgctgcactagacacatcacatatggcctattatgtatcaattcattagagataggaaataataaagtcgatttctaatatgcattcattatattatattagactgcagcttgcctcaagatatcattattcttactagagcatttagctgcctgattacacacttctaacattctcccagtctcaggtaaaatttttttaaaaagagaagggaattgaggaaagggttgaaatagttcattcagtagcacctgttccaagaataaaataaagaggtagaatattgttgacaagcaatgtaaaaagtcaggaaaagggcgagaaaagatcaggttcaacacaatttatatttcaataaaggctgatgataggtttttaacacattttaaacactaattctcaacactaagtttggctagtttgttaggctagcagttatcaaacttttggtctcacaatcgctttatactcttaaaaattattaaggaccccaaataaagtttgtttatgtggactatatctatcaatattgaccatcttagaaattaaaactgataaattttgaaaacgcaagaacacacaagcacaccttccatagctgtccaagtgatgacatcatcatgccatgtaacctctggaaaacttccctacacaatcacaaaagaacaagcgtgacaaagcagataagatctttgtattatttttaaatagttttgaccccatggtccccctaaactgctatgctagaactgtttttgctgtggttactagttgtagttgtagtaccaaaaaacaaaaatgaaaaaccaaaccaaaaaaaaaaacccaacctcaaacagtttctgtgcttgctcaggggtttgagagaaagtgaaggaggataattgtgtcccatttcacagtggaccccaggtggaaaaaacaagcaaagtccgccacaaatgggtgcagtggtgggtgggtgccaggagcacacctaggaaatgtgcaccctcaggaggcacctgcctctatctgtggacccgcccactgagacttgccctggccaactggagagtggtcaacagtggcctaatgagacaagtgatctccaagcccttggtttagtgctttcttccattcttgccgctggtgctccctgtgtgtaacccaatctcatgctggtcatgtaggttgtgacctctgcctgggtttctaaccctgtagtcctccattgaccagcctgggcttctggatcctcagagcctggtcattgcttatttagttccactcaatcttttcttccctatcctggttgatcacctagtttacattacttgccagctctactcctgtctaggtgaattcctcatcctatccccctctccccaacacacccctaattcaattcagcaaatatgtgttaaacacctactacatgctagacatatggaatatgaagatgagcatgatccctgccctggagcagctagtggctaaatgggagagaaaaatcatatcaacatacttgatttcagagctctctccctagtagccagtatcgatacggcatgagctaaggcctttccttgagcatgataccctcctggaaaagctgtgggcatctgtgtcaaggcctcctttcctctattgccaccttttccaggctggcctggtctgggacctcagagggccagtgtctctgggagaaaggctctgtgctctttcatccttgcttggctgtagctaactgcccaacttccctcagactctcccctgcttccccattggaaggtggggggcggggcaccttatcacccctcagccccacctacccaaagccttgaccttcccatcagcatattcctggtgcctagttcccttctcttgtgttgcagcaaagattccctctttatttctctgtctgaataatgcccacagtgagggggagaactgagagttaattgatataactgattattggatgactagatccctcctctagctacccttaatgctggggactcttggctgggcaataatgctcacagaagaaagtgaggcttttcttccacaaatagaatacagccagcaaggcgcagtggctcatgcctgtaatcccagcactttgagaggccaaggcaagaagatcatttgagcccaggagttcgagaccagcctgggcaacatgataagaccccatctctataaaaaataaaaaattatctgggcatggtgtcatatgcctgtagtcccagcaactcgggaggctgaagtgggaggattgcttcagcctgggaggtcaagactgcagtgagcagctgtgatcacaccactgctctccaacttgggcaacagagctgtctcaaaaagaaaaaggatataaccaggaaggttatggagtgctcccatctgagagggtcacagatcttctgcagtccacaccagctgaagtacaatccccttgttcttctcttttcataacactctattcctttcctctttatgttttagtaacacatcacaatatgttcctacatttgtatttatttgcttacttatttattgcctgcccatcctaccaaatgtaaactccaaaaaggcaggaacaaagtctgttatgctctcccttgtataccagtacctagcacagtgactggacatgataggtgctcagtaaatactaatgaaatgagtcagccttcaaataaatcaaacacagactgaataatatggttagttctatggtagatggagttaagcaaaagagtaggaaattcagtcccacttagggattctgggatcatttcctagaaaggaaaataactggtatgagtcttaaagaatatggaagcattacccagacaaaggtgagaagattgttttaggaaaacattatggcataaacaaaacctgccctgccactgcccatattcaagtgtgacagtcacagactcattctcaggcatgcaaacagctatgtcattctcagtcagacacacactcgtcagtcgcaaccaaatatataatcacagccacataaaaccttattggagaagaatggccacccaggtccagcccttatacacagctacttcgaaccaaataatcccagagtttaaaggactttaaggttatcccataagccacctccaatccttcttggaaaaaaggagggatatggataaatacacgggaaacacttatatgcacggttagtaaaaaagtggcgggggaatcgggaagattcatgggtatgattttgagaggcagatatttgggatgagggaaggaagagcattccagacaaaaggaaaaagaacataaaggcacaggggcaggaaggccctggggttgggggaactcagaggcctggtaggctgcagttctcagcatgagggtaccaggaggtaagactgaaaaagtggtttgagaacagactgcagaaggtcttaaatgtcacaataaggagtcaggattttattctctagaacacaagtcactgaaagttttgagcaggagtgaaatgaacagagtcatgccaacattccccacaaattttctgaaatctgaaatgcgtttctttccattcctgctatcatcacactagttcaagctatatcacctcacccccttctaatctgttacagttggtctcactgccccaggtctccccctcttctaatcctgaattctgtcactactgtataattatctccacacacacacacacacacacaaaaagtcaaggaccccaaattcaagtcctagtgccttaagacttagagctctccttaatctgattctacctttgcaactttatttcctgtatctcctttaagtgaacccctcattcttgtcgggtcagtatcttcttggtctctcaaacacgcccattcctatctttttctctttgctcaggatgcttggatctcctctcccactctgactatgaatatgacatctatcattaaagtcacaatacggtctcacttcctgtgtaaaagccttccctaaacacagcccacactgactcttcctcctctgagccactaaagttcttagtgtctgttccaggacacataatcatatcctttctcaaactttgtctgactgtaccagaacgatgcctcacctctccataaagggtggaagcccacccaagggctaggatcagatctcttcctgaacttttctcccccacaatatagcctactactggcacttaggaaagtcagtgttttaggattttggaggcagccaaagtcagtcttggcagcaagcacactaagagtcacaaaagtagagaagtaagaaagggtgacactagactcagaatgcctctgttcattttactcctgtggctcacaattcctgcctggttcctagggtttctttagggtcttgtgagagagaatttccagcgaagcacctcttccccctcctccttcagatttggctcaaatgatacctgaaaggcctctctgagggcctgggcctgttcccgggtgcgattgtcctgccagggccggcctgtagcacgtgtggggcctgcacggagactctccccaaagacatccaggtaaaagaagacataatccccattggtcagattctccctctgggcctgaagcaggatctcatgcagcatctccagagggccgcagatatacacaactgggagcaggtacatgacagaggagcaccctgagaaggtatccaggtcccccacacagccccctctctgaatcactgggatgtccctcttcagcaagaaagagagtgccctaacctatcaaccccaaagcagatgctccccagcccacccctcttggagtccaccataagtaccctggggccatatggaccatctggcagaagtcagagcctgtccagaccccagaggaagggagctgtcactctcaagcccctccctttcccagagcctcccttgctgctccccacccaaccggcctgctccctgactcttccctgcccttccctgggctcaaaggcacagacagcacagatttctcagtatgagctttatctgtctttcccaaatctgctgagccctgagtccgttcatggagccctcattatttttacaccaccaaggggtcttggcgcccagtctgggtggtagctctgatcacagacagggcacatttcagagtggctatcaatcacattcactactctagggcacaaacattgctcccgaaacttaatatcccctcattttcacattccaccttgatacaaggcttcacccctcatgctctcttcttccttgtttgcatctgcctagggtgttcacaagctcccatgatgaagccttggccctctcacaggtgctctgtccacgtgtgcttcttgatcccaaccaccacatacagctgctcaatgcctatctccatctacagttccccagtgctgagctttagggacacagcgaccctcctcccatgaccctaaaatagcccaggccacactcactgcgcccgttggcccggatgaagtgggtggcctgctcggggccccctggctctcgggcatacacctggtgctgcacactgaggttgctgccctgcagggcctcaaagacgccctcgatggtgaagtagtgaggccggtcatctgtgcgagcatccaggtacagcaaggcagcacgggcagtccaattgaagtgcccgtgtagtgtcaccacaaactcacccagcttgggagcagaggggccagtgcgaaccagggtacgataatggtcattcttagccgaaaaaccagaggccacagcacccgcagtcagcaggggaaggcgccagtgggaggcaaagcgggccacagaggcagcagggtacacgcaaccgggacctaacagcaggtcggggtcatggtacagcttgaggtccacagcgctcagcggtgccaggtactcagagcaggcgccttccagttcggagctgacaaaccgcaggtccacgggcagtgcccggcccagagcctccacagctagtgccacagcgggtcccacccgtggccaggcccaggcatagctcaggttgtgttctggcagcaccaccgccagcgtcaggttccgcgccccgggaggacgcaccccacctgccagggctgccaccaacagcagaagtgatggcagcgccatggggataaagcagcagccccaccgcccccagaacttggggctgctctggcctacaggggagacgcgagcaccccccagcctggagcctggggaagagggccaggaagaggaggagtaggctaggtaggctgggatgcagaaggtgctgggggccggggagaggagggggagatgggaggaaggcggggggcgggcaaggagtgggctaccagcctagggcaaggactgaggactgagaacggggtggcagggggagggagggaccgagggggcctgcggccaggatggggacagtgcgaggtgaagaagcctgataaatctaaagctgagaaggaaaaggggatctgggactgggatggggtgggggtggggggcgggtggtacaaagaaacggcctgggggaacctcacagctgaaagggccgggagggcaggagggcgctgcgccacataggaccaagggggtaaggtgggagggtgcccgcgccgcggaaggactgggatcatgggcaggcggggagcgaagcgaggcctgggccggagggcaggggaaggcaggggtaaatctccctgtgaaggattctcccggagctcctgcttggactaacgggcccgggcgctggtcccatccggagctacggcggccccgcccgtgtccccgctcctctctgctccgcttctcctgggccctggcggccggcgctgcccggcgcttcctcccgccccccgcctgggccccgcgcgcgccgctcgtccgggtcaggtcgcctcggcccggcccgtctccgctcgctgcgccggcggccgagtgcgactcccccgggcaggccgcccgcccccgcccctcccccgctgcctctcctcctccctcccggccccaccctccggcgccggctgccttcccccaccccccacccgggcgctcgggaccgccaggtcccaaacccaccccggtgagcacttgggggctccgcaccaaggcctcgccggccagcagggttcccgggcgctccctcactctcagggcctaccctggtctcccccacgcccctggtccccctgccgcccctccttccatttccatctcacacacgccagcgaccccagggtttgtcctctccccctcgctcagcccgttcttcttgggtctcccctctgaactccctgagtccctcagtggttccagtctccaggaagcagtcgaggatccccagacgtgtggtatcctcaccagccccctcacctagcaaaccatagcgccctcccgacggcagtgcggcttactccaccgcggaccatgcccgctccctggacgggcccctccagcagccaggggcccctgctgtacacttcccaccagtccttagaaagtccacgaggctccttcttgcttgggactcaactctcggccccccgctgtctccatgccccctgccctcctcgtgtcctcagaggcccaccgcagcccgcccggcttcctccgcaccatctgctcagtcagggcctcgattttcttttgtctcctgcacagcgcaggctggcgcctggggaaagcctgtaacggaccggcgggacactccccgcagtggaagcccatccacgctctcctggggttccaccttgctcccagcttcccttaggaagctctccctagggccctcatatctggagtgccaatctgaccccaagaacagcttgtgagggatgatctcatggtggctgagagggactgctatgggaccttggggatttttctccaactgtcataaaggacatgcacataagcccattctctgcccgcgctaagagccacggtttctctccccccttcaagctatttctccagaaatcacaagctaagagcgctcctggagccctggagtggggtgggagtgtatagggcgaggacgggcatggtttccctgagatgaaggcgacacctagtggtttggtgggggaaattaaggacaatgccactttatccttaggcacgatatttattgaacaccggctgcctagcacaagctgtacctgtgaatacaaagaaagccgaatgatacagcccttacctttgaggaacatgcatttgcaatccctggggcacagaggccaagagcaggccgtccctaacaatgttcttgcctcaagcccagtagagatggaagcctcaggacagctccttctttaacgcagaggggttggtaactctagttccaggctcccaatactgcagtgaaaaggaattttgtcctatctggccaaggcaaaaaaaaaaaaaaggaacagtcaaaagaatgacgagacaacatgagaaatactttagaccaagtcaaccaaatagaatagttgatttttaagcaactacacattgttttatgagacaagcaaatccaaaatgacaaaattcctgaaagaattacagaatggcagggctaagaggatcatataaatatattgtttagccctctcatttaaagataattgaaaaccaaatcccagagaggaaggtcgcagtgtccttacttgctcctctcccccaatcccacatggctttttagttgcaaaagagagattaaaatgcaggtttcatggtctccaaggagaggctctttatagatattttgctgactcatggaacttactgtagaaagctgtgcttacaatataatagccaccaaacccaggcaagtctctctggaacacctgcagccctcagtgaggatcagccaccactgtcacccagactcctacgcaagtacaagtgcatcatatgtcattattctgaacattaaggactattcttcattatgttagggattaaacattcaagcatcttgcctttcccttttcctcccagttggccagttaactagaaagtaggaaggggccaggcacggtggctcttgcctgtaatgcctataatctctattaaaaaccaaacaaatcaatcagatatggtggcacgaacctgtggtcccagctacttgggaggctgaggtggggggatcgcttgatcccagaggatagaggcagcctgggtgacagcaagaccctgtctcaaaaaaaaaaaaaaaaaaaaaggaagtggaaggagcctggtgcagtggctcacgcctgtaatcccagcactttaggaggccaaggtaggaggattgtttgaggtcaggagttcgagactaggctggccaacaaggtgaaatctcgtctctactaaaaacacaaaaattagctgggcgtggtggtgggcacctgtaatcccagctacttgggaggctggggcaggaaaaccgcttgaatctgggaggcggacattgcagtgagcagagatcgcgccactgtgcgacagagcaagactccatctcaaaagaaaaaagaaagaaagaaaggaaaagaaaacataagtaaaaactaaaaataaaatttaaaagacaaaagggaagtgggaaggagtggggagataaaagataaatcccctaatgaggttttttattaacacacagtgaaaggcttttggtgtttattttttcatgtttgagggaaagctgaaaatattaaataaatgagaacttcggttatgtatatatcccactatccaagctatcactgctgtcattgatatgggcaataatattttggctgtatttggtgaccatgctgcaatacatagaaaacctaggaaatctagattctactggcctaagcagcaaccagctagggtccaactttctctttgtagcactgtcatggccttcttctaatccacaaacagataccagctataatttcttctggatagggtcaatcaacaccctctttctttttctttttttttttttctttttttgagacagagtctcactctgttactcaggctggaatgtagtggcgcaatctcggctcactgcaacctccatctcccaggttcaagtgattctcctgcctcagccttccaagtagctgggattacaggcgcccgccaccatgcccagctaatttttgtttttagtagagacagcgtttcaccatgttggccagctggtctcgaactcctgacctcaagtgatccactcgcctcagattcccaaagtgctgggattacaggcgtaagccaccacgcccggccccaaacaccttatttctgatccagaactaaactgcagagcatcaaattggccagctgctagaatctcctatggtttccaagctgccctgtcccttcttcaaaagaaatcctaatcctggttacactcaggccaaaggtgcctcaagaccctagttgagctctgcaaccaccatgggattcgggctcatgctaattttcgtgataggctctgatgccccaaactgacagcattaaacgttttataacaaacctatttgtgcagctgaatctggatcctcaggtttgttctacaccagatcatgcctcccaggcctacagaattccagaaaacaaaatatcttctctgctgacctgactagcagaaatgggctttgactccatgcaattgtcccctgcacacagacggacaggtccaagagaacctgccaacagagggcagagaacagccatagaaaggtagatcaaataaggcaggaaagatacacttcacaacacatctcaatagaaaaggagaaagtaatgtagaaaaagaaatgtagcaaagtatatagaaagcaaatagagactttactcaaattctgcattctttattttagccccataagggagagacagaatcctgaaattaggtcaaacctccagttcccctccaactcctacttccctcccagccacgcagcagtgcacagtatggttgtagatctaagatccagttcatcttctcacagatattcaacagcctcaaagggctgctgtgggccaggcatggtgactcatgcctgtaatcccagcactttgggaggccaaggcaggcagatctcctgaggtaaggagttcaagatcagcctggccaacatggcaaaaccccatctctactaaaaatacaaaaattacctgggcgtggtggcaggcacctgtaatcccagctactcaggaggctgaggtaggagaatcgcttgaatctgggaggtggaggttgcagtgagccgagactgcacctctgcactccagcctgggggaaagagtgagtctccatctcaaaaaaaaagggggcagcggtgggcgctgctgtgattgtttaaagggtcaagggtttttactttgaattcatatacatctttgtaagttcaaaatattttcttttttattttttttaatttattatttaaaaaaaaaaatttttttttttgacagagtcttacactgtcgcccaggctacagtgcagtggctcattctcggctcactgcaagctccgcctcccgggttaataccattctcttgcctcagcctcccgagtagctggaactacaggcgcccgccaccacgcccggctaatttttttttttgtatttttagtagagacggggtttcaccatgtttgccaggatggtcttgatctcctgacctcgtgatctgcccacctcggcctcccaaagtgctgggattacaggcgtgagccaccacgcccagcccaaaatgttttcaaatcagatctcagtttccaacttacctgaatagatatatgttttttagacaaacaggtatcatattctaagggccagaaatatcagctttgtgaaaatacagtccaaacaagtcattttcccatggaaattgtttcatagatggccaaagattcctaagagagaaatttaagaattgtcaggagaagcaaccacatacatttatttccttgatgattcaagctccacgtgaaccatatttcacctgtctgctccatctgggcctggaccagcacctctgtgagtgcccaggaaggccccagttcttctctgccctctcacacttggcccaagaatcttcctaggtacatagatagtttccctattttcctattaccacccttcatcattattaccaaccccagtagttatttaccaccctttgggagcatccgatagcatgaagtctcaaatataatattccctgaaataatcttacccactcaacttgaaattccacttcttcacaaaatctttcactgaggaaaaagtggcaagaggcaagtggcaagagggaaaggtgtccccttgccttttaagtcctgctaactctacaaatatctggcataaaaagaggcaaaggaaacatggttatcactgcttctagagactggaaatgcactagtcactattttaatcttctgctctgcttagaattttctacagaagccaaagactgggaagaagaggagaaatctgaaacaaaaatgtacaaaactgtactgcaatatgtcatgaagaaccaagagaagctaagcagtggcgatgtaagattggtgggcagacagactgaaagcaagaagaaccgtgaagaggttcctggagaaacccaagcctgaagtgtctaatctaggatgatgggatagtaatggagagaggaacaaatctgaggtaatctgagggaagaaacaacagaatttggtggccgactggatatacaagacgaaaaacagtcaaaggcaggggttgcaaaggcaaaggtggtcatgggccaggcaggaaatatgaatgggagaagcagctaggtggagactggcaagccgtgaaccccggcgccatctaaagtggatgctgaccctgggatggagcccagagtagccagttcttgctctgccttctctctgggtctctccagtctcacttccctccagtccagcctccacgatgtgttcaggtgtcaaagcgaccttttgaaacaaaaacctaattatgtcacatcactgcttaaaatctttaaatggtcccccttggaggctatgtttttcacactgttatttttagcagcaaaaccattccttcaaatgaaaatgtacatgtaaaacagaaaaaaaaaaaaaaaaaagcccagctgctccagatgaaacagtgggggtgggcccagaaacccctcgccttcacctcattctcaaacagaacccctgaggcaccttcagggaacctctgcgcagcagccttcaaacagtagtagcacaaaaaggctttccaaggactatgtttgtccagatggctttaagggaatccatctccagaccctgaacttccttatgtactcagtcccaaaactgttctgcctgagaatgacctgtgctcacaacagttgtgctgacaacaaccctcccagtttacaacagaaaggcatgtccctaccccaagccaaattttattatgatgaattattttagggtgtaaaaacctttggagcaccaagaaaaaggatatataaatcaagtattggtctggggaaacttgtgaaggtgaatcaaagtgtcttaaaggaatggggcttcctgtctttccccaccatatccatattctgtgaagagtaaagcttggcattagaaatggggtgttttcagctgagaggggtggtgtgtgcctgtagtttcagctactcggaagactaaggcaggaggatctgatgagactgggagttcaaattcagcctgggcaacatagtgagaccctgtcttctattttaaaaatatatagagatagggcagggcacggtggctcacacctgtaatcccagcactttgggaggccgaggcgggtggatcacgagatcaggagttcaagaccagcttggccaagagaccagcctggccaatatggtgaaaccccatctctactaaaaatacaaaaattacccaggtgtggtgtcaggcgcctgtaatcccagctacttgagaggctgagggaggaggagaatcacttgaacccaagaggcggaggttgcagtgagccgaaatagtgccattgcactccagcctgggcgacaagagcaaaactctgtctctaaataaataaataaacacccctatctctcatcacttacgaaagtcaactcaaaatggattaaagacttaaatgtaaggactgaaaaccatgaaagcattagaaaaaaattcaggaaaaacccttcatgacattggactgggcacaggcaaccaaagcaaaaatagacaaacaggattgcatcaaattaaaaagcttcttcacagcaaaggagacagtcaacaaaatgaagaggcaagttacagaatggaagacaatatttgcaaactatgcatctaaggggttaatacctagactatataaggaactcaacaattcaatagcaaaaaaaaatcccaaataatatgatttttaaatgggcaaaatagacatttctcaaaagaagacatacaaatggccaacaggtatatgaaaaaatgctcaatatcactaatcatcagggaaatgcaaatcaaaacctcaatgagatatcatctcatcccagttggaatggctattatcaaaaagacaaaaattaacaaacgctcatgaggatgcggagaaaggagaacttttatactagtgggaacataaattagtatcgccataatgaaaaacagtatagaggtttctcaaaaaattaaaaatagaactaccatattatccagtaatcccactagtgggtatttatgcaaaggaaatgaaatcagtatgttgaagaaatgtctgcacttccatgtttattgcagctctattcacagtagccaagatatggaatcaacccaagtgtccatcaacagatgaatgataaagataatgtggtatatttacacagtggaatactattcagccataaaaaagaatgaattcctgtcatttgcagcagcatagatgagcctggaggacattataccacaggatctcactcatatgtggaatctaaaaaaaaaaacaaaaactgatctcttagaagtacagagtagaataattgttaccagaggttgggaagcataggcaggaggggtagatggggtgaggtgggccaacaaagttacagatagacaggaggagtaagttccagtgttcccttgcacagtagggtgactttggttaacaatattattgtatttttcaaaatagctagaagagaggattttgaatgttcttaccacaaagaaatgataaatttttgagatactaattgtcttaatttgataattacacactatacatgtatccatcacattgtatttcataagtatgtataattattgtcaattaaaaataaaataaaaagagaaaattaaactgaaaagttttacaagcagaaaaatacttcagctacgttgaataaatgaataaatgaataaaaaaattaagggccaggcgcagtggctcacgcctgtaatcccagcactttgggaggccgaggtgggtggattacctgaggttgggagttagagaccagcccgaccaacatggagaaatctcgtctctactaataatacaaaaattagccaggaatggtggcacatgcctgtaatcccagctacttgggaggctgagacacgagaatcgcttgaaccggggagggggaggttgcagtgagccgagatcacaccattgcactccagcctgggcaacaagagcaaaactcagtctcaaaaaaaaaaaaaaattaagtaacttatttcatagttggtgtactttattcaataaaatagttaaaagtctgttttatctggcctggcgtggtggctcacacctgtaattccagcactttgggaggccaaggagggtggatcacctgaggtcaggagtttgagaccagcctgaccaacatggagaaaccccgtctctactaaaaatgcaaaaattagccaggcgcgatggcacgcgcctgtgatcccagctacttgggagactgagcaggagaatcatttgattccaggaggcggagattgcagtgagccgaggtcgtgccactgcactccagcctgggcaacagagcgagactccgtctcaaaaaacaaaaacaaaaacaaaaaaccttgtaataataaagttagatttcaatttaaaattgtgtgagtgttttattttaaggagctcatgaacaaaaatatttgagctctgcagctcaaaataacactttgaaaatcagtgactaaacaatgactcttgatgctaccaaacctaaatcttccttctaataattattttctaacggcacctttactaacttaaaataaaatgcatagataatacaacctatctctacacataatttcaaaacatcaataaaatttcctacctgtaatatagaagagaaataatagccgggcatagtggcaggcgcctgtaatctcagctactctggaggctgaggcacaagaatccctggaacccgggagggggaggttgcagtgagccgagatcacaccactgcactccagcctgggcaacagagtgagactctatctcaaaaaaaaaaaaaaaaaaaaacgagagaaataaaagacaataacttattttaaaaacaggtatttcaatatgtaaatggttggatataactgtgatagaacaccaaaggaggcactcagctaattgtaattagatgcttccatctaattacagggaatgaataaattttgatttaagagatctgaagccactccataaagaaagatactggattaaacaccagtgttaggataagcaataacagaacagatgtatttatatatatatttatatataacaccctacacaactgtttggtggaatatttgaagactgtgcagaactcaggatatctaaatcatgccgaattcaggacatttatttgacacctaaaaggtattgccagtgtcaaggtacaaggattaacaaccaaaacaaggtgaaattccttctctcatggaatacattcttaattatgtggaactgtcctcacattgcagagtctaacatctgcggcctccaactactacaatgccagtagcacccactctcatcactatagcaaccaagaaaatgccccttcccctccaccccctcctgcctgcccccccaccccctccccccacccccactatctcctgcgcacccaccacggaccaaaatgcccctccaggaaaagtactactgctgttcagagccactagcctgcaggatggagaacaagaatctcagtccaccaggtggtcctggctccatcttcctctccagcctcctctgcagccacatatgccttctaaacatatagagctatctatagtcctctaagtgggtcatgttattctatgcccatgggttttctgtcagcctgaaatgttttctcttcccttgagttctaattagtcttttttgaggcttactcaggccacttttcaatttaatttaatacatttgttttaaagtaggtactttctgccccattagattgtgtattccatgagaaggaattttatcgtccttaatctttgtaccttacattggcagtatattttagaattcaaataaatgttttctcaatggatatatgagtatggatgaagggattcactttatttttatttatttggtcatattttgagacagagtctcactctgttacccaggctggagtgcagtggcgccatcttggctcactgcaacctccatcccccgagactcaatcaatcctcccacttcagcctcccaaatagctgggaccacagatgcacaccaccacgcctggttgttttttgtttgtttgtttgtttgttttgtatttttggtagagatggagtttcaccatgttgcccaggctgatctcaaactgctgagctcaagtgatccaccctcctcatcctcccaaagtgctgggatcacaggtgtgagccaccgtgcccagccagggattcactttaaaagaaaaagaaattcctctgagactgcagggaaaggtggaacaatggattcagggatagatttcgtgacggataaatttaacttatctgttgagcattgagcttggtcaggtataaacataacctgccacccatcagtcttcatctgtgccatgacaaatgtctcctttgtacctcttcacaacatcatggtcagagtccataacactctgctcccttttggttatttaaagactcagtccgatatggcttaaaactccagtctcaggtccaatgcagaactcatcttaagccatggcttaaggaacctgcggtggagagaagaatatgatcccttctattgattctgcttctcctcttctagttctctggaaggttctctagaagggttttagctccttggtggttgagaactaggaggagggcagggaggaaaagaacaactctctttttatttaacaaggtagttatcacaaaccactgtttgctgacagaccatgccaacctgttgtttggcagatgtcaaaatgctatctttcttgcacatggtggctcatgcctgtaagcccaaggcattggaaggctgaggcaggaggatcacttgagcccaggagtttgagaccagcctgggcaacgtagagagaccctgtctctaagaaaatttttttttaattagccgagtgtggtggcacataacctgcagtcccagatactcagaaggctgaggcaggaggatcacttgtgcccaagagattcaggctgcaataagccatgatcacaacactataccccagcctaggcaacagaccccatcttaaaaaaaaagatgctggctctcttatgagacagttatgtgagttctttagaaggtcctactgggcttctccactgagttgtgccctaatgcagagaatcctgatccaagccatctctttaaccctcctaacttctgttcagtggcagccttttggatgggttaccagcatgatggctcaagcccggcgatcttcctcagtgtccctttgatcacagaaactcacatacccttgctaagccaaacagaatgaatgcagactattccactactatccccttactctgcccttcctcctttctctaattgcctttcctcttctcagacaggtgcggagctgaacaaatccactgtctaaacagatagtttaaccaaggaatgagaaatcaatctctctttcatgtagatctctttcatactcccttgcttactttaaggggggaaaggagggaaaagtactccctgctaggctcatgacagcctcccttcagtcatcttttatcttatatagcctgggaatggaggtggggtggtaaggtatgggttggctggaagttgcagggccacttctgctacctctttgtaagccctggagaggagctctgatccaattattagcaactctctctagaacgtgcagtatttagtcctctttgtcccagctttggaccctagtcaccaattccagggcaatagaaaaaaaccttactcaacatcctctataatatattgaaatgaagggaaggttatatgaaataaggagctcaactgcattcctcaatggggaagcaaagtcatcttttgagtgacagaaggaaccaggagtttgaaagttcaggcagaataaagaagacagagatagactggagatagaacatcagatgaaagccatgtatactctcttttccccattaaaatataaaaagcacatatacatattattccacaacattttacatatcatttcaggtgcacgtggatctaggagctaaaggatcccagattaacaagccttgggcttaagagaaagcaaacaggaaggcgaatgtgcattatttgtgcattcgagaggagggagtgggtatgtaggcaggcaaagccaatgcacaaaaggaaggctggacatttagggacttgcatccacccagaagccatccatgtcagacaccagtttgacatgtcatattatattccaaagtattctgactgcttgaacacttttgtatattcagcttatttttcagtataatgttgtgatacatccttctacagagttaatatgattaataattgagggactttagagaaggggccagaaatttaattatgctttaaaacgtagcttttggactggaaactgttaacagcgaatacctccctgaaggggaacaaggtatctaaagggcaagatgaaagagacagttttttcattatctatcattttgtatacctttttttgacacagaatttcgctcttgttgcccaggctgtagaacaatggcatgatcttggctcactgcaacctctgtctcccgggttcaagtgattctcctgcctcagcctcccgagtagctgggattacaggcatgcgccaccacgcccggccaatttttttgtatttttagtagagacggggtttctccatgttgatcaggctggtctcaaactcccgacctcaggtgatctgcccacctcggcttcccaaagcgctgggattacaggcatgagccaccgcgcctggcccattttgtatagctttaattttgtaacaggtgtgcaagtatgacctattcaaaatttttaattaaaaatgaatcttaatcataaacaagaaagcataaaaatatgtcattgatatggggtgcttgatatcttgaatgttttaaaggatggcaatgggacctcaaagggaaagatgggatttcttttaatagataaacacacatggtgaatccctcatagctgtagcaaggagattaaaaacatcaaagggcagaacggtaacatcagagctaagaaggcttttctgaaaaccagtcatttggaaccaaaagataaagtattacaaaaagtataatccaagatcagtaggtctgaagaagaagagttagaactagaacatcttacaagaaacaagtaccaggctgggcgcgttggctcacacctgtaatcctagcactttgggaggccaagatggaaggatcatttgaggccaaagtttgaaaccagcctggtcaacatagcaagaccctatctctctctctatatatataaaaataaataaatgaaagaaacaagtacaaaaaaaaaaaaaaccacaaaacatgatttaggcctggcacagtggctcacgcctgtaatcccagcactttgggaggctgaggagggtggatcacgaggtcaggagatcgagaccatcctggctaacatagtgaaaccccatctctactaaaaatacaaaaaattagccaggcatggtggtgggcacctgtagtcccagctactggggaggctgaggcaggagaaaggtgtgaacctgggaggcggagcttgcagtgagccaagatcatgccaccgcactccagcctgggtgacagagcaagactctgtctcaaaaaaaaaaaaaaaaaaaagaaaaacacctgatttagataacttcatgtataatgtcataaaaacaaagctaagattggttggggtatatctggcccaagaataaattcaattattttgattttccacaaagcaaattttttttttttttttgagacagagtctcactctgtcacccaggctggagtgcagtagtgccagctcggctcactggacgctccacctcccaggttcaagcgattctcctgcctcagcctcctgagtagctgggactacagtcgcccgccaccacgtccggctaattttttgtatttttagtggagacgaggtttcaccgtgttagccaggatggtctcgatctcctgacctcatgatctgctcaccttggcctcccaaagtgctgggattacaggcgtgaaccaccgcgcctggcccacaaagcaaatcttgatcaaacactagacaagatgaactgtagggctgacttagactcttccttgagggccaaggatgacactttgaaaataaagaaataaaatatttatttagatgagaatagggggccagatgcggttgctcatgcctgtaatcccaacaatttgggaggccgagggaggtagatcacctgaggttaggagttcaagaccagcctagccaacataatgaaaccctgtctctactgaaaatacaaaaattagccaggcatggtgcagacgcccgtaattccagctactcgggaggctgagggcaggagaattgattgaacccaggaggtgaaggttgcagtgaaccgagatcataccactgcgccccagcctggatgacacagcaagactccatctaaaaaaaaaaaagaagaagaaggagaaggagaataggccaaaaacaacaggcatgatctatatgactgcaaaggttccacatgagtagtcgtcattgtcctaaacacctgctgggtcaccaagagagaaaaacagaggagtaatttgatgccagcctctcccaccagtgacagctaagaacacctcccactactgagggtagctaaactgtctaacaaaaaggtcaaagaagtttgcctatcatctgtgattcagaggaaaacaagaaaagagcattactgtttttttctttcaaatctaggccttaagctaacctgttagaggtcaaataaacaggctccaaaatccccagattaagacctatttgcagtaacaataaatgtaaaagcaccttgtatattgtaaagcattatataaatgtccattattatggtaattattaggggtccgtcatatccaaaattgaactacatcccaccatcagcagtttgggaccatattctggaagagtaaagcaaaaatttttttaaaagagtttgcttgtttttacactgtgtaaaggttttcaaatttttcatctcttcattgaaaagtctaataagaagagctgatcagtagtatatgaccaaaaaagagaaactgttcaacttagttcaatatccttaagaagtgtactaactaggaagagacaaacgcaagcttatgtggaagcgtgtgtagtaaatggtggcgctccttcccattccctccacagatggcttcctgctgagctcagtcagggaggcactggcagaaaactgaacgagagaagccagactatctcttccccttctctcccagccttggccagcatctggacaggcactctttggccccagcttccctagaacaggcccccaaagttccggcttctaagttaccctgccccttgcacttcccctccttcccacagcctagggagaatagaaggttcggttgctaatcttcccctgcattgcctcaccttcccttgaaaggcttctcagctcttccaccatattcacagccagctaattctctggattaaatgccctctggtttaaatgcttagagtgagttctgttttcctgtttggaccctaaatctggcagctaaacaaaaaaaaatgaatttactgcactgagggcaaagaccctggctccaaaactgccaagttcaaggttcactgctatcagtgtgggtccatccagatggagtaatatagaggagtgaagagacagaactgatttcccttttctcccaaaggaacacaggagagaaaatgaatttggagaaaacagagagaaaagggtattataaatttcctgcttcccaatcctcgagacaatatggggaggaggctgctgaaaaagacaaggatgtgactgaagccccccccaccaaaatttgggatgagtcaaagaggggaattgacctgtataaaaaccaaaaacactgaaaagattatagtactcccctcctccaaaaaagaaataaaaataaaatcaataaattcaaatttccccatagtaactatttccatgtttttttttgttttgtttttgagacagagtcttgctctgtcgcccaggatggaatgcagcggcacaatctcggctcactgcaagctccgcctcccgggttcacgccactctcctgcctcagcctccccagtagctgggactacaggcgcccgccaacacgcccggctattttgtatttttagtagagacggggtttcaccgtgttagccaggatggtctctatctcctgacctcgtgatccacccgcctcagcctcccaaagtgctgggattacaggcgtgagccaccgcgcccggccaagtacttccatgtttttaaaaacacagcaacatcctttcctccaaatctatttagtaccactgctttgctgggaccctaaaggcacacacttagtctgcctaccgggtcatccagcaaaaggcctgtgcagcctgccctgaccagagctgagcacagtcagtctctcagggagggaggcgtttgctgccatgggggagcaaggtgctgaggctgagtctcctgaggacccagcagtggtagaactggggtatgaccccttcagagtcccatgtacattcaacgaaaaccggaataacccagattaaccattcacttcattcaaccaacttataataatttttgactgttttaatgaaatttatcatcagagaataaagtttgtgcaccaatacacattttttaaagtggctataaaactgaaataacaatggattgttttttcacatataaaaagatcttcagaaataataatacgggccaggtgtggtggctcacacctgcaaccccaacactgggagtccaaggcaggaggattgcttgagctcaggagttcaagaccagcctgggcaacatagcaagaccccatctcttttatttattttaaaaattaaataaataaataatttttaaaaagaaacctggggctgggctcggtggctcacgcctgtaatcccagcattttgggaggccaaggtgggtggattatctgaggtcaggagttcgagaccagcctggccaacatgatgaaaccccatctctactaaaaacacaaaaattagccaggcctagtggcatgcgcctgtagtcacagctacttgggaggctgtggcaggagaatcgcttgaatccaggaggcagaggttgcagtgagccaagatagcaccactgcattccagcctgggtgacaaagcagcctccgtctcaaaaaaaaaaagaaaaaggaaacctggaacagtataaatcaaaatgttaagagtgactgtctctttaggaatagtatgtgttagaatttatacatatatatttcttttcttttcttttctttctttttacttaagacaggttcttactctgtcatccaggctgacagagtagtgcgatctcagctcactgcaggctcaacctcctgggctcaagcaatcctcctgcctcagcctcctgagtagctgggattataggcattcaccaccacacctggctatttgttttttatttttcgtagagacaaggtctcactatattgcccaggctggtcttgaactcctgggctcaagtgatcctcccgactcagcctcccaaagtgctggggtaacaggtgtgagccaccatgcctggctgtacttttcaataattatgtattacttttgcaataagaagctatatatgggtttttttaaggtaccacaaggataaaagaataccaaaggactttttgtaaatgtcactgaaataggtctgtagtctccacttaacaaatacaccagtaaagtttgagagttttatgtataaattaccagcatatttgtttatgaagacatattactttaaaacacaactttatagctcatttatacaaccccaccacagttagtatgcagctcaaaaaatatttgttgaatagtctagtataaaactttttttttttttttttttgagacagagtctcgctctgttgcccaggctggagtgccgtggtccgatctcggctcactgcaagctccgcctcccaggttcacgccattctcctgcctcagcctcctgagtagctggaactacaggcgcccgccaccacgcccggctaattttttgtatttttaggagatggggtttcaccgtgttagccaggatggtctcgatcccctgacctcatgatccgcctgcctcggcctcccaaagtgctgggattacagccgtgagccaccgcgcctggcctctagtataaaatttttacaaatgatctggatgaagaagaatacagtggagttgttagtttgcatatgacagtaagttcctccagttacacatcagtcacatttgatgttactgtcatctacttaaaactcttaccatggtttctataatagctcatactcatagtcatccttccatctcaatatccagctgatgtctccccgtgatgaagatcctcttcttcctctgagctcgaagctccccatctccaggctctagtcctcagatttctgcattcttctttccacactcatttccttggtgagttaatccataaccatgccgtcacctgtcaccttgatgcatataactgacagtagaaaatgaccttgtttcactgggtgtgggcatatgtgtcactgttgctacatatgtaaggtatctcaatattgcacaacagtaattaatagaattgtgtagtacaactccccaaggaaaagattgcttggaatatttgagaaagagttgttggcacaaatggcaactcctgcctcccctcccccaaaagcaaaccaaataaaaataatacataaatagaaaaaaagtgagcaaagcatgtgtctaaaattctcaggtttatggtgttataccttgtttggggaaggaaggaagaaactatgtaaatgcaataattggcaaacggaagatagagaaaaaaggtcttagagtctacatttttaaaactcacttacatgaacaaagtacacatttttatcaatcacatctttgttttttaatttttctggcagtcagtcccagccagctggattacagccagattactcttgtgtactcagctttaaggcaaacctaactgcctcccttctcttccaatcagatttctccccttaagcttctcctacatagaaattacaacccaccacttaaacccagggtatgttaaatttaggtcctgaaataagctaagagctagcctcagacccaattcacagaacatagagattatagatttttggaattagaagacagcaattttgggctaatttttcatcaatcttcactgaagggtagaactactaaccttaacatctagctaataaatatgtttcagaaaagcaaaacgggagagaaggagatggttaaggagaacagaacttccaaggctcagaaccactaacacctccagaaggggtaaaggaagcatctaatcatatctaggccaataaagctggctgtgctccgggctgactgctttttaggacagtgtgtaaggacactggttccgggacttgccagccaagcagaggggttactataaatatttgttacggaagttactcctcagaaaaggagtgctagccaaactaaaccaagatcaagagccaaggagaatcaactgggctagagaatcagaggggcaaagatagaggcaaagacagagaaaaaaattaagttcagcttctagaaatgataaaagggcaacaaaattaatgggatgcttcagatccagagactgaaattcactctgatcctaccaaacctcaccaggttaaaggtttaccctgaagatataatacgcctgtgtgagtacctgttctttcctctgaacccctgctacttcctggagttcaggttttcttcagatttgacaggcagaaggctgctctatttattagggagatgcttagcggaggctgggagctccaggtgtgctcctctgatcctctgtagcctactcactcattcaattattataagtaacctaagcatctccaggagtgcagccaaacactcttaacactcccctacagctgactgtagtggtacaccctccatgacaccacactgtccaggtttcttccaaccagctggcagctctttctcagtctcttactgacccttccttctctacctgcccctgggttgattgatgatcctcagggatctattctagatttcgttttccactcaactctctctctctctctctctctctctctctctctctctctctctctccatggtaatacctatgcccattgctccaataaccaatttctatgtgccaagaatgaatcaccagtccatttctatcagctttcaaatcatatacctaattgcccacaggatatcttcacttgatggtcttgtaagaactttgaactcaacatccaaacaagacacatgattttcctccaaaatatcttcccacccagtgttctcctactcagcaaaggacactatcatccacataggtgctcagccaaaaacctcagttattcttgaattctccatctccctcactactctccacatctaagccttgctggacatacctccaaaatatgccccaaatctatcttccctactacctctaccctatgcagttcaaaccaccatcatccttcatctggactaattaacaatcccttaacttgtctcccagcatctagtgttgatccactccaacccacactataaaacattcaaaatgcagtactggtaagaatcttaggcggagaaactgaagcagtccctgcccccaggtttggcagtgaaggagctgaaatgaaccagacatgcagatttgaactacattaaaatttttaagttaatttttttaatgcagtgctggcaaagtcaatcctctgcataaaactcttgaatagcttcccattgtgcttaggatgaaatacaaacaactgatcctgaatttcaaggtgccccatggtcaggtccctgcctctcttcagcctcatctcacgtcacatccctcttcctcatcctctacactctagacacactgaacttttgttcctttaatttctctcatctttgcacgttgttccttctgcctgaaactttcttccgacttttcatctgattacctcaaaatcattattagatcacagcacaaaccttcctacttcctttacaaactatgttctcccaaatatgtgtactccaataagactctgtattttctcagtaatatttctgaagcttaatattgctcaaacttcattgtattcatgtgtgtttattcccttatctctacaaaatactgtgtcctcagtgcctagcacagtacatggcataacagactcaataaaagaatgagcgaatgagaaaaaaaatgaatgacaaaatcagggtgggttgagctcctcagggtgaggagagataacaggtggatgctgatggaaacagcatcaaggacaacaagacaagaacctgtcctcccaagtctgacagggccaggtacagtagatgtgtttcaaccacatggttctttcttccttggcaatgggtgcagccagggctgtgacactggtggtgctgaggcaggtacacatgggcacgcagtgcccctgcagctgagtgcacctagccccctgctcagctaggccgcttgctacctaacttatctcaaatgggcccaatcagtccctcctggacacagtaaacaggcctgcctcattccacattcagtcctgcctcagtttatcgaaagtggtgggtgagctgagggcaccctctactcacatgaaggtcttgtgcatcttcacagttgcctacattgtccctcttaagcccccaaaccagtttaacgtagtcctatctgatcatttaatgtctttttaggtactgctcagactctcctgaataaaaactgctcagtctctcagatagcaacccctctcctgcttatctacctgagatggatctggatatatcaggggaaggggacttcatagcagcaggaaaaagttgcaacccttgaggaagtgctcctctagcttcttaagatctccaggccaatgttcctttgcccctgtttgctgcttactctgctggcaaccatggtccagctctgtgctagtataactccagggtctctctcagcctggagatagcctgagtggtaccctctggcagaataaattgcaccatcttcccctggcactattttttctgagtgtggttgtgatacctattgcacccctcagatgcatgcaacagaaacccttcatagtctctgtgccaagggcttccctgttgcacatagggaatgccccacatcttgacctccagggtcagacatctccataaagtctcactgatgtctctttcaaaataacctgtccacggccaggcacagtggctcacatctgtaatcccagcactctgggaggccaaggtgggtggatcgcttgagctcaggagttcaagaccagcctgggcatcatggtgaaacctcatctctacaaaaaacacaaaaattagccaagagtggtggcacatgcttgtggtcccagctacttgggagggtgaggtgggaggatgcagtgagccactgcatcagagcgacagagccagaccttgtcttaaagaaaaaaaaaaaaaatctggccaggcacagtggctcatgcctataaccccagcaatttgggaggctgaggcgggcagatcacctgagatcaggagttggagaccagtctggtcaacatagcgaaaccctgtctctactaaaaatacaaaaacttagctgggtgtcatggtgggcgcctgtaatcccagctactcaggctgaggcacaagaatcgcttgaacctgggaggcggaggctgcaatgagctgagatcgtgccactgcactccagcctgggtgacagagtgcaaaacaacaacaacaacaaatgtccacttaatgtctacatttcttttcctattatctagttctagtcttaccaggctatgtccaggctcagcaagaaagaatgccatgatgaatttaatgatgtctgctatggatagatgataaaggaatcaagccatgaataacgtatttgctgatgtaatctttttcctcaaatccatcaatataaattaatctgccctctttatttgtatctactgaaatcctactcatcatccaagactagatcatagagctcatcctgctctgatttaaccctatttattatttggctatttaatattggtattagtttataaatgttaatagtaaatggaacttatttttgatacttgaagtggcttgaagaatggtggtatcattaacacatagtatgactcattttaaggaacacatgaatggctaattatagaaggtatctggtcctctggctatcagaaaagagatctaagagttctctaaatgtagtattaatgaactctttcggcaaaaaaaaaaaaaaaaaaaaaccaatttgcttaaaccaaagaaaagagcattaaggctggtcattacacctcaacagtaacaggaacatgagatcatttgatatgattctgcatgcagtactgctctatcacatgacacattgtattatagttggccgtatgcagccccagattcccttttctctgcagatcagtgactctttttggaaagaggttcatgctctatcatacaataatattaagaagattaccaacaatctaaaatgcttccttcaactgaggttttgagaaatcacagagaggcaacaacatttttcttgactttactgtatatacaatggaggctcattataataaaaacacaatttcacccactcaaatataaactccaagggagcaaggacattgtctagtgttttcattactgtatctccagtgcctgactcagagtaggtaatctatatatattttactactgaacagttactacttaatcaatattagatgaagataatataatacacagaacaaaagtttaatatttctattctacaacctgtcttttgaaagaggcagtcatctttattccagattcttcctttcctactgtgtcttttgtgcagtgagaacaaaattaagcatgcgatcaaaatggatcatagacataaaagacctaaatgtaaaagctgaaatcataaaacttttagatataggagaaaatgtaggaaaaaaatctttgtgacctggtgtaagggaagatttcttatgcaggatacaaaaaacactagccatacaagaaaaaagcaaaacattagacttcaccaaaatttaaaacttctgctcctcaaaagacactataaagaaaataaaaaggcaagccaccaattaggggaaaatatttttaattcatatactcacaaaggacttgtatccagaatatataaagaactcttaaaactcagtaacaagaagccaaacattccagttttttaaatgggcaaatactttgaatagatttcaccaaatatgagatactggtgacaagaaagcacataaaaagatgctcaatgtcattaaacattaggaaaatgcaaattaaaaccacaatgaggcagcactacacacctactagattttttttttttttttttttttttaagaaactgacaatactaaggccggcacggtggctcatgcctataatcccagcactttgggaggccgaggtgggcagatcacaaggtcagatcgagatcatcctggctaacatggtgaaaccccgtctctactaaaaataaaaaaattagccaggtatggggacgggtacctgtagtcccagctactcaggaggctgaggcaggagaatggcgtgaacccaggaggtggagtttgcagtgagccgagatcatgccactgcactccagcctgggcaacagagcgaaactctgtctcataaaaaaaaaaaaaaagaaagaaagaagaaactgacaatactaagtgctgacaaggatgcaaagcaactggaactctcatataatgctggtaagtggaaaatggtacagactctttggaaaacagtatggcacttctcttttttaaaaatttatcttattttatgaataaatcagtaacttttttttttttttttgagacagggtcatgctttgttacccaggctggagtgcagaagcaagatcatggctcactgcaacctccgcctcctacactcagatgatcctaccacctcagcttcccgagtagctgggactacaggcctgggccaccacacccaactaatttttgtattttttgtagagatggggtttcaccatgttgtccaagctggtctcaaactcctggactcaagcagtctgcctgctttggcctcccaaagtgctgggattacaggcatgagccactgcaccaaactggcagtcttttatttatcaagtaaaacattcacttacaacaggatctaagatttcacttctaggcatttatcttaaaaaaatgcaaacatatgtccacaaagacttaaatgtgagtgttcatagcagcttccaaaaaagtggaaaacagcccaaatatccatcatcagatgaatgaataaacaaactgctgtatgtccatacaatgaattattgctcagcaataaaaatggacttcttttttttttttttttgagacagagtcttgctttgttgtcaggctggagtgcagtggcgccatcttggctcattgcaatctgtctcctgagttcaagagatcctcctgcctcagcctcctgagtagctgggactactggtgtgcaccaccacgcctggctagtttttgtatttttagtcaagacaggatttcaccatgttggccaggctggcctcaaactcctgacctcccatgatctgcccacctcggcatcccaaagtgctgggattataggagtgagccatcgtgcctggccaaactattaatatacataaaaacatgaataaatatcaaaaacagtgtgctgagttaaagaagccaaatgcagaatacatactctgtgactccatttacatgaaactctacaaaacaaatctacagtgatagaaaccagatcagtgtggattgcaatgagtgaggagtaaatgcaaagggtaataaggaaatttgggggcagtggtggggtggtgacagagatgttctacatcttgactgggaagatgattacacaggtatatacatctgctaaaactcactgaattgtacattttaaatgggtacatcttcctgtatataaattatatttcaataaagttgaaaaaagtattttgaaacagttatttaaaagtattttttgttatcaatagtagctggccaacaaatcattatagagattaagcagcccattagtaatataaggttatccttgctccattagccttctgaaacataccggaagaatgagttctctgtccagtggaaatggaggttaatttgttatccaatccacaggagttaaagagtgtgaatatgcacacttctcatcattagcttaagtcgaatttttaaaaatcagaccaagtgctaagaattgaaattaactttttcccaaaaggataatgcttcaaaagatctccattgtgggaaaacaaaacacttcacttcttttttcttcttcttctttttattttattttattttcaagacagggtctcactctgtctcccaggctgagtgtggtggcatgatcatggctcactacagcctcaacctcctagcctcaagccgtcctcccacctcagcctcctgagtaaaaaaaggaagtccctcttcctcccctcctctctctcctttctcaatctctcttatcagagttaatgtctgtcatcagtctgatgagttttttcttttctcttttctttttttttttttttttttgagatggagtctcactctgttgcccaaactggagtgcagtggcaagatcttgactcactgcaatctccatctcccaggttcaagcgattctcctgcctcagcctcccaagcagctaggataacaggcatacaccaccacactcggctaatttttgtatttttagtagagacagggtttcgccatgttggccaggctggtctcgaactcctgacctcaggtgatctgcctgccttggcctctcaaagtgctgggattacaggcgtgagccatcgcgcccagtctgatgtgttttcttccaggcaatttctatatatctcattcttgttttaaaaaatgcatgcatgtgagatataaataggattgtattattcatattattatgtaacttgctttttatgggctgtgattttctgtttcttttgtatcttcttgtcatgcctgattaaaactgtacacatgaaaatcttgccaaaggtgaagtctaggaatagggagggactccgttaatctcactattatatagcccattaattactcataataggatggatttaggctctcattcagctgaacaatgaggatcctaaagaatgctaacacaaggttagcctgaaaagttctaagagatagggagaaggttcttaaacagggaaatctcaggacgaaaacaatgttccaagaagaataaaatggcaacagtatatataatatagaacagaattagacagcaaggagactagttaagtggctaatacagaatagtaaattagaagaaatgagattctggattacagtggtggccagtagaatggagagaagctttcattgaattctaacaaggcagacttgtagagtggaagaaacaaaagatttgaactagaagagctagatttgaatcccagctctgaaatttactagctgtgtgacctctggcaagacacttcttccgtatctcagcttccctttcaataaaaggaacaccttgaaatatcagagcctttaactttttttttttaacagcagaactgtttttttttttccgttaaaaagaaaatcttcaaggaagccagtacgtttaatttgtaaaacaaataaaagcaagattgttctggttgaagcataggtaaaagggctcagagccccagctagccttcatttcacccttctcagccacttctgaggcatccttcagaaatctccagagggctgaggaacaaagtttgagaaatctctaaagactttactatcaactctattatcaattacttgagggggtaaaattgacagaggtgcctagaaaaataataatgaatttaatagtgccacagaatcatatgacagaaaaagggcgaattgacttttcctaaatctgcctgcttctccttgcaggttgaacccaatttaatgtctaaaacctcatccgacccttgtgcaaacggtcatctaacctctatatgaacaatatggccaaaatttactgcctaacaattcagttcattccactttggggtcctcaaatgagtcaaaatttccttatcaagccaaaatttgtcctccatcactaaataaaagttcttaatctatcttctggaactaaaccagtaaatctaattgctccttcatcatgacagtccttcaattgtctgaggagagctatcatgtctgccttatttccttgtattctcccttgctcttgctctggcatgacatgaatataccatggaggcagcctgctcctgttttggatcaagttgaattttttttttcaacagaatctcacactgatctcggctcactgcaacctctgcctcaggttcaagtgattctcctgcctcagctgggatgacaggcatgtgccaacatgcctggataattttttgtatttttggtagagatggggggttttaccatgttgaccaggctggtctcaaactcctgacctcaagtgatctgcctgcctcggcctcccaaagtgctgggattacaggtgtgagccaccacacccagtcagagtcagtattttaaagcatctaagtgcaagtaggttttcatttatttgtggctttaaggaaacttaatttaatcaagccagatgatcctcctttaaaaaatgactagctttgataactaagtgtaaatagaacccaaattcattatttggttgtttttgtttttttggggttttttgtttgtttgtttgtttgtttgagacagggtcttgctctgtcacccaagctgaagtgcagtggcacaatcatggctcactgcagcatcgacctcccaggctcaagtgattctctcacctgagcctcccaagtagccgagactacgggagtgcaccaccacacctggctaatttctgtattcttttttgtagagacagggttttgtcatgttacccaggcaggtcttgaactcctggactcaagcactccatctgcctcatgttcccaaagtgctgggattacaggcatgagccatgcacctggccctaaaaatattcttttcttactgaacattagctgcttccagtgtactagaagtagattgccaaaccttttggcccaaagcaaattgtaaagacatttagctagggatgcaaaaacatctaagactcaaggtccagtgaagcaggcataaataacataataaataaagagaagcatcctgattccaaaacttgcatctaacaaccaactcccagggaaatgtagttctcatgattacaaattcaattatcaccaaaatgacatgaaatatcaatgctagaaggaaagcttcattcatcattccttatcctacccaccccataaatctactaccaggtctgtgaaatcaggatctgtggcttgggcctcagtctctgccagtctgggtagttttggggatggggaaaaggaagtatggctgagtccctaaggagaaagcaagccagcataatcacagtccatgatgcttgtgggagcactgagcctgtacagtttcctgtgctccagttgtcttggtaacctgaggcctccttatttgtgttggcatcatggggccaaaagcggaagcaaagctggaacaccaggaagacttgcaggagaaaaaaatgtagataatgcagcagttatgccacaggagggtcaagcctagggcagaattacctggttgggggtgggaaggtagtgtcttgtaaaaatcagatctctgggttctaccttcagcgtttctgattcagtaggtctaggataagctcaggaacctgcaattttaagaagctaccacctaccaagtaagtcaaagaccacacttttaaaattccagctacaaatcagcagttgggaagagaaagtataaccatttaatcaatttcaaaaagctgatattctagtacagtaattctatacactggagtagagggtatattttgtcttccaggaacatttggcaggatttggagacattttggttgtcacatctgagataatatcattggcatctactgagcagatgctaagcatcctacgatgcacaggacagccccccacaacaaaggattatcctccaaaatgttaacagtgtcactgagaaactctattcatgaggatattctgctctcccaacaatggccccccaccccgcccatcagccccaatccattggaaatcagtgctacacagtttaggtcacaatgcagagacttatgcgagatcccctgaaaaacttttgagaccccagaaatcttttttaaaatggtgaatttcattaaagagatagaaaaggagaagattagaactgacaataaaggaaagtaagtatgggcaacaagggtgaaccaaaaaagggatcaaaggaggctgaggcgctgagtgacagcagcgggaaatcaatgctgcccctcagtggacgcagcccatttgtaaagagatgataaacccatgaaaaataacaggcacaaaaaatgaaaaaaaaaaaaaaggaaaaatgaataaaggaactgtgtagaaatagctttaggattcatcaagtgtagatctggatgaaaaaaggacattagagattcttctacaaaaggatgcttaaataaaaattctccagcaaagacgacaggacttctagaaggagatcaataattatatcagaaaggaaaaaaattttaagtatttacaaccctctactcctaatcacccccaagataggtgggtccagaaaaatgcaccttggttttactgaggagagatcatgagagggaagggaaagtggagaagcaatttcagtttcatagcaaagaattctttttttttttttttttttttttttttttttttggagacagggtctccctctgtcacccaggctggagtgcagtgcagtgatgcaatctcggctcactggagcctcagcctcccaggttccagtgattctcccatcccagcctccagagtagctgggattacaggaacgcgccaccacacccagctaatttttgtatttttagagacagggtttcaccatgttggccaggctggtctcaaactcctggtctcaagcaatctgcctgcctcggcctccccaaatgttgggattacaggtgtgagccactgtgcccagtccatcatctattgtctgtaataatttagaaatctggcaccaggattatgaaattcactatacagtgtgtggcataacaccaagcttaaatggtcactcagtggacttcacaataatggccactttatgcttctggatgcaaaacgttgggagagtttgaagtggatatgaatttgagaatgcgttttcttgtaggaaaagtaatggaaacataagcatctttttctaatcacaggaaaggttaaggctttggtgaaagcaagcataactgagtttaaaaacagtctagaataagaaaagggtaatagaagaggaaggaaggcagaagtggaccatgcagaataaacaatcaagcctagcttttttaaaaacctgaggtcttactaaagagaaaggaggaaaaacggaagatttcaacataagagtgttaaaggtggaaaagagccagaaaggactgtgggcttaaaaaaaaaaaatcagtgaagcagtagtggtgtatgttggcaaagagaagtgtagagttgagaggagggagagaatttatagtagaggaagtcggtgtgaagttttcctctcaagatgcccagcagagcaaagaaggaatgaaggcaaaggccactgggaatagagtagggctggggctaaaacagcacgggagagtgcaacagggcccaaagtaagacattttcttttcttttcttttttttttcattaattgacccagatttgcttgtttgggaccaaaggcaatgcagagtttagggatctttataatttataaagtaatcacctttggcccaacataacacagatcataaggatcatggcagaattcgtctctgagacaagtacaaaataccattttagagttgattttagaagagaagtcagactaataaattgctgtgttgtagaaatactatggtgaattaaacagctttaactttttctatcagccacaggataaatacagaaactgtataattacatacacatccacagaagatagtagcctcatatgctaaaattgtgagttgtttgtctgtatactgtagtccaaagctcccattccaagaaatgttttatttggttcaaaatataaagggcaggttagagggctacacagaaaaaaggctaaaaataaagacagtaaaatgagggagaggaaaagtggaagtgcagcactactgatccagaaaaactgaggcatcagccacaaagaattcaatcaagtcagtgaggggcaaatggcacaaaagccaaacaagaaaaaggctgaataccatattaccaatctgagagcctcacttttggttttaagtcaaatattgaattagattgtgcaacttttctatttttatttttttatttttaaaaatccaccaaaattacttaaatcatttgacagagtcatacaattttaaatgactataaaaatgtgcagatcagtgccaaattttttggcaaaggctgaatggcagacagtaatccaagacgcagacaaccttgcttttaagccatccgttacacagagaccagcaggctcccttctacctgtgagaccaaataatcccaaaatgtaaccaaataatcataactccccctactcctaaaacctacccttcacccttcactgtctacgtcagcctctggacagacctgatgcctggggtttggccatttccgccttcccaccctgtgttggtctccctcctccctcctcaggtccctcagttctcccaggcctaacttggcgtgcttccttcctctctcaccccaatcaatccggctctccttccctttctgggttacgccacctgcccgactcccggtttccccctcgggggcccctccttgccctggggtctgctctcggcccgccaagttctcccaggggatccctccccacctgcctccatacagtcagactgtgttcagtgtccgtttcgcgcccgtagcgacaccacgacagaagcccactaagtgaccctctgctcccagaaaccctcctggctcctccagaccctccggggctctggcccgcagctcccctctccctccggcggcgggggtcggctgtgactcaccagagggccagcggccggggttggggtgggggggccggaatgctctcacttcctctccgcgcacctgccccgaggctggagcgccgcccggccgggcctccggcggatgttttccttgttcccaagcgtgtagtgcgcgccagccgccccctccgggacctgcgcgccagccaccgcgcccccaggacccagcgggcctggtcctcaccactcaccccctccccagcaggcacgcatgcgggctcgacccacacctctgcaccgccccccaacttctgggagaggactcctggctcagcccagcctctagctttccagaagcccctatatgcctacctcatcttcgttataggcgatgaaccttcacttctgtccccgtttccgcacacgcaccaatccccactggcgatcccttccccttcggcatcacccccaccttcatgcgccccagctccccactcacatccgccccctattgggctggctctagcttgcaagagcagaaggtggcccagggcccagccttccaggatgtcccctggaccccctctctgggaaaggcggcagagctactggccactgacaagacctttgggccctcgtgctagacaggccttcgaatccacctgctccagcccagagagcaggcccaggccgtgcctcccacaccgcagccgacctcagagcaccctgcctcaactgtgagttttttcttggcaatcctctgaaacggaaagggtatcagtcctgactagggcgaacgtgaggtccattctgcatctccatccaccttagctgtctccttggaaaaggacagcaagggagtttgaggtgcactgacacagtcatttctgaacagtgaagagatgacaggtagggtggtcccccttgaaaagtcagccagaagtagctgtatctgatgcactaggtggcagggagtgagtcttggagtaaatgggactgaaaacgtagaaaaaccaaataaatgccaaagagactatccctatggagaatacctagaacatgggtctttgaagtgtggaaaaatgaaagaaatccaatttgaccagggcctttagtgccaaagagatggctagcaggagagtggtgagaaaggagaactggagagttcacatgagcggaaataggaagaaatggatccaaatccaagtgagaaaaagcaggagacttaaagttagcctggcaggatgatgagaaaaggacatcttgtcctagggtagaggcgagggtgcagatctgggggaagaaggcttattgggaacagtttctcaaactagacattcagaagtcaatacaagggccaaaaccaaaatgttcctggaggtacctgtttttgaaagaggtgggaaaggtgacatggattaggggtctccatcccccaggccacaggccagtaccagtctgtggcctgttaggaagcgggagcacaaagcaggaggtgggcggcaggcgagtgagcattaccgcctgagctcctcctcctggcagatcagcagaggcattagattctcacaggagtgcaaaccccactgtgaactccgcatgcaagggatctagattgcacactccttatgagaatctaatgcctgatgatctgagatgaaacagtttcatcccaaaatcatctccccgctgctatccccctccatccactggtggaaaaattgttttccacaaaaccggtccctggtaccaaaaaggttggggactgctgacaaggagtatgagtgtgaaaggtgcagaggtctatgccaggagacagccatccccaatagaagccctcagctatgcacaaactgcttaatgtcattcaaagaaaataatgtcgcccattttgcctcagagctttagccccaatcacagcaactgctatttcctgacgcttacgcaccagagatggtgataagagcactgcacgcattatctcagtaatcctcataacagcccaatgagttggcattactatccccaatttatagatgaggaaacaggctcagagaggtgaagtaatctgaccaggttacatagctaagtggagtcaggatctgaatccaagaagactgtctctacagcccatgctctcaataatccatcctgggctcctccagaacctgtgggaaactcagaggatgccaaatgataaattcctaaaaacctcactccattatatatgggaggaaagagaggacacctctgtgaacctggagtgattcatcccatcagggcacttagagatgctcctctttgaaaggggaaagaaccatccccagatgtggggtgatcccacatctgctgtatgtttgaaggtgataagcaatggacagttcacctctggaatgcctgaggaaaagagaccctccccaccatctctgaggggcagccctatttcttggatacattagggaaaccctgccctaggatctgagggaaacacagtctccactccaggtgcctgctcactctcctggagcttctggccgtcgcaccctattgcagctcctgggtttggctggggcacaggattaaccatccccaggaaatgcctccctccggtccaggcagggatcccagcatacacacccctggtggtggcagtgggggagaaagggggaaggtggaatgcttccttctctccaggtcagggaagagatctggggaccacctgggggccctcgcccctcctgcctccttgctggggaagtgcccagtccagtgccccctccatggccacctccctccctctagctgtgccggggcatgaatcagctctcacagcttgttaaagctagacctcttgttttcatgccctcacctcaggaaacagagttacaacttttccagctctactcagcagggggccagggtcctcactttataaacatccccagcctgtgagagcagagggcagggagatagtgtgagacaggagcccaggggagaaagacagaaactaagactcaaggagcaacgcaaagcaaagtcaaggagtcaagaccagagtagctgagcagaggccaagaagggtctgagagggctgtgcagcagcaatggccctaaggatgctctgggctggacaggccaaggggatcctaggaggctgggggatcatctgcttggtgatgtctctactcctccagcacccaggagtctacagcaagtgctacttccaagctcaaggtaaagtggggtgaagcgttaggaatggaggagcagcagagagggcacagggaggatggggccttacagatgatcccgtgtcaaaatacccaggcttcctccagctgtgaaacaggaaagacaaactaaatacggggatagtgcgtacttactgtctccaccccagaccagaagagcctctgcctctcatcagcactcctacacctactaacatttcccgttcttccctagccccctgtcactatgaggggaaatattttaccctgggtgagtcttggctccgcaaggactgtttccattgcacctgtctgcatcctgttggcgtgggctgctgtgacacgtgagtgaccaaagatggccagagagaatgactctgatatgagtgactgagggatgaccagggagtgactagattgctgtgatgtaagaatgaacagaagagcaatacaagatgggccaaacctgaagggaccaacactagtgtgaaagataaggcttcaggctataaatcaggggaggttggggtggacctggagagaaaatactcctgttataaaacaaaaaggcccacatatggtaggtgacagcttagttaggaggaccaaggggccactgaaaggggctctgtggggggaaaactgtgagagagggaacatgtgggcagggataaaggcagcctttcactgtgctgactccttcccctatccttggttccccaggtcccagcatcccatcgacttcccggctgggtgtgaggtacgtcaggaggcaggaacctgccagttctccttggtgcaaaaatctgaccctcggctgccctgcaaagggggagggcctgacccagaatggggctcagccaacacccctgttcctggggctcctgctccccactccagctaaactcaactgatcatccatctgctgactgctcactgctgctgccacttccagggaaaccactagcagctgccaatgtattctgaacaaataaattaatgctatagctgaaagcccgactctcactgtccacgacattggaccccaggtggaaaaagtgggtcccattagagtccaggtgctgagttctcagtatccggaaggaactagcaccagggtgggccagtttcagatggttatggtgctggtgctggggcctggggcagcatatgaggccagggtggggctagtaggcagcaccttgatgggcaggtcccagctgaaggtgtctacaggtacttgctcaggtcctgtccaggtggtaggttcgggctgttccacagggggtaggagtaccaatcctggttctcgggacgttacaaattcaaaatgcaatctccacttcaaggacactatggaagaaaaagattaaggtagaagcatcagaagctagcaggagtaaaagccaatgacaggatatagttagtgaatgagaagaaaacaatctgtgttcaggaagacagggaaaagtcacagggcagggagctgtgattaagggtttttctgaagcaatgggtactaccacagatgtgagctgaagatagcagtattaagtacctaataacctaagagtgaggcagtcaagtctaggtagcatgaagtaatcaaaaatcagtgtatcacagggtcctagtaggtaggtgtggggaaggagttctatcaagctgttaggagtttaggggtcagtgcatctaagaaacaggaagaggttgaaggtctgagaaactgttccgggtcagaggctagacgtgggtatgtctgggagtgtgtataaggaatcaggatccattacaccctcccttagcacagcattttactgtccccctctcccttctccagtaacagtgagggtctcaccaatggctgtacagaagcctggggtggagctgagagggattgggagggagaagctggttctagttgtatgtaggcaggattcctggtgccgggcgtgagtcacatgtgacacagaggggacaccccctgccccacgtcgccgctggtactcaggctgtacacgctcctcggtctgtaagctgactgaaaactgggagcaagagacaggtgtgtgctaacaggaagtgctgtctgtaggtgagaggacagcccaacctcaagctgttttacaaagggaccctggatgaccccactatccccttctacatgccacccctctttatacaggccttccaccctagcccttcaaccccagcaccccagcaggtaagaagctctgctcccttcttacctgcaaacaagctacggttccttcccctaagtttaaggtccccaccacgtcctcgccaagtctgtacacagatttgaagatgccaaacgtcccaactttccctcggccatcactgatattgtatagatctggggagaataggacactataagcctggagtctacatactggataacgtctaggactgggcaccacaggccaaaagatggggcttttctttaaaattggaggtgtcaggtatcagtggatccacagaagtgtgtggtggttaggagactgtctctgagatgggaaaacaatgaggggaaggatggggtaggacaattctgaaagaattctcacggaggctgcggcaggatgtggcagccattaggcgttccccagccagctcagctagccatgaatctttcttcccaccttcatcctcctccaagaatggactggatggggctacagcctcatcctggggaaaccggacatcctgaaggcctagagaaagaatgagtggagaggtaatgctgagagggaacggagatgagagtagaggttagggttttagattctaacatgagatggctaaaggtaaggggtgccagggctgaggtttacatctctatctccagaaccctccctcccttcccaactccctagcactgtcactgagaccaggaagtttccctgcagtccctcttgcaagccctctaagacaatttctgctttggcatcgcccttccccagcccttccctccaggagcccttgcttaccagtcagcacaagaaccctcagagggactctgagtaaagtgataggggagttgacacgctggcagccaatggtcagtttgtagacgtacttgactgactgaccccgaaaggagggtggtccctctatgggcagcacttcactgtaggagtctggttgggaagtagttgtcaggacagccagaggcaccagaggagtcctccctccaggagacttagaaggcaattcagggatggggacaatcactcacatgatttggactctccaggatcaagcctcaggtcacagaatagaattttcggtggagtagaaaggatacactggcccctctcacctgaaaaaggtaaaaatgactaatttaatgacccattgtccagtactgaacaagactagcacggcaagtggagatagtgaaaggctgccaggccctccgtccctgctgtgaaatgggaatagtcttctacccctaaagcaatagtcatgctccccaacatccccagcatgacagggactataagaacaagaacaattaacaacttcacccatgggtgacaatgcctccacacacaccctccgcaccccccctctcccaggcaaatgcccctctctaacctcggtgtggcagaaagacagtctggctgtcgggctggacatctggctgactagagtcaggaggaggcagtgctactcgactctcactggcatggaactggcagtggatttgggcactggcccaggccagggcctcactgtgggaaaaggaaaaggaggcatcagaggtagttcctgacctcacaaatgctttcccaagctccctatcacaccatcttaaccaacaaggttagatggctgtcctagtgatcaggaaatccacaatcccaaagagaaaccattaaataaagagtagcagactgtgcgtaaaaaggggaacgggggaggggaaggaaagcgtacagctatgtcatccacatcttctgttaaagagccctctcctacaatgacagcacagtgagcaagaggaggtggtgtcgctacaggacaacctgagctctgcctcagccccagagataatctggcttcttcccagaagggccaccaccttcagtgccagcatccccacctggatgcagaagtggccgtgggcggaagggggttggtgacggtcactacacactccagcgcctccccagccaaaaatacaggaccccggctgagctctgctaccacttcaatcatggcagctccggaatcagatctagaaggaaacaaggcggggcggaggtcagcaccttgacagggaggggcgttgcggtgagcacctagggctgagggctgaggacaggggtggtcagcaccgtggtgcccgagggagctcctggatataggaggggtaggcgggtgggagggaggcgactgaagactcagtactgcccagggggaggacatcgctctgggccctagaccccagcccctgtgcgacgggttcttctccctgggcacccccgcggagttcccaaactggcctccgctccccctttcctcaaagttccacgtcccagcccaagatcaccgccgctagtcacctcgcatagtcgacactagggatcggcacccctaggcctcatctgcccgcccctcagggacctggctaggtacgcggcggcggcggcggcggcggcgtccgctgggcggtagaggcgggacttcccttcggtcccccaccctccgcggagtcccttccggccggaagcgcccggcaggccagaccggaaagggctcgggtcatcccggcgcccagggtcaccttcccacgggctggcacctgggcgcgggcgctgccccggagccggccggcgggacctggcgcccaatcctgggggacccggtgccgtggcccaggggccgggccgaggtcccgggggcggtgccttgcgggcccgtcccggggcggtgcctggtgggctggccccgcggctcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtgagtagaccccattgcctagaatgcctttggcttcactttgttccagctcaaaacttctagcagaggtgggaaagggcaagaaagcagttgggcttcttgtctgagtgaagcggtccctatccctggcatattttaggcctgtggttttggaccgtgagaccaggtcacatctctttgcaacacccttccctcccagtgttttgtcttttcagaaggaaagggtaggaacatttggtcatgcaatcagcctttcccattcaggctcttctcacatactggtttccaatgacttccctttgggattagctatactttgtggcaaggtaggaaaggataatctggctgctgtgatactaacacaatgttgttttatttgggggtgggggggtctcaaccccttatttcccacaagcagctggggcattctctgtacctcattagacacactgttagagtcccaacactactgcttctttcttcaagctttagctccagggagtaggtaagaagagcctccctgccctcacctctgaagtgatgagaaggtgctgtcattctgttctgggatagagagctcttgatattaagtcatttatcagagaggcactgccatagatgtagaacccatctagatccccactgagttcaaagactagtgatgaggagccagacccattaacaggaacaggtggatgtgaggacagaaagcatcaccctgaggtcatcctgactcagtctacacaatacacacagaactgtggagggaggcataaagcttgggaaaccctgcccttacagtttctagagtaggagacccttcatttccccagtcagtgctgtggggctgtgatggggagatcagttatctaaccctagccctggggagtgggaagggcctgatgctgcctgcacatctggctttgttggtgcctgtgggtagcctgtagcagagaagaatcatccctccaggctgcttctggaatcaattcagtccaagtttgaccccaaaagtttttgcatcaaaataggatctagtgtacatagagaagtacactgagttgcatgtggtaggaacaatgagatcaagaaaagatgggcatcctagcctcttagcccttaaatatgaactgagtcatagaggcctgaagctgtgctcaaccccctggaccctggctccccattccaggatagagtggggggtactgatacaaggcttttggaataggatgagttcctatgaggagaaagcacaggtgagacaagaattctaagtgataactcttgagttgaggttgaaattgtggagaaggccaaataggtcaggaatggccagctaccatattaagggagtaagagagctcctaagatggagctgaactgtgggcactctgaccaggagctctagcaagacagaattctctgggtcttaccttcgtaagaactcaatttcaattgttctcccttccagccagagtccactcattcaataaatatttattgagtgcttgttccatgccagatagtcctttgttctgtctgtcctcatagattgcagttactctccctggttgccctaatcctcggccacaccctccctctaccagtcctttctggtctctagtttcaaagtccggttttctctaagctggcagagaggattctctgccttcctgtcatcccatcctttgtcttccctcttctttccacccctagaatgtgctgtccctttttattttattattattttttttttgagacagtcttgctcttgtcacccaggctggagtacaatggtgcaatctcagctcagtgcaacctccgtctcctgggttcaagcgattctcctgcctcagcctcctgagtagctgggattgcaggtgcctgccaccacagctggctaatgtttttgtatttttagtagagacggggtttcaccacattggccaggctggtcttgaactcctgacctcacgtgatccgcccacctcggcctctcaaagtgctgggattacaggtgtgagccaccgtgcctggccgctgtccctattcattaatcacatttcttctcctctgctccagtctgttatctctcttgtgccccatcatttgtatgttcattcatctgtaaaattggcaaatatgcattgactgcagaccatatgtcctaccctgtgcttggacctgagggtaatattcagctagtctttgtcattgtccctttccccaaggaacttaaaagtatgtcagcctcacatgaggaacattgaaataacaaggcaatgtctgattaggaattgagataacagtttgtatatatgagtaataatcatacctgtactttatggctttcttatctattatgtcatttgatctttcaaccatttcattagatagctagagcaggtggtatccccattttgtagatgaggaaactgggacttaggggttacttacccaattatttggttagaagtggtgtgactgaacagtaggcataatgtggcagtaggcaggagagtggaaatgggaaagagtctggcagggcaggggctacttagtgaggacccatctggaatgagaatttgtaggaaataagattagaagataggctgggacagatgtcagagccttgaaaacagaatcgtttgcctattgaaaacagcctcaatcatttgcctcttggatatagggctgtaccaagcccaggaaaatgttgggattttttgaaggctttaccaagagcaaaatcagaaagcttcacagtttaaatgttgaatttaaaaaaaaaaaaaaaaaaggcttgagaggaaatgtccagaaataaatataaacactgattgtctatgggtgagattatttttttccccctttcacctttcataattagaaagaaaaatgatcattttaaaaagaagaaaggccagaagcggtagctcacgcctctaatcccagcactttgggaggccgaggcgggcggatcacctgaggtcaggagttcaagaccagcctggctaacatggtgaaaccccatctctactaaaaacacaaaaaaatgtgccaggcatggtggcgggcacctgtaatcccagctacttgggaggctgaggcagaagaatttcttgaacttgggaggcggagtttgcagtgagccaagaccgagccactgcactccagcctggacaacaaggaacgaaactctgtctcaaaaaaaaaataataaataataaaaataaagataagaaagttattcccagcagcctatgcctgttttggaggtaggggattgggggcggaggctgtaggccaggaaaccataaatggtcctttcagcacgtcagacagaagctcctgatgttggaaataaagcagtggtggtggtgctagagaggtaaggagagatcagaaagccccttctgaggagaacaaaggagagaaacaaagccactccttcacttcagctggggtgactgggaagatgaagggaccttgaactgtatagaaatcaagaggaagaaaggtttgaaagcagatgtccttgggacatttaatgggaggtcacagagagaggcaggtgactcagcctgtgaacagctgcccacctgcccccttccactcacattgcctcttgctcctcaggtacctgcagtggtggtaccggaagacccatgtggaaaagaagacacctttcatcgacatgatcaattctgtacccctaagacagatttatggtgagccccaccccatctctgctctgctcagagaaggcctagcctccaggtctaccacagttaggaagagacttccagcttatgcaaattgcactgttccatcccctaggttttcagaggaaccaggctttatagtctagaaagttagaaatgggcttattttcctctcccaataccccactaaccaccctgatttctctaggttgtcccttgggtggcatcgggggaggcactattacccgtggctggagaggccagttctgtcgttggcagcttaaccctggaatgtatcagcaccggacagtcatcgctgaccaagtaagagccaggaggtggagaggccaggacaatacctccccaggccaagaaggaaggacctcttggctagtgtagaaggtagcagttagatgtgaataagattcaatctaataagtactctcgggatgcttcctgtgtgcccagccctgagctaggatataccgtaggaataagacacacacaagcacacattccttgaaagagtaaacagatctggcatttctctagtaaatgcctcctgtctacctcactgccccaacccaactagctgaggcagcccccaaccacagagaatgcagagaattcccaaatcacttaacctgcctgaaagaacattttgtaggactggaagggaaaagaaaacccaaagtctataaactcatgggaaaaaaagacacgtagtacaaggttcctcaccctgattgaggaaccttcaccaaagttcagctcctctgctgatcactcccctggaggtctcctggcttagggtctaaaaagctccttctctcccaggcttagatctctagccttcttccctcttctgaagcttcacttttttccttttgctcctgcatcacatctgggccttaaattgccagaagtatgtgtcctgcctctcatcatctctctctagttgaccgcccctttagagttgcctaggaagttcctctttcttggctccagcattcagcctcatcttcaaaggaaaaatgactagcaaatctttagtccaattaatgacaatacccttcctggttcacgtttaccagccctgcccatgtcccaagatccctctctgcctcatcccttaggtatcctgaggggaatggcttccagaattgtgactctacaattaaagtaattattgcatgcttaacatgtgctagacactgtgctaggctctttgtatactgtttaatattaaaaacaatcctacaagggaagtaccactattatgctcattttgcagatgaggacactaagatccagagaggtttagtaacatgcgcaaggtcacaaggttggtaaatggaaaggttgggattcagaaccatttctttctggggtgaagagcttgtggtcttaaccattatgtaccattccaacaaaatgaaaaattattttatacagttgtccctcagtatccatggggggttgggcccaggacctgctatccgaggatgctcaagtctttgatttgaaatggcttatagtatttgcaaataaccattgcacatcctcctatatactttaaatcatctgtagattacttataatacctcatacattgttacataaacccttgttgtgccgtacagtaaataaagtgtgtacatattcggtacagacacaactttttttccacatattttagatttggttggttgaatccactgatgtggaactcacagatatggagagcccactgtatacaataaaaatatttgacatagtttgaaccagggaaagggatattaatccctcatagctcctaccctccaagagctaaaactttttttgagaaaataagacttaggggaaatggagactgtgagaccacatcagtgctaaaaggagaggggtggatagtatactgtggaaaaagggacggtgctgcagatttcgctcattccctccacatacatgccaactctgaagaagggtgcatcagtgaattaaaaaatgtccctaccctcagaagaatccatacagcagtcagggacacagaatggtcagtcaatacattataacataatacaccaaatgctagaatagaaggggaggggggcacacataatgactcactgctggaagaagtagaggaggaagagatggcttttgacctaggctttgaaggatgagaggtttcaccagatagcgaacaagcatgagcacaggcatggaggagagaatgtagtgtgctcaaggaacagtgagtgtttttatatgaacagactataggtgcttgaacaggtgatgagtctgatgggcagggagaggccagctcaagaagggccttgaaagccaggcaagagttgagactttagcctgagggccatggggagtcactgaaacatcctaaccaaggactgacatatcttgatttgcctgtgagaaagatcactctgctacccagatgaaaagggccacagaaaaagcaggagattgggcttaagtgaggtgctaacaccaccgtagtggagaagggagagaaagcttgggagatagatggatggggaggtagcaggacttggtgattcactgagcctgggggatgacttgaagctgatggtgcagtggtaacagttgcaggctctgaaaggggaggagctgatttgaggagagggaagacttagtctgtggtccctgtggtttaccccgttccagcctatctgccctcttaagttcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggtgaggcccccacatctgtatcttccattgccctcccttccccaggacctgcctctgctagaaactgcatggcctgcgaggcgcggtagctcacgcctgtaatcccaacactttgggaggccaaggcaggcggatcatgagatcaggagatcgagaccatcctggctaacacgtgaaaccccatatctactaaaaatacaaaaaaaaaaattagctgggcgttgtggcaggcacctgtagtcccagctactcgggaggctgaggcaggataatggtgtgaacccgggaggcggagcttgcagtgagccgagattgcgccaccgcaccccccaaaaaaaaaaaaaaagaaactgcatggcctgtgaaagggaggttggagccatgaacatcacactggcttcccagaaccaccgcccaactggttctggtcttctatattccctgctaggcagcttgcctgggaatatggggagatgcaagtggacaaaagaagagtacactggggagtatttgagtcaggtcctctgtgtgcccaggactgatcctagcagagtggggtcaggaggcgctctactgggaccgtctgagtctaatcttctgcccccaggacagcagcctgcctgtaggagtctttgtgtgggatgtggaaaatgaaggggacgaagctctagatgtgtccatcatgttctccatgcggaatggactgggtggtggagacgatgccccagggggtttgtggaatgagcccttctgtctggagcgtagcggggaaactgtccgggggctgctcctgcatcatccaacccttccaaacccctacacgatggctgtggctgcacgagtcacggtaaggaaagagcctgccctataccttagcccctgaaccccacctccaccccagcatggtctcttcatccaccctcatcatactcctgtaagcccctgggcctgggaggttaagagtaagtaagaggagctggggagctagccgggacccagtgtactcgtggagcctgccctcacagtccctgaccccttcacaggcagctaccacggtaacccacatcacagcctttgaccctgacagcacggggcagcaggtgtggcaggatctacttcaggatggacagctggactctcccactggtgatggggggtctgactgggagatggtgggaagagaggttgtccctgtcttgggaccaggggtgggaggcctggtaataagtaggccttgtttccatgttagggatccctatccctggggctgaaggggctcctgtcctgaattctcttgtgtttctctcaggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggtgaggggaccaagaaagtgtaaggatccagagtgctggggctctgacctggggcttgtgttcatccttccccttcccaccccaggcggtatacaaggttctttggccaggatggagatgcagcacctgccctcagccactatgcactgtgccgatacgcagagtgggaagagaggatctcagcttggcagagcccggtattggatgacaggtgccagtggggcccatttcttgcctttctcctgggcactcactccaaatgggactcctcgatttactctccacccaccaaagtcagtagacttgcactgggattcatttgatgatcccactctgctgaacccccaaatcctttccatcttgggaggtacatgttccttaaaccatttcctcctcctcgcttcccagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggtacaggatgctggtgggctgggatatggcaggccatccccaagtcaggatgatggatttgcctaccccagggtattggttaggatgagggggtgttgggtgtggactagtaacaatgccccacctctaaatctagaggacaagctacagaggggtttgaaggggaagcaggaattctggcaacagtgtgtctcattcattcctccaggccaggagtaccgcatgtacaacacatatgatgtccacttttatgcttcctttgccctcatcatgctctggcccaaacttgagctcagcctacagtatgacatgggtgaggatcccttttgtgccgcttctgccctcttggctccccatacccccgaacttctgtggtccctcagattgtctcttctttcccttcccttcatacgtatctgcatgctgcttactggttccccactgcagtcacacacatagctgtgtgcccctcctcaggcatgcccattccctgcctcccttctgtgtctctcccccagctctggccactctcagggaggacctgacacggcgacggtacctgatgagtggggtgatggcacctgtgaaaaggaggaacgtcatcccccatgatattggggacccaggtaaaagtccaccccaaggtcagcttccctccctcaacttttgcaccctctaccctatccaccaatgcaagtgacccaagtcccctcctctcccacagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagtaagggatgcacatgcagtggccagtgtgccaggggtatggttggtgtctgggaagagcctagctggttgttgcctttcctcggtacctaggtcttcaacatcttggtccctctctaggctgtgatggaatctgaaatgaagtttgacaaggaccatgatggactcattgaaaatggaggctatgcagaccagacctatgatggatgggtgaccacaggccccaggttagcgggtaggggtttccaggaggcctgaggtgagaaactgggcaacaagggattgtagggctcaagaaagaatgactcattgtctattacacggcatgggagcagctggagctgccagtctgacccccaaacccatgtccctgatcagtgcttactgtggagggctgtggctggcagctgtggctgtgatggtccagatggctgctctgtgtggggcacaggacatccaggataagttttcttctatcctcagccggggccaagaagcctatgagagactgctgtggaatggtgagttcggggagcctaagtagtcttaaggcagctgagaggacaccaggagccttatttttctcttcctcgactccaggccgctattacaactatgacagcagctctcggcctcagtctcgtagtgttatgtctgaccagtgtgctggacagtggttcctgaaggcctgtggcctaggagaaggagacactgaggtgagagaggaggaggagcagccagagagaaaaatgggttttccctggaggtgggaagtaagtatatgagaccatgttcctgcccttgcccctccaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagaggtaatgcactccttttcccatctctccaccatctgtatcctggcccagaaaacttcctcaaccaccaaatttcttcaaggcataacccaatgccatcttgtccgtctataaagcctcccatttttccctggtatgcattccagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagccattaagtgtggtgtgtttgagccctcagtcgtcctgacagggcacaggagctgcggccagcccttgcccaccgctttttatttggacacagatggggagccccccaggctcctgctgagaccccccacatatcctcatatctagcctgagtatctgtcctgcaaaatgacagaggggctaccagtaggaagccatcctcccttccttgtgagatttgcctgcagggggaggatgggacctcggcagagaggctctgagaagaggtcagggaatggccactccaggggaggctctgcactgggagcctgaggcatgtaatgcagcaggcaggaagtgttgccaggggcctggagtacacagtctgagccgtccaaccactggtgtgtgctgtctttcggcacttctgactgcagggcaggcagctccagctggtaagggtcctcactggggagggcacgaagctggcgggacaacactgaggagacaaagaatcttcagaggccaacccagacctctccccttgccctgtctgagagctatccttaagcctcttacctccatgctcagctggcaggctcccccttgtgtcagaggagtacatagcaggtacaaggaggaggcagaaggagactagtaggacctagagcacaggaaaaaggagatgaagaagggctctggattgccctgtccccaccaactgagaaaaggatttctcccctcatcaccatcctcaccaagatgcaggtgctgctgctgctggttttgtttgatatctcaatcaccatggcctggagtttcctcagttgatctagaagggacctagaggaagagaggggccaatagtgagcatcccctggcctagcatcctgagacacagtgaaactcctgttcaggccacctcctccatctctgcactggatcctctctcttacttttcattctatttttgcaaacgacttcttcctctctggacaaaatgcctgaagttcctcattaaaacaacaacaacaacaaaaagcaaaaacaaaacaaaacaaaaaaactctgccaggacttaacctcctttgcgaatatcatcagtcgttccccactgtctgatcagctatgcacataatcctcaccaggcattttctatgttctctaccttctgtcccagctcatgtgtgttaagagttccagcccaagatgactatgctggactagtcctcttgcctaggatgctttctctctgcctagaatgctttcccaacccaaccccagaatcctaactactatgaaagcccatgacgtctttcttaccccctttctttttcttggtacttaacttattcttagttacttgtaaatgtattcctcactactgggagcttcttggaatcagagacctagtgaaggcagctgcccagttagaaatcaagtgtagggcaggggaaagagtgagaaagcattaaatgaggggcataggaagggaatggtttggagggatacttacaaattctgttcctccagaagctgtactttgttctgaagctccatattctgggctgtgtatttcaagaccctgggggaaataacaaagatacggggatatggcctgtatcctcccttcaaaaacctaatacttacaacagagtccctctccctttcatacctgctctctaaacccccaacatacaccttctttttcctgcggctctcttgagcagatcttttatttcgaatcttcctccgcacacgtttcagaatttgttcctctgtctgaaaggaaacagggaaagggatatcattagaggaactctagaaaaaggagttgaaacgcaactgagatcaatctctttccaatacagaaatcccttctacagcttccctgaccaacaggcattcagattctttctgaatgcctccacggaccaggtgttaaccctaacaagccagaccattttaaactattaaaaaaaaaactggtcgggcagtattcaggcgacgtggctcatgcctgtaatcccaacactttggggagctaagacaggaggaccggttgagcccaggagtttgagaccagcctgagcaacatagtgagaccttgtctctactaaaaataaaaaattagccgggtgtggtggcacatgcctgtggtccctgctactcaggagactgaggaaggaggatcacttgagcctgagaggttgaagctgtagtgagccatgatctcgccactattctccaacctgggcaataaagcaagaacctgtcttcaaacaagcaaataaaaacttccttatcctgaaccaacagctgcctccttataatttctatccgttggacttacctagtatctctggggccaaatagaataaaccctgtttagctattttaaggcacttaacatttcctcagagcttaaagaaaaaaaaaaagacaaaatttttaactcatcttctcaggatagactgcatcctcttagtatctgtcaaagatgtgctctagccagtatcaaggaaagcaagagagtgacttgtagagacaataactctattgctacagtttccaaatcccatgaactttcttagtagccacatcacactgctgactcatcttgtactttgaagaaattaaaattcttcactttgggaggccaaggtgggtagatcacttgagcccaggagttcgagaccagcctggcaacaaggcaaaaccccatttctactaaaaataccaaaaaaaaaattgccgggcagggtagtgtgcacctgtagtctcagctactcgggaggctgaggtgggagaatcacctaagcccagaaagtcaaggctgcagtgagccatgatcacatcagtgcactccagcctgggcaacagagcaagaccttgtcaaaaaatatatatatattcctgtaacctttctattaatgagcactgatttcatcatagtaccccagtactctgcttgtgaagttgccactcattgcttaaaactgaaaactaaggattttacatttattcatgtactgcttagtccaaccctgttgaactctctaaacagttctaccattcagcaagaggtggattactatgaagccaacgaagtgtcaaggcccttcacttacacagtcctttccaaggcccaatactaatgttgcactgataattttgagttatttttttaacagaacaccaaaatttgtataagcccaacaaaaacgaggatctgcccttgcatctggcatattgtgtacctgcctcaacttcctattagcaataaatctactaagtttctcacctcaatccttttttaaagttattgatataaagttaacagaatttgcctacttgggacttttaatcccttttcagcctttgttcaaccaatgagagtcttaccttagtgagaggaagtgtctcaggcagaataagcccctccttctccaatagactcttctcctcatctgtcagtactagcctagcaatctcctagggtaacaagaaagtggacggcagttgcatggggatgtcagagaggaatggggaatcctgcccccacctggggaatgtgagagtaatctcctgaaaatcaagtcaagtacctgctctgccagctcctccatatgctgtggagtcatctgggtcccctcttttctacagctctcactctctgcaaaagggaaagtatgaatagccaggcccatgaaccctgtcctccccgcaaacttatttcagactcacctagatccatagagacagtttcccgtgggagggagtaggtgtggtcatggtggacaaggcaggggttggaggagctgagaatgttcaacgacgctgggggactcagcagggagcacagcaaatcatctacttcccagtcgctcggtacctgcgcagggttccaatgaacaggccttgaccttatcaccatcacctgacttcatggacatcccacgctttccccagtcagaaccccaacctacctcagaaagcggcagcgcccagtccagtggggccctcacggcctcatcgggtgccgtccccaaatctccactttcctctagcaggaaggccagcaggtcttggtcaccagcatccaattccagctccatttgggacaactacggaaagggtgggccaccgggccccaacgtccgaagcccagacacgagccccaggccagctgtaggcctcgggcacctatccactgtccctctacggccgggattccccgccggcggctttccatagccctctccggacccgcctcccaggctcaattctcctcagcctccaacgcagcgaaagtgacgcaccccaccccgtggcactgtgggacttggagttccctccaactgagaagaggcttgggtgcagcgccacgtcccaggggctatgcaaatgtaggggacggccctgctgccgcctcgcaccccgagggcgggggttccggggctccggctccgccttctaccccaagctagaaaaaggaagagttctagcctgaaagggaactcgggcgtcgtcctggcgtcctctccggattgcgccgcaccctcgcttcctgccagggaggggctgccgggctttggcggctcccgagcatcgagaacggggccagagcagcttcctgcctgccccccgcgaccatagagcgcgggcccagggcgccgcccgcgggtgggggacgttcccaggacggaagtggccgagagagtgtcgaagggagggcgaggccggagcccgagggcgacccgagaagcggcggggcggcgggccggcgggcggggcgcagagccaggcagcgcaggtaggccagaccgggccgggcgggggccttagggtggggccgcggggcctggccccggggcgggcgggccctgcctctcttgcgtgtccggttcgggtcctattagttggagaggtcagcgtccagcgcatctcggcttgagctcggcgtgaagtaggccgtcttggggaagacaggcctttcctgggagcagtcctatgtctgggataggctttggggagcgtgaggagtcgggtggcagcggggcgcagggcggggacgggctttggtgttagctgatagcgggcatgtgggtaggaaagctttgggtgagttggggattaggtggggtccgtttaggaatcaagggtcgctataggagttaaaagctggggttaaaacttaagagttagtgtgagtcaggtccgttttagataggtaaggtttagattacggtcattatcttgtttgctgggatggccatcatacgtcataatttgagttcagggtcaggttaagggtcaacaaacaacaggaatcaggttagagcttgtttgagggattaaagaatgttggcatggtcggtgttaaggataaacagtgaaagcgtgagttaggaatcaaattataaatgaactttaggcttaggggtcaacatttagggttaacatcaggggatttggtgctaaaggcaaaacttagatcagtttcagggatcagggattggatatgagtctgtgctaggaaagggatgaatgtccaagccggtactgggaatcaggaaacaaattagaggtggggttaatgttaggaatttggggcagctttaggggttgtggtttgaggctagcatagttgaccttgagcagataaaatttaagaggttggcagtaggtaaatgcccttcttttgtagggaaatcctttattcctatgtagttacaggggcttctttttacccagagagataaactaatttcaggctagcgttctggctttagctagaattgcaggcatctgggattccagcttctttattccattctctaagcccaaggcccttgctgtggccaccacagttaggggacagagattctggactgtgttgtttacagacaacataggtgggaaatagggacccaggatgtacaaggcctagtcacaagttggggactgcctagggaagaaggagctgatgactatgggggaagctaaccaaggaatcactgttgccatgggagaagggaataactgaatcccctgaaagtttagccctgcttctcccacttcacttgttctcttggtattaagccctcctctccaactctcatccctgactctgcatttcacacccatcctgcctatccccttacaaaatacttcccttgcctttaactctcccatgctcatcttatcatccgttcccatccttagttctacctccctcaccaacctttaatccgcacatcctacctgaatttaccctcatcaaaacctgagctttcccatcattttaaattactctcctaccattttcacccagtcatgtacctacattccacctggtcatctgctgaataccctactcccatcccctgctgtgtgtcaccccctggatctaagcctcttttaatttcttggaccatttgtagatccccttcccccactccccaacagaaaagaggaaacgagacccaaagaggaaactgggtcttgctgatcccacgcccagccaggccactgaccacacccccacttcactcccagcctgaccctgccactgaccacagcactatcctctactcagcctgacccagccactggctgtaccccatcccccatcccagctccagctttacttagacattgccaatgtcccttcactttcccacccccaccccagtctgatttagtgactgaccacaggcccagctcttctcaacctcctatagcctgacctggcctctgacctcaccccatcattccctgacttagccaccatccatgtaatcattccccttcccccaacctgatgcagtgactggtcatatatgtatcttatgtatatgtatttttccaaacaccatcatcaccagcattctttttctacaccctgtcttctcatcctttttctacaccctgtcttccccattcccagcctgatgcagtcactaacccaaccccatctgcccctagtggctactaatcatatactcataccctttttccccacagcctaaccacatcccgtaaccacagcctcatcctcacattctctgcccaacctgatcctttcccctcttcccaattcgtcgcctaaactcaagctgccccagccgctaaagtggctgctgatgataggaagctgtgggactctaacctgtctaccttagtagttattaggtcctgtcatttctacctccccaaacttgttctgagtgacatcttcctcaatgccattccaactccggcttcattacctttaatttgtactaatacagtgtccttctaactaatctccaaggtaactgccagagttatttttctaaaatccagttccggttatgtctcttctctgctcaaagactcccttggcttccttttgtcctccaataagtaaaattcctcatacccctctccagtcttcctctgcctttccatcctaaccctgacttccccaccactgctcccttgcaggtacccctgtgcttcaacagcctgcctgctcacttccctgaatgctcctccacgatttactgcttctccatctttgcttatgctatttctctgcctggagtgaaaactacccctgacacatctccagctggctggcgtagtggagaaagcttgggctttgcagtcagaaacctgggttcggatcctggcttcacaacttattatttggagaagtatttgaacaagtatttaacatctttgagtctgttttctgatctgtaaaaatggaaataatgacacctactgtaaggattaaatgaaattatgtatacaatgcaagtgacatagtcaataaatggcagatcactattgttttttattatctctattttttaaaattctagcttcaaatgatacttatcatggagactttttggttccccttccctgacctaaagggatctctctgagcacacaccttttggctcttaccacatcctgccctccgttgtgattctgtacttggcttattcactcatctcgtggactgggagccctttgaactcaaaggctaggtcttactgatcttggtccccagccactgaaagtttggcccagggtcttccccacagctggccctcaaggaatgcttgctgggtgaatggagaatgtctacataatgggaggagagacactgggtgccgggtgtgcttgttatggaggttatctgtgcaaaagctgtgtgcataggatgggctccctaggagaagataatgcagtcgtgatgggatctgtgtgggggctgtgtgattgagataatgtgtgtatagagagagtaaggtagctttgtgggaaagagctctgcctaggctggggtgcatctggggagaatgagtgtgcatttgagtatggaggggctgtaccgggggaagttctgtgcagcccttcagctagctgcccagtccagctctaaatgagtctccagcagcctgaggccggatatgtcagtctcacccacagccctcccccactgccagcggttgcggactcagaggccaaatttggtaacagactgagtgttactcccccatccctcttatattctgactgtcttaagctctttccttttgttcctgtctgtaactccctatctttctgcaattccccttgtgggtatctgctctgactatattctccaagtaccccaactttcttagctccaatactcttacattccattccttgctgggatttgacctcctgtcctccattccccccctccaattgcccaacttctttggaatgcatcgcaggaatgtattgagggaggaggagttccctgggagggggacacggcagtggggagttgctgttccatcaaacacaatggaaaagggagcaaagttctcaggccaaaggaggaatgagctagcttctactcatacttgtagcagccttgttctttgccaccaccacccacaattcactgatcagttcttcgcgtccacacaccctcttgtagctgtgtgaatatccactctggaccagctggggagtaagggtaggcatgactcagctcccttatcggggtctcaccagaggcttccgtgcttgaggaggaagggggtgtctaagtgtccagaggaaatggggggagacatgcagtttcagcttagtgtgaagggtcctttcagtcctgcttcttggctccacagactcctccagcttctcggatccaccagcccagccctcattctttcatggtcagcaaccccatagccaggtctgtccagctgggacacaagcggatagtaataaggttgggcaaagtgccccaggagtggggagggggcagagagctggaactggggagactgggagggtcctctcttattggggagtaaagacagagagctgtggttcttctcttttgagactctggactgcttgtaaggtcagaaatggtctatctgccacttggtaccagaccgctgatctagaccattttcatacctgcctcctgtctcttgtttctacttagattttcaattctcctcatcccatctctcctaacttctttaccctctaccccttcttaacttccctggctttcaaatgccttctgtatcctaacacccccatctctgctttccagccttcccctctcaccctgcttttccccatttgaggcttgtagtttgccaggaggggaatgggcagcttgtatttgcccattctcttagttaagaggcacccaatccctgtaccaagcaggggcacatcagcagcagccgggcagacttgtcctcttgcagcctgtgcgccacctgctgcctccagtgcctcctctagcctgctgagagggggtgccaggagggtggaagaaggtggggtaggactagtattctgagctgcactgaaaatacagtcaggggaagtgggtgagacagagcagaattcgagacagacttgctgaagaggagaaagcatgggaggagttgcaggactgagtattaacttgatgacttggaacaagcaaggactgagttacagggactgggtcctttctctggcctgtcttgaaaatgtttcctggcctcccagagtctatttccccttctccaaaacacaagagttgaccagataacttctgagatagatccctttgagttagagaatcacatttctagcttgactgcctgggaagcccagtacagggctaggctccttcagaaggcccccgcatctcaggttagaaaaaagctggggcaagagcggacccctgaatggcttgagcaaccagtatttggtctccctgccaggctagctagagtttgtttgcaggcttcaagagccttagggaattataacatcttcattttgcagagaaggcagctaaagccatgagaaggaaggtcacgtggtgagaagagagctctgaaaatcccggacagggaagagccagcaggacacagcaggagacaaagagagaaaaatactgaaccaggcaaaaatgaaaagaaggcaggagtagggctgagaaaggtgatcagggacaaggggcaagagagatacttggatgaaagtagggaggtacaaattccagtggtggggcagggcagtgtcctcaggtagcactgcatttcagacctgctattgtaccttgcagaccagcttctcctttccctcagatgtcttaaattgttaggacttggccgggcgtggtggctcacgcctgtaatcccagcacttggggaggccaaggtggatcacgaggtcaggagatcgagaccatcctggctaacatggtgaaaccccgtctctactaaaaatacaaaaaattagccaggcatggcagcgggcgcctgtagtcccagctactggggaggctgagacaggagaatggcgtgaatccaggaggcggagcttgcagcgagctgagatcgcaccactgtactctagcctgggcaacagaacgaaactctgtctcaaaaaaaaaaattgtcaggactcattcttttgatgtaaataatttttcactctttaaaattattaaatacaatgaaaacaaccttattaccatctactttggtgagtccctttcaaaaacactcttcccttggactccaccatctggggggcctcttctcccaccagaagagtgtattctaatgccctgatgccatgggtcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcgtgagtctgactcccccggtggctggagtgggagtcttcagtcccttcttgttcccaggctctcggccttgagagttgacccctttgtcccctaagactactcacccctcaggtctgtgttccatggttccctcgttctttaggcccaaggtcatgggagaaatagtcaggggcaacatggtacaagctgttcagccacattggggtcttcataagcctaaagtgatccatcctctcttttagccagcgactttgggctctttctgtcagatgatgaccccaaaaagggtatatggctggaggctgggaaagctttggactactacatgctccgaaatggggtaagtatcctttcatcaaggaccaccacatccccttccatcagcttctccctgttccacctcctgttttcagcacccacatctgttgtctcttagccctccccatgctttcttcctattaacagacagtcataattccctgcttttgaacgaaccaccatagtcttcctttcagtgctccactctctcccctcgggctgtgtaaagaggaaataatacccctagctcagagtaggcccctgtctcttcttcctgccctaacaggacactatggagtacaggaagaaacagagacccctgaagatccgtatgctggatggaactgtgaagacgatcatggtggatgactctaagactgtcactgacatgctcatgaccatctgtgcccgcattggtaaggggccctagtacagttgaaagcctgggccagaaagcctcaactctctcaaaaggcatggatgcagtacctgggaagctaacaagccatctccttcctcaggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagtgtaagcagaactagaaaaaagagggcttttgaaatgggaagggtgggaaggggcttcagcatctgcttctgccaggcactgttttacaccctggggatacatcagtgagaaaacaaagtcctacactcatgggacttacatttaagtgaggggaggtaggaaatgcagaaataaacagagaccagacagcacaggggccatgggggtttggcactgaggggactgtctgtatcccagtgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggtatgcagaggacttggctggggtggggcaggaatagggagggctcggaagcacagtgtgcgtgtccttgcacccacacacaacattcgcctccttgccctgtgctctccaggcacgagatgacatcctgaatggctcccaccctgtctcctttgacaaggcctgtgagtttgctggcttccaatgccagatccagtttgggccccacaatgagcagaagcacaaggctggcttccttgagtgagtgacccacatcctataccctgtcagggcccaggactccctgccattgtgaccccagtgggcctgtctccattccaagcctgccccccactatttcttcttccgaggtaccagggtttgaccaacatagctacccttttagttgccatcatccattgtctcttctctgcctctggaatatgaatgtagttcagtatctctgcccctacccccatctctgaagcaagcatgtcactcttttttgagattatctgaagaattttgctgcagtagccagagggaaaccgggtaaaattttccctatagggaacatgggttaaaagtctcacaagcctcatctgctggtgtttcttggaatgcagagtttggcgtggctttctcagcttcctaagtgcatgttcatccttctagaaagctctttctcctcttggttccctgaaatggtgctctagacccactttccctcagggactgagcctctaacttaattttcctcagtccctttccctacagggagagacacaggtcacattaagaattcatactggccaggctcggtggctcacacctgtaatcccagcactttgggaggccagggcgggcagatcacctgaggtcgggagttcgagaccagcctgaccaacgtggagaaaccatgtatctctactaaaaatacaaaattagccaggcgtggtggcacatgcctgtaatcccagctactcgggaggctgaggcaggagaatcacttgaacctgggaggtggaggttttggtgagctgagatcgtgccattgcactccagcctgggcaacaagagtgaaactccatctcaaaaaaaaaaaagaagagtttacacgaagtcacctctatttcagaagataatctagactctattccctcagagtcttttttctccccaaagataacactgtcctaggtatttcctcatacccccaggcccacagttcatggcccacatgtcccctgatgctgtctaccacatgctgaccctcccttttctggtgtagcctgaaggacttcctgcccaaggagtatgtgaagcagaagggagagcgtaagatcttccaggtgaatgtgggtaggggaaagtatttgggatgaccgcggagctttgctgcttaatcttactgactaaatggccccctgcctcctccccgtctcccctaacttggctttcacccaccgggctgttatcccacctcacctctgccaagaaagcagacagcttgggcttttagtctcagctccatccctgcttttgctgtgcaattcagttcaatattcttgtaatcttttatttacctctgatttgggataacagtacttgccccgtgtaggactgataggatcaaatgaggtagcataatctgaaattactgtgaaagagtatagtctttgtccactataaggtgttacccccactctgaatactcagcccagaaggccttctctttgcccttctacttccaaactctctgttcatatctccagaatgtctgcaagttccttgactgtatcccttgactcatcgcttctgcatagcccttatcagcctccatcccgttaccctctcgttctcatatcttgtactcctcaacctttccagtgtccccataattctctctcgttagagttagcatccaaccttaattccttagctgtgatatgaaactctttgctaaattcttccccattttatgcacaggcacacaagaattgtgggcagatgagtgagattgaggccaaggtccgctacgtgaagctagcccgttctctcaagacttacggtgtctccttcttcctggtgaaggtaggttatgggcccttttcactgccctccttgtttcccactcttgcccttttctgtctctgaaagtctctggccttgccctcagtcacatctcccaccattccctaagattcccattctcttccttgctctgacctcatgaaaacctgcctgtcatcagccctacaccaccacttccctccctaccctgcattttcccttgtccgttagccctcccggccacctcaacatcccctatggctgcaagctgatctgatcattcacctctcatttgacctctgacctgtaacaccaacaccaacctctgcctcataggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggtaagtctggggactataacaagaaagtgctttgggagtttcattaaaggggcagctgcagaggtctcttccctctcttggggtaagtatactgagtattactccagaaaaaaaggaggttagagtagatggagaatcttcctctgggagagtgtgaggcttaaatgaaacggatgatggacttattctttaaaatcagcagaacaaaaatctcatcagcaagctgagatcacaggaattcttgtaggtgtggtgaaaggaaaaatgtgataacctccctgtttcagcagcagctatatacagtgaatttttgactttatattatagggttatgaattgaaaactgatatcaacttgataaagtaccctaatgacacaaatacaaattataggaaatgctgttttttcccttttggatactacagccaaccttaaagtgtggccattttatgccaaatattatatcctctcaattttatcatcagagtaaaaataagagacttcctaaatgatatgtatttgaaactgtgtagtgtagaggccactcctcagaagtaaaaaatttccctccaaggagaaaataaagaggaggttcaagaaaggtgggcatcttccaagagggccgttgccacgggaaggcatctcatcagctcaaccttgggcctcccatcctagccatttccatcctggatagatttgagctttccctctgagtcccccacttgtcaccctaggattttggagattaccaagatggctattactcagtacagacaactgaaggggagcagattgcacagctcattgccggctacatcgatatcatcctgaagaaggtgagcactgcctgccctagccttctccttatcgcctcttgccctctccacaagccagtcctttagaaatgggcactcagattgcttgaacctgggaggcggaggttgcaatgagccgagatcttgcctctgcactccagcctgggtgacagagccctttcttgtcaaaaaaaaaaaaaaaagaaaaagaaatggacactcagcttctggaaaatggctggttatggaaagaagaggctgccttttctccacttccctcttctttaactatcccaactcttgttcctttttccttcctacagaaaaaaagcaaggatcactttgggctggaaggagatgaggagtctactatgctggaggactcagtgtcccccaaaaagtacgaagggagttgggctgatcccatttcccaggggtagagaaggcaaggcctgactctaaggactcttgggaggtggggagtccttagaatggttctttaactagttgcaggctgtagtgagacctcacacacctgcaaaggtagtgtaaccgggtgggacgggtagagatgaggagtcctctgtgagctcaatagttcacccctctacaggtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctggtaagtgtcccacttccaccacggtgccagggcccttctctcaccctcagctgggccgagccaggagttaggcagtcttttcccaggtccctatttgtattctctccctagaccctggttctcttttaccttctcttttctccaaacatccattccagtccctgtttctccccacttgtctttagacttcagcccagcaggcactcactggaaccattaactccagcatgcaggccgtgcaggctgcccaggccaccctggatgactttgacactctgccgcctcttggccaggatgctgtaagtatgggatggaggagaggccggtggtactgaagctgagactccaagggatagggatgaggtgaaccaaaccagggcagatcctgaaggcttttcctctctctttcaggcctctaaggcctggcgtaaaaacaagatggatgaatcaaagcatgagatccactctcaggtagatgccatcacagctggtactgcgtctgtggtgaacctgacagcaggtaggccggatgctagcttccgggtgtgtgatggggagagggggtgcaagtgtgcacaggcatgcatgtgactggcttcatgtgtgactgtgccttgactcactgtggaagggactgtgtgtgtgcgtctttctgtggacatgtgtgtgactaactgggtgtgactttgctccctccccagcccttcgtctggcctgccctgtctctcatgttcctctttctccttttccccttaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgaggtcaggggccacaggtttgggttagggtggagacagggttcaagcccaaggagaaggggcagtccaagccacaggatggaagcctgggtcccgtgggcctgtgatatgcacaggcatgtgggcagggattgggcagcttctgactggtgttcactctccacagccccgtcagaacctgctgcaagcagctgggaacgtgggccaggccagtggggagctgttgcaacaaattggggaaagtgatactgacccccacttccaggttggtgacttacccaaccccccagaaccccagaatctaggaagtaacttctgctcgtgaatccagttcctagtcctggcttctgtgaattgacccctaaaaaccaatctgaacctctatttccaggggatgatactagtaacttctgatctctcttttaggggttagaattcagaacccctgaatccaaacttaacctgctagtttactcttggccctcatttattctttagccccttgtcatcttttctctctcttccccgtacatagcccttgccccaatttgaggaccccccacaatgctatagaccatgccaccctgagaatagtgttcctctagctctcccccttcccgctccatgccaatttcctcagctgacttttcaccctggatttcccatgcagatatgtgcatccagaggggctggggttcgatctccccccgattcccctacggtaacagcctctggcctgggccttcccagctttgtcctctctgagccgcatacactcgtttctgtacttcttcctcagcctcctgggggaccagaacttggtgggagatgaggaggcctggcgaagccaggctttgggaaatgggatcaggtagggtagtacagggacttgctcccaagactccaggatgaccacttccaatccaagatcaagaagtggagtaaagaagctgggggtggagggatcccaggagatacctcctacctcctctccccaccccattgtaacagcgccaccacattgtctccccgtcatcatcgagtgtatccgcctcatgtgtgtctccatttggtgtaggctgtattttctcttggtgtgggtttgttcctcggtgggggttctgtcctgctgggtgctcagggcagtagctcggggtaggttctggttgcttctgcgtacactctcctttgattggatcagtgggaataatgaagcagcttacgcctctgagaagtgtctgtgaatcccaagcccaatctcaggtcatgctaactgctgttttctcacaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtgagccccaaaggttgctctagtccgtgctgaggggtaatactaccacacacacgtgagcctttcattttatttctttggctctggaggcctcctcacccatcccagttactgctatgagcagcatactctacctcctttcccttgcctacgtctctgacattcactttacctacaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggtaagacacgcacccccaggaaaacaaaaaaccctaccagggttccctaagcccactggacatcatccccttgcggacctaaccacttcaccccaaggaactcagcacagtgtgggcttgccagccacacaaccataggctcatcattaaagctctctgaaccctctgcttccccttctgtaaaaggaatattaagtcctctaccttccctggagcatttaaagaatataccaaagtacgcacaaaaatatatagaaagtgacatgaaagtggtatagccttccctactatacccctgaccccaaaagttttcagagagtgtctcatcttctcaaggctactggctgaaaatacccattggagactgtccttctcccgtaagaacccactggagaatctttttctccaagatcctaaacccagaaaaaaaatagccccaaagaaatgatgcaagagcttttgccagtctctttttctgtccctaaagcccccatctaccttgtctacaccacttttccccacctttgtccccacccctgacacctcagtgtctctggcttcctcgcctgactgtgccctatgctctcaggggagatggtgcgacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaaggtacaaagccttctgtgcacactcccagactggaccctagagggaagtagagcagtccagatggtcaccctcatctgatgagggagacccaggaaaagcagaaaacacaagaggacaaatataggagcactcaggaaatgaatgagccccaaggctgtgggtgagccatgacccaggctttttttttttttttttttttaaagatgtggtctcactgtgttgcccaggctggtctcaaactcttggactcaagtgatcctcccaccttggcctcccgaagtgttaggattgcaggcatgagccaccacacctggcctaaaattattttttaattgacataattttacatattcatgaggtacatagtgacatttcaatacatgtatagtaatcagatcagagtaattaacatatccatcatttatccaaatatttatcatttctttgtgttgggaacattcagtatcctccccctagctatttggaactatataatagtcttaactttagtcatcctacagtggtgtagaacgctagaacttactcctatctagctataattttgtgtcctttaataaatctctcccattcctctgtagtaggcaaccagatcctttttctttaagtccaaggtcttaagtccaaggcctatttttaccttctttgctgctaccctgcctgggattcctttccttcctggtctcccctgtgaatacacataggcattcagtctctggggcctctgctgccagcaggacactgagacaccagcatgcagagaaccatcagaaagaagcccagatgattcctaggccccctggactctggggcttttcagttggcaggagtaagcaggtcccctgctttggtattcctgagatgcctgctctaaactgagtcctcctttgtccaggaagccctactcacctcactcgtgtggtattccccaaggaggggaagacaaaacaattccaccttaagaaaggatttcagcatccagtgggaatcctagccccctgaggtttcccattgaccttcatgagtcagctcctctcaaaggtgattgccttttggtggggctagttagagatgacttcaggaaaatacatgaattttaaactgagtctagaggagtgagagaggagcttctttaggatccacaggagagctgggtgatgactgtctttccacctctccctcagggagcagctgcccaccctgacagtgaggagcagcagcagcggctgcgggaggcagctgaggggctgcgcatggccaccaatgcagctgcgcagaatgccatcaagaaaaagctggtgcagcgcctggaggtgaggctgggagtttcaccaggagcaagagagagtgtgggtgctgtgggaggaatgaactgaaagggaggtgcggagagtaagttaatacgtccttgaggcataacctgggcaaggtaggccagggactgggctgggcatgggaatccatgggcttggtctgactactcttgtcttcacagcatgcagccaagcaggctgcagcctcagccacacagaccatcgctgcagctcagcacgcagcctctacccccaaggcctctgccggcccccagcccctgctggtgcagagctgcaaggtaagactctaggaaggatgtgggagtggaagagggagacttgtgggtctcttatgacattttcacctacaggcagtggcagagcagattccactgctggtgcagggcgtccgaggaagccaagcccagcctgacagccccagcgctcagcttgccctcattgctgccagccagagcttcctgcaggcaaggcaccccctctgcacttctctgacctgaccttcccacctttctaagcttccatctcccacagtttgaatctctgccaagagcctctttcccaataccaagccccagtgttccctacatcctgaccatcatcagtccttgtacccaagcccagagggaggatggcacacttcatccacctgcctattccccaacagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggtatggaagctggttctggctttggaagatgaggctggagtcctgtgatgagaggaaatctgtgcagaataacccaatacgcagataattgtgtaatcagaggcattggtgagacacagcaggaccttctacacccaaaacccctttcttatcataggctcaggaagcatgtggacctttggagatggattctgcactgagtgtggtacagaatctagagaaagatctacaggaagtgaaggcagcagctcgagatggcaagcttaaacccttacctggggagacagtaagtatgtttaagacctcattcttactcaaatcctaaagtcttccttcacctccgtgccccagagctgctcaaaacctttccttccttcctttttcttttttctctttctctcttttatttttcttttctttcttcttccttccttttttctttctctttctctctccttccttctttcttccttcctttcttttcttcctttcctctcctctttcttttcttttctcttttcttttcttttccgttcttttatttctttttctttcttgatggagtctcgctctgtcacctaaactgtagtgcagttgtgcaatctcagctcactgcaacctctgcctcctgggttcaagccattctcctgcctcagcctcctgagtagctgggattacaggcatgcaccaccacgcctggctaatttttgtatttttagtagagatggggtttcgccatgttgcccaggctggtcttgaactcctgacctcaggtgatccacctgcctcagcctcccaacgtgctaggattataggtgggagccatcgcacccagcccaaaacatttatttaaattgccacctgtccccaagtaccttctcaggttccttctcctcaccttctcctttctcaagcccaattcttcccccttcatccttagatggagaagtgtacccaggacctgggcaacagcaccaaagccgtgagctcagccatcgcccagctactgggagaggttgcccagggcaatgagaattatgcaggtatgtgggcagagagccaggcatggggcatattgtgagggaggtaggaaaatgggagctggatgagggatgggactgacagacgaaaccactggaatcagggcctggcaatgaaagcaccttcccttccctctttctcctcatctcccaaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtcagatactgggaaagggccactccctctcccccaggttccttcataaggcccaccctgattgaggccaaagcttctgagcctcgtccacactcacagagtgatgtcttcttgggtctgctcttgacagcccctctgtggattccacccttatgttctcttagtcttttttttttttttttttttgagacagagttttgctcttactgcccaggctggagtgcaatggcgcaatttcggctcagtgcagtctccgcctcctgggttcaagtgattctcctgcctcagactccctagtagctgggactacaggcatgcgccaccacacccagctaatttttgaattttgttttagtagagacagggcttcaccatgttggccaggatggtctcgatctcttgacctcgtgatctgcccccctcggcctcccatagtgctgggattacaggcgtgagccactgtgcccggccctcttggtcttgtagaagtgtctcagttggattcagtcatgggctgagctaaacaccaagtttggggaagtttaattactgtcacttgaaaccctaacctcagcctgttcacctacaacgccccctttcttttttcactttcagaggcagtagagctagtcatctcccatgtcgcgtgaatggaggcgatctctcaaattcttttcacttgggcaaccctgtctcctttctcaccccaggtggctaaagcagtgacccaggctctgaaccgctgtgtcagctgcctacctggccagcgcgatgtggataatgccctgagggcagttggagatgccagcaagcgactcctgagtgactcggtaggaggacggtagggggtgggggaacgtaggagtcaaagaatgccaggcctctccttcctccctctcggttgtcctttgaccctgacttcccagatctgtcccctttcattactcccaggctatgtgcccaccttttcagccctcctttaccagacttctccctgcatcattccccactcttctgtctgacttcccctctcaccttgcagcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccggtatgaagaggcagagggtctggttgaatggttcccactaagggttagataggaggcagttgagtgaccagtcctgacttgctcctggctcccttccctccccagtctctagcactacttgagtgtctgggaaagaagatcccttttagagacagataagaaaggacaggacaatgcattgaccttgtcaccttcaacagagccaggaggaccgagcccaagttgtgtccaacttgaagggcatctccatgtcttcaagcaaacttcttctggctgccaaggccctgtccacggaccctgctgcccctaacctcaagagtcagctggctgcagctgccaggtaagtagttgctgagaagcccagccctggactgtgtgagagagactggggagcaggcagttcatgagagcttcttggcttaggaatggttataggcaaaagataaatacttacataggacccaggaatgatgacctattcaccttttcactcaactttctgtcactcccagggcagtaactgacagcatcaatcagctcatcactatgtgcacccagcaggcacccggccagaaggagtgtgataacgccctgcgggaattggaggtagacacatggcaggctgatggcattgaggttgagggaagtgttctggttttgggcctgagggaggtgtcttggatctcactttgccctccccctacacagacggtccgggaactcctggagaacccagtccagcccatcaatgacatgtcctactttggttgcctggacagtgtaatggagaactcaaaggtcagcacagccaggaactcggaggagagagggcagtaggatggagctaaccagatgctgccctggggttctgaggacatgctctgactcccctgatgtcctctgttcctcaggtgctgggcgaggccatgactggcatctcccaaaatgccaagaacggaaacctgccagagtttggagatgccatttccacagcctcaaaggcactttgtggcttcaccgaggcagctgcacaggttattttcctgagatgggttctttgaatggcccctactttctttaccccattttctctcagcctgacatacctgtagataaatcaagaagtttatgtttgcaaagccaactctatggaatctgggttgtcctcctcctgaagtggagacacttgtcagcaattactgaacaccagcagttctgatttctgtaattcctgaaccctggtactttggttaggattacactgcccaaccgtgaggccttttccagctggctttctcaaaatatactaattagcttatacaaactattttttcatgttattactactttctttttttttttttttttttttgagacagcgtttcgctctgtcgcccaggctgaagtgcaatggcgtgatctaggctcactgcaagctccgcctcccgggttcacgctagtctcctgcctcagccttccaagtagctgggactacaggcgctcaccaccacacccggctaattttttgtatttttttttttttttttagtaaagacagggtttcaccatgttagccaggatggtctcgatatcctgactcgtgatccacctgcctcggcctcccaaagtgctggaattacaggcgtgagccaccgcgcctggcctgtaatcactactttcttttttttttttttttttttttttttttgagaccgagtttcgctctgtcgcccaggctggagtgcagtggcgcgatctagactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcgacctcccaaagtgctgggattacaggcgtgagccaccgcgcccggccaatcactactttcttaaaatagtactagtgacaaaatttccagttacttgagttatcacttaactttgccttttcccacattatcaagtataaaactacctattagctgtaaagtattttgctttagtatatgaatccttaaaacaaactggcatcataagagttcacttcagactattttccctgaaagcctaccatcctagccctccatctccaccacctccctgtgccctgtcagaataggcgccttgctctagatggcttgtttgattttgtttttttgtttttttggttttttgtttgtttgttttttgagacggagtctcgctctgtcgccaggctggagtgcagaggcataatctcggctcactgcaacctccgcctcccgggttcaagtgattctcctacctcagcctcccgagtagctgggactacaggcgcctgccaccacacccgtctgatttttgtatttttagtagagacagggtttcactaaacctctttgttgtttgtttggtttttttccccccaccttctgaaaatgcatagaggaaaaagcaaagctactgtgtattgattgaagtatgaatcaaacattaggatgttctttccatcataaaaatggctttttaacccctcccttcctttccaaatatctgacgcatggaggtgctataaatgtgaattagcctaataaccttcatcagttttgaactgtctttaaaagaggctttgcttgtgtgcacaaaggtgtgtatttatatatggctctcaaacgttttactgctacttacagtaagccatacttttcactctaagacccaacatacacaaacatatctaaatagagattggataaaaacccttgctatgtagttttcctttttattaacttttttaatcttctgaaatgcttgaatatacttaatgaaaacaggagagtattttttttcttctttatagtgtaaccattgtttgctaatgtatctccactcatggagaactctggaaaataagccctattctctaaacttacctctgctctcttttgtccctactatcactattcatttcccacctgcaatctttattcctcacccccacccccttttctcttcccaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtaactcaagggaacagggaccacaggcgagtctgggaaagggcagaccgaccccgtggagtagagggaggtgaggcatgtgggaaagagggcagggacccatctctgaccttgcacacacagcttctttttgggtaactgtctttttctgccatgggtctcatcatttatcagttactgctaaattcacaacttctctgtagatgttcgagcttactctcccacatgccctcttatggtttctccattagtatgtctttcctctcccatgcccagttcatctttgggtatctctgtctcctagatcttgacttttcaggtgactctgttattcctgttttgactcctcagggtattgctctccatcccctgaccctaaaatggctcctccttgggtatgtacacctccttcctgccctcatcgtggctcttccatgtgtctcctcaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggttcccattgcttgaattcccagcctctccctgacctgtcctatcttctcccccgagtcccccagttattctctgaagccttctaccaaatcccctctgcctgagcccaagctctttctattcagactgaccacctagcctctccccaaatcctgtaagtcccaggaaggagacctggacttcacttcctataccccctatgactgcatcccaagtcctgagagcctctctgtcacttctaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgaggtgaggcgatgtgaagggggaactgatgggccagcttatcacctcatcttccagggactcctgagacttaccttcctgcctcccctctccccagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgaggtattgagggatggggaaccagtgtggctggggggcatacattgtggcagaatggaggatgggcacttgagtgcaatgagatgggatggtgttgggaggatacaggggaaggataggctggccttgcagtaggggatgttcttggtgttggagcccatgatgtgtctgcagggacaaggctccagggcagctggagtgtgaaacggccattgcagctctgaacagttgtctacgggacctagaccaggcttccctcgctgcagtcagccagcagcttgctccccgtgagggaatctctcaagaggtgagagggagagggttatatggaaagatgtgtctaggaagagaaatatcagactcaaagaagctgggggatcaaggagtggcttcttagggacatcaaaggctgggatgtgcgaaggagggttagggtatttggtatggacagaagagcagttctttgtagccagagggtcctattgcaggtcaccatcagggctaatgtccacttcctccccaggccttgcacactcagatgctcactgcagtccaagagatctcccatctcattgagccgctggccaatgctgcccgggctgaagcctcccagctgggacacaaggtacctatggagactcatgggaagtcccagggagtagggtgagagagaggggacctgacccctagtccaaccccttgcctcaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaaggtattgagggttgggagggaggagctgttactagcaggaggctggagaaacaggaacaacagagctcctctcctctccccacagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccaggttagagtcttggggtgcctttggacactgaggctaccctgggccagagcctccaagcacagtggcagagaccctaacagtctttccctttccctatcctcccccctcagctagatgaaggaccaatgggtgaaccagaaggttccttcgtggattaccaaacaactatggtgcggacagccaaggccattgcagtgaccgttcaggagatggtgagtttgggcgagtcccagaggactgccctcggagagctgactttggatataacttcactcgttccattatcaccaggttaccaagtcaaacaccagcccagaggagctgggccctcttgctaaccagctgaccagtgactatggccgtctggcctcggaggccaagcctgcagcggtggctgctgaaaatgaagaggtaaacgtggaggcaactctgccctgccccctgccccttgttcctgatgtgtcagtgtctagggctgtcccacccccaccctctctggtctttcatagaaaggggaacagcctcagggccactctgctgaagactagtgaggctctgggtagggacagaggatcaaagccttcagtcacaggtacaaaggaaacagctcagaatctggagccttcccgggcctgcctttctggcttctgccgaccctcatctgggcctacagctgcttctctgttgtgctgccagtccatgttcttgttctttcttgttgcaaactcatgaagctcttccttacctaagcctctagctttccaagaaagcaagtaattggatcttagcaggacacatgtaatgcccatccttaaaaccctccataaccccatacaggccacatggtaatccacggccctctgattcccacattcaagcataaagtgctcctccccttctccccactgtgcttaacacaatcctcaccacttagtgcctgcgtgctactattttctgtgtgtaggaggtgaccttctgcctaaaggatatgcaaccggaaacgtccttgtgctgggaaccttctctctctgcttctttagtctacaatgcatgtttttttctatgtccttagtgacttttccaagcacagtgaaggtaccctgagtgccccttgtaaaatccatctgtctttcccttggctcacagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtgacggtgctcatccctgcagatggtgggactgcctccaaactctgtagcctttgccatcctcctccagccctctcagccctctcctgttgtcacttctcccaggcatgggcaacctttccatttcacatggcaccttccacagtcaccatgtgacattccctacccaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccggtaagacaggaactgggcctaagggaggcagacaggtcggggcacggggctggaagaggcaggatagcattcgctggaatggggaagacctggaccaggcaccttggacgggctggagcgggtaggggagatctgactaagctgggccctccctcagggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtagtgacctgatgcccctaattccggctggaatcacttcctgtcccgcttcttcctcccatagaccagagccaacgctttcccacacaggtggtactaatcaacgcagtgaaagatgtagccaaagccctgggagacctcatcagtgcaacgaaggctgcagctggcaaagttggagatgaccctgctgtgtggcagctaaagaactctgccaaggttggagagaatgagagcaacatcaggaggggcactggattaacatacttcctcctgttccttaaaatcattcctcttcactcctctgatacctccaggtgatggtgaccaatgtgacatcattgcttaagacagtaaaagccgtggaagatgaggccaccaaaggcactcgggccctggaggcaaccacagaacacatacggcaggagctggcggtgagtgagagtctggggcatcagtgactagggtcagagagagggatcctgaaagcctgtgaacctgtgccacacatatactcacagctggagtcacacacagtcttctctctcatctatcgccagactttttttttgagaagggtcttgctctgtagccatcctcctccagccttctcagccctctcctcttgtcatttctcccaggtgtgggtgacctttccatttcacatggcatcttcctcagtcaccatgtgacttcccctaccccagctctcccacaccctccttctggagtgcagtggcgtgatctcagctcactacaacctccacctcccaggttcaagtgcttctcatgcctcagcctcctgagtcactgggaatacaggtgcataccatgctggctagtttttgtatttttagtagagatggggtttcaccatgttgaccaggctggtctcgaactcctggcctcaagtgatccacccgccttggcctcccaaagtgctgggattacactcatgagccactgtgccagtgagctacattcatgtctgtcccctacccacttgtttattccttagcatgtgacaactgtattttttcaccaccctcccactttctccagtcactagtggcctcttcttagttgctacattcagtggccacttcttggccttcatcctctttgaatatttcgaaagcatctgactgtgttaacaagcctctctttgaaattctttcttctgctgggcatggtggctcacgccagcactttgggaggccagcgggtgtaatcccagcactttgggaggctgaggcgggtggatcacaaggtcgggagttcgagaccagcctggccaatatggtgaaaccccgtctctactaaaaatacaaaaattagctgggcgtggtggcacgcgcctgtagtcccagctgcttgggaggctaaggcaggagaatcgctggaacccgggaggcagaggttgcagtgagccaagatggcgccactgcactccagcctgggcaacagagtgagactccatctcaaaaaaaaacaaaaaagaaaaaaaatgaaattctttcttcccttggcctagatactggcttttctcttgtttctcgaacgtcattgaatcacctttaacttagtaaatgtggaggccttcccagggttgtacaaatagtcttccttctctcttctcttctttggcaagtttaaccactttcattattattctgtaagaagcagacatccagttctgagttgagttattttcaactgcctgtttgacatcaccacctagatgcagtgcctccgaaccatgacatggtcctcctaatggtgggaacacccttgcagtcatgaagattccacctcagtcatctttgacttcaccatcttagccaccatatccaggctgttgccacgtcctttcattcctcctccctggttccctgtccgcactctggttcacacttccatactctcccgcaatttggctgtggcaccagttttctccctggtctccctgcttctggtccctgccactctcctctctccctactcatctttctaatttctaaatgcatctttctaaggttctgttttcacttttacttgaagatgtccaagttggaactcttgactttctgcctcccatacctggtcctttcctggtcttcccccatctcagtaaatggcacctcttagtaactcagttcctaaagccagaaacctagcttcaatatattagacttctctctttctctcattccccacatctaagttttgctagtgccccttccaaatacagctcattttttctttttatctcctaccactaccacactgtccaaaccatcatcagtccttaactggatttatgcagtagtctctatccagtcaccatgcttcaacacttgccccctccaatcctcctttgtacacagtagctaaaattatgtttttaaaatataaattagagtctggacatgctggctgatgcctgtaaaatcccagcgctttggaagactgagatgggaggatcacttgagtgagttcaagactagtctggacaacatagcaagatcctgtctctacaaaaaatttaaagattagctgggcaaggtggcccatgcctgtcccagttactcatgagtctgaaggcaggaggatcccttgagcccaggggttcaagtctgcagtgaactatgatcactccagtgcactccagcctgggtgacagagcaagaaatatatatatattagattatgtcacttcactacttaaaacccattagtgatggctctgcttgcttctccagtctcatcctactctcttcctttctgtgccccatccccctgcaccatcagttctgagaacatgccaagctcttatctgctgcaggctcttccactcagttctctccagctttttgaacactgtgctccttccagttcatcaggcttcagcctcaatgtcacctcctcagagagcccttccctgaccacctatttgaagtagttctcatcacagcactgtctctattctctcataatccaaatcacagtcctcagttttgctgcttgtttatttatttattacctgtgtccaaaaccagaatgtaagctccatgagaacagggagcatccctagccccttgcatagaatctgccacctagctgatctttaataaatgtttgcagattgaacccgtacatcaaaatattttatgactttcacatattatgtaaaagtccaagttcctcggtgtgatattcaagtccccaataaccttttcttcaccattcctatattccagaacattccttgatactttccgatgtgacatcttggttgttcatgtcctaccatttacctaaaatgccctcctatcatctgtatatcttttatggcctagctctgcctctcaccccttcaaggcttctctctattttgggaatgaaaacccagccaaaagccacttttgtaattacttttgtgatttcaaacaaacaaacaaactccccagttgcttcagtcagaaacaataaccaactgccttgttacattcactgtgatgtgtgaatgtctgcaccaaatcacatgcacacagagttctacgctgtctcatagtctcagccactgtaaaatctttcttcttcttctgcccccacaggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggtagaaatccttgaggcatttccgtgaggcagctttgggccagaacatagtgggagagaaactgtagggatctgcggggcctaaagctaacatattactctggggacaggaagcagcttaccacccagaagtggcccctgatgtgcggcttcgagccctgcactatggccgggagtgtgccaatggctacctggaactgctggaccatgtactgctggtaagggagggcgttgcttgttcctcataccagcctccctgaatacacagccctcttcctgcaggcctcgcaccctgctgtctgttttgctcagatctcctccctaccccaccctctacttcccaaatctgttctcctttccaagtctccctttctcccaggccccatccttcttatcatctttggttctcccagtcacctcttcctcttcctctttttcttttctcctcccttcccacctgaccacccccttctctactttcgtcgtctcctctttcatctcatcattctccttgctccttgtcagccggtgagtgacacagccccactgtctctatcacgtgtgaggtgtgatgcatgatgtgtacttggataggcagcgtggagtttgagggctatggtgtggagtgctctagggataggggtgagggggccatggtctgccctatttcatagatcagggtagaccctaagatgtgatgctctttgtcccctgcccgcttcttgcccagaccctgcagaagccaagcccagaactgaagcagcagttgacaggacattcaaagcgtgtggctggttccgtcactgagctcatccaggctgctgaagccatgaagggtgaggggtgaccagggacagggacggatggaaaacccttatcatggtgtgatctctgcttcctggctggacagctctgtgctagcctctgaccatagtccccacagatgccagggcctgatgatactaaccatgctccctggtgcttttgacctccccactctgccttagcctctttcctcttccttcatcccaccaggaacagaatgggtagacccagaggaccccacagtcattgctgagaatgagctcctgggagctgcagccgccattgaggctgcagccaaaaagctagagcagctgaagccccgggccaaacccaaggtcagtcctgctcccttcctcttccaccctcaccatggcagtgtccccaccttcatctctgactttacatctctttctgcaaccttcgcttattgcaggaggcagatgagtccttgaactttgaggagcagatactagaagctgccaagtccattgcagcagccaccagtgcactggtaaaggctgcgtcggctgcccagagagaactagtggcccaagggaaggtgagtgcttaaatacccagaagaatggggacaggttggcactttgatgtccacatccacatccatagccagcgagtctttgaagtgaggaaaatgcaggtctaagtaggctcttctccttcctacaggtgggtgccattccagccaatgcactggacgatgggcagtggtcccagggcctcatttctgctgtaagtgtgcaataccactaggtctctctcagtttgagagacttgagaaggctggagtggggatggaccagggcaaggggcatatttttaagcaaactctccctgctttaggcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggtgagaaccctgacccatcccattgtcccttgggctatactgcttcaaactgtcactcccgagatgtatgtttctatgagagaattgaggtactgtctcaactgggaccgtacctgagttctcaacctaggccactttctctctgcccaggctgctggcaacgcagtgaagcgagcctcagataatctggtgaaagcagcacagaaggctgcagcctttgaagagcaggagaatgagacagtggtggtgaaagagaagatggttggcggcattgcccaggtgagcttcaccccagatgctgagggacgctgtcaggagggcagtcatgttgcctgcgctggtcccaactaccctatgcccctgctgtgcatcctcactgaactaagtccccgatctccaccctcagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccggccagtccccacagcctcatcagctctcttcaccgttttttgatactatcttcccccacccccagctacccataggggctgcagagttataagccccaaacaggtcatgctccaataaaaatgattctacctacaacctctgcctggcttcaagggagatacaagttttctcccagggcagtaggagagacagtggggttgaattctgtcacccagcttgatccagcttgaaatgggagaggggaagactggcagtctgcacctgaggtcccttcctccttgcacccggaccctaaagttatccaatggggaagttgtgcctgagaagtcatactcctgttatcctcacctccctggccagcacctaagcctcacaaagtgtcgttctgctgctgctgggacagcagctaccacagttccttgtggctaccaggacattctgttcttcatagctactcagggtatgtcaacaaatccagtccttgaccaaattcaaattttcaaaagaagctttgctaaaaataatatgcctgtaagtgtctgagcctaagagaactatggccacaaaactgattgaagccattagcaagcagaaaaatcccaacttgaggctgcctcgggtaggcaccgctcttgattgggttgggacactcctgcctagggtagcgctaaaagtgaagagcttgacccaggtgtgagaatttattgttagagggggcagagctcccctagtggccaggaaggtgctagcagccctgttccagccaccctgcttatctggtgggtcagtggaaagaggcagtcagagaggtggatgctgtgtgcttccacgtccccatccagccactctgtccataatgcatggactctctgacagtcgtcttaggttggcaactattttcatgcgtgattctttagtcagccctaccgcccagtacattatttcctcaagtagaacacaaacgccacccatctgctactaacaccttctactcccaccacattagggaaagcttgaagtagatggaatgtagctggtaacggtggttcgagcctctaatcccagctacttaaaaggctgaggcaggaggactgcttgagaccaggagttcaaggctgcagtgagctatgatggtgccactgtgcaccagcctgggtgacggagtgagagcccttctctaagaaagtagatggaactctaggacagcccattagggatggtgccaacctcctaccatcactcctatcacctgtgattcattcattcaatatttactaagccatgcttgtgctaagcactggaaaattgagatgtattatcacttctctgacgcagaggactggcaactccagtacatactgtgggggctccctaatcccagattcaatgtcatagtatcagttgaggaccttggagatcaaatcccttctataacctccccgacaagtggcagtctagactttgaactccagctaggagcccaggacagctgcttactcctgttaccatttccttgtcatgtcctcaggaactgggaccaatcacatacttctcactagtgataccttgggagccatctggggagaggctttaaaacctattaaaccagcagctcttcaaatgtggtcctcagacccctagggttccctaagaccttttcaggggtccataggtcaaaattattttcataaaaataccaagacattattttccttagctggggatggtggtgcacacctgtaattcccagctacttgggaggctgaggcaccagaattgcttgaacctgtgatgcggaggttgcagtgagccaagatcacgccactgcactccagcctgggcaacagagcaagactcaaaaaaaatgtccttgatgaagtaaaaaaaaaaaatttttttttttttttgagacggagtctcggtctgtagcccaggctggagtgtagtggcgtgatctcggctcactgcaacctccacctcctgtgtcccggttcaagcaattctcctgcctcagcctcccgagaagctgggattacaggcacatgccatcatgcccagctaatttttgtatttttagtagagacagggtttcaccatgttggccagactggtcttgaactcctgacctcatgatctgcctgcctcaggctcccaaagtgctgggattacaggcgtgagccaccacgcccagcctaaatgtattaatttaattaaaccttaatccttaaggaaaaggcttttcaacattctgtctgataaagtgggaagtatgcataagacattttgcataccaaagtatgatggttttctggaggaaataacttaggccattctttgagttgtgagctgaactagctgctcttttatggaatgccacgtttactcaaaagaatggccgacaaactgtggttatcagatttaggtagctggcagaacttttctaaaaaggaacaaagtgagtctgtcacttcagggaaaaatctgacagtgtttgttgccaatgatataattcaagctttcaagtgaaaaatcgaattttggaacacttgtatttgctacatgagcttcacagcttcccaaaatttaaaacttaaagactttactgttctccagtataatactatgaagaaaaacaaagactttactgttgaaacctattgtgatttttttaaaatttatttatttatttatttatttatttttgagacagagtctcgctctgttccccaggctggaatgcagtggtgcaatctcagctcactgcaacttccacctcccaggttcaagcaattctcctgcctcagcctcctgagtagctgggactacaggcgcccgccaccacacccagctaactttttgtatttttagtagagacagggttttgccatgttgcccaggctggtctcgaactcctgagctcaggcaatccacccacctcggcctcccaaagtgctgggattacaggtatgagccaccgcacctggcctgaaacctattgtgatttttaaaataatgtataatgaaacattaatatttggaagatttgcatagctcagtgaatcaattattttccatatgacgaatgcacggtgttacaaaattatgcatgggtaaaagatccaatcaggtgcagttcagaaaaacggattttttttttttttttgagacagagtcttgctctgtcacccaagctggagtgcagtggtgcaatctcggctaactgcaaccttcgcctcgcaggttcaagtgattcccctgcctcagcctcccgagtggctgggattacaggcgtgtgccaccaccacacctgactaatttttgtagttttagtagagacgggagggtttcaccatgttggccaggctggtctcgaactcctgacctcaggtgatccacccaccttggcgtcacaaagtgctgggattacaggcgtgagccaccacacttggccaaaacaacggattttagtttaacagtacaaaaaggtcactgatatggtttcacattctacattgcaactgccccttaagaaactgccaattatcggccaggcacagtggctcaggcctgtaattccagcactttgggaggctgaggcaggagggtagcttgagcctaggagtttgagaccaacctaggcaacatagtggcacaccatctctatttaaaaaaaaaaaaaaaagggccgggtatgatggtgcacatgtgtagtcccagctactggaggagactgaggcggagagagcacttgagcccagaaggtcaaggctgcagtgagccaagccgtgattgtgtctctgcactacagcctgggtgacagagccagaccttgtctcaaaaaaacataaatatgccaggcccggcatggtggctcacgcctgtaatcccagcactttgggaggccaaggcaggcagattatctgagttcaggagttcaagaccagcctagctaacacagtgaaaccccgtctctactaaaaatataaaaagttatctgggcatggtggcgggcgcctatagttccagctacttgggaggctgaggcaggagaatggcgtgaacctgggaggcggaggttgcagtgagccgagattgtgccactgcactccagcctgggcaacagagcgagactccgtctcaaaaaaacaaaacaaacaaacaaaaaatacaacagttagctgggtgtgatggcttatgcctgtagtcccagctactcgggaggctgaggcgggagaatcacttgaacctgggaggcggaggttgcagttagctgagatcgccccactgcactccagcctgggtgacagcgcgagactctgtctcaaaaaaataaacaaataataataataataaataggccaggcgtggtggttcacgcctgtaagcccagcactttgggaggccaaggcaggcggatcacttgaggtcaggagttcgagaccagcctggccaacatggtgaaaccctgtctctactgaaaatacaaaaattagtcaggcatggtggtgcatgcctgtagtcccagctactcaggaggctgagacaggagaattgcttgaacctgggaagcggaggttgcagtgagccaagatcgcaccaccgcactccagcctgggcaacagagcaagactgtttcaaaataaataaataaaataataaataaatctttccaactgcatatctgttgtgagacaggattttcttcatatgtctcagtaaccaacatatagcaacagatcaaatatggaaggagatattgataatacagctgtccccttggaagccagagagtaaagagattcgtaaaaatgtaaaataatttccatactctcattaattcggggaatgggaatatagttatctttcatttagaacattatgttaacatgattaatgtgtaatgagtttatttttgttatttttaacgaattgatacatatttaaaatttttctcaagtttcattttaatatggcaactattggtagatataacccacttcaacaaaaaagctgtttgggggtcttcaatactttttaagagtgtaatgggttctaagaccaaaagacccacaccgtattagtatatttgataagtacccagaaactggtacataaaaaactcatctggcaaatgttcatgaagtgccaactctatgcctggtgctgtgataggccttggggattcagaattgagaacagtcgtttctgttgaggactcacagaccggcggaggcgccaaaccggtataagaacagttataccatgggactaggatgagggtgagagcccgcaccaagaacacgcacctattaggtgaggcggtgggaagagaagtggccagggaaggcttcccagaaaagctgacacttactgagtcttaaaggccaccaggaatcagccaaggggatgggcattttagggagagagaacagaatgcataaactgtggaagctttaagaaaagtatggctatttccagctcctgcacgtagctcattatgaatgcagcatgaggtacaagtatgaatactgggggtgaggttgggcatggaaggagatgaggccagagaggcaggcaacagccaaaacaacgggccttctataccatattaagaaatgtggattttttttttctcctcaaaacaggcagggtgcccgcacgcctgtaatcccagctactcaggaggctgagtcgggaggatcacttaagcccataagttcaagaccagcctgggcaatctagcaagctcccgtctcaaaaaaggtggggggacagggattagggaggggttttggagaattttagataatattcgcattaacttttaaaaagatatttgacaacaatgtcatgggacagtcaaatgaatgaatgagttgaggaactagaagtaagactacaaaacagactgaagaaaacataaggcgcggccagaggccagcccagaccgacccgaggaggaacctccttggtagaaggcagcctctccaggattaggtggttgtgagacgcgaagggcaggggatacccagtggtctagcataggctactggtggatgaggcgtcttccacggagttagaggaacactgcgaggtcaggccagggttgctctccgtgtggctagcaggcagctaaacagatctgaatgcatttccacgccacctccccaccgccccggccagcggcctcgggttcccacggtccccagcccactgcaaaatccaggcctcccgcccctctatgactggagggtgggggcgaggctagcagctccctcccggcttcctccgcttgttctctcctccccttccccctcctcccggcggctctccacttcctttccccccaccccaccccagggaaaaacgaaaacaaacaccctcgcgcctcgcgcctccgactcccagaccccacgacccggctccggcgctggtttggcggcctgggtgggagaaggcacctcgccccggaccccctatgccccgcagctcagtgactcttcccctcgccctccgccttccccgccgcagcccggctccgcctcccaatggggaaacatcccaaaaaagggcagaaaagaaatttcagcataaagttggcccactgggaaagagaggagcgtccgcggggagcgggggagaagagggaaggcgcgcggaggggagtggggccaggcggagccaggggcggggagcggaggggctcgggacgcgtccgggtgggagcgggggcggggaacgcgcggtgaccagcctggccgcagccgcgtggaaaatatgcggggcacgtggggggcggggcggggagctgggtcctgagccgccgggtgctcgcaggaagggcctggctccaggggcaggggctgggaggggaggcgaggggatgagaggtcaggccggtcctgggggcagcaagcccggccacactccccaccgcgaccggggctctgggctcgcttcctgcttcagtttccccaagctcccgatgagactccgctactaccaccacgtcgataacgcaaacctagagggactcagggtaaactgaggcactcaaactgccgaggagctccgcctcccgagagacatttaatccggggggatttgcaggaaacttctaaattaagggtagcggctgctgcagctgagggggggcacgccggtccctgcgcccgggcagctgccgtgagctcacgccccgaaatagccccaggggccccagccgcagctgccactgggtccggctgtcactcagaggaagcacggagcccccagcccaagggtcccctccccttcgcatcgccggggtttttccagccgaccgtcggccactttttcctccgacggctggcagggaagagggggatgggggcgggaccccaagggaggcggtccccagtgggtgggcgaagggggcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcaggttagggccgggcccagtgcagcctgctctccccgcgcctagggcaagggtgggccgctgccatgggtcccccagccccgggcctgcccgccaaggctctctctcacccagggtgggggctgggccttcgcagtaccctcagggccttcgccagagccgcttctctcccctacaatagcctggggaagccccaggcccctggtttccactctgcctttgcagagcgcggttggtcctgctccttggggcctgaagttttctctgtaccctcaacgggtcccaccagtacccttgactgtactgtcccttttatgttattccgcttccatcccagtagcctccaaatcttagtagcgcccctacacacaccgcgtctccattctgggcctgggccccctcccagcctggctgaccaagtcccctctgtcccagctggaggaggagcagcaggccctccagaagaagctgaaggggacagaggatgaggtggaaaagtattctgaatccgtgaaggaggcccaggagaaactggagcaggccgagaagaaggccactgatgtgagtgtggacttgggggacaatgggaggagttagggctctgggaaggggccccccgggtatgggaataagaggattggggcaccttatccccttatgtccccagcgccaggagagaaatggtttcatctcagtaaccagggctagggtaaacttacacaagtaatccaagacagtggataaatcaaaaccacctaccacttcccccagaggacttagccctgtaattctgtttggttccagcttttagaatgtacagtgatcaagcaatgagtcattgtgggggtggaaggtataagaatttaccatctacctcaattaatcctccagctgaaattggagaggagactgcagccgtttggggatggggggatgtggatgtgaggtactagcctgcaggaggagggagagggatccagagatgagaccccacttgagttacaaccctaaggggccattagaaattccctggccttgacctctggcttcagcagccctgctgtgccctggggccccagctcaggttctaatggctcctcatttaccctcattaagctgtcagcctggagaccatgccaggccacagggcagagggacagggccacaaatgccaaagcagctaccttggcaggtcatttaccctgagatttctctgcccaccccacaaccccaaccagacttcacttcctgccattcccaacccccagcttaaggtaggagaatggccatatggctttggtgtggtggtagtttccccattctctgcctcagtttccccatcttccttccacccaggattgttttaagatgaacctatggttagattagcataaagcatggtctgaacatcagagatgacatagctgtttgtgtcgactgctcatgttcccagccccccaggggttgggcttctgtgacctccagcctccagttttggttctccaccagtcctggcacttgggagggagctgacctgcagctgctagcacagacaaccctgggcatctgacactctataaataaccaaggcccagtgcagctggaggcaagattggaaacccaagttgctggtgggggctggaggggcaggggggacagggacagagctggggaggcagagccgcagcaccaggagcagataggaaagactgcccaagcttcctggtgaccttgaacacagcactcaacttacatggtgcctcagtttctccctctctcttgcttcccatttttctaatggggacagtagtgcctgtcctgtggttagagagccgcccccgtaactgggaagagcttgagaggcaggaaatggcacatatcagtcccatgatgaggaccccaggacttcccaaactttccagagtcttttgtcaccccaccatcatgcagagtttttcttttacagtctcacctctctctagggtagtactccaatgtcccccacagtgattcttcccaacccccaatgctgtccccagaatgcttccacactgtcatccggccctgtgcccatgatgggctcttgtcactctaggtggccaagctccaggtgccttcagcacctggaagacaagctaccatctactctctatatatggtgctgtttctcctgccctacagtccgaccaaggacctgcttcctatgctgtgtccaagtgctgcccccagcccctccccccacctcctttccctacacaggtcctctctcctttccactctgaaatctcagggtctctgtgtccttgtttttgacagagaaaggggataacctaatatttatggaatgtggaccctgtgcaggcaatgtactcagtgctttctgcatgttattttacaatttcccaaacttggcttatcatcagaatcactcgggggctttaaaaaaaaaagagaagattcccaagcccccgccctacacatcccaattcagtggatctagcatggagtaagagaacctgtttagttttatgagtctcaccgaaggtcctgttgattaactgagtattaaaagcagtggattatctcagaacagccttaagaaggaggaactgttattgttaactccaacttgtgaaggaggaaactgaagcttagagaggctaaataagttgcccacagttacacaggtgttgagtggctgagccgtggctcaaagacaatctgactcagagccgatgctcttaacacgtggctgccctgctcctctcattttcctttactggcgctcgccttgctctgccctttttctcagtgtttgaccagtttttatggattttttccaaaacctccatggttttgcctcctactgcaagcccaggggctgagtagacatccctcacactgcccctgcattgcccccagctctctgctggccttggcagggagccccttgctacagccatgggtattccttataggcctgcctcttgggcttcttgctgggagtctgccttacagctgatgacagatgacatcactgaacttgatacttttttttttttttttttttgagatgggatcttgctatgtttcccaggcagggctcctggggtcaagctgaactcccgccttagccttcggagtagctgggatgacaggcatgcaccaccatgcccagtatcactgagcttgattctgtgacgggctattcttagcagcagtgatgtctggttggcctgattctcctcccatccccttacctgggccaggctttgctgtgtaggaatcagagctgcatcagacctggccccagcacttgaagtgctcccacagggaacaggaggacttgtgtgcaggtgacctttgggagactaactgtgcacagtgcaggagaggccctgcagcaggggagcggagcttgtcaagcaaggaatgcatgtatttttttgtttttttgagatggagtttcgttctttttacccaggctggagtgcagtggcacgacctcagctcactgcaacctccgcctcctgggttcaagtgattcttgtgcctcagcctcccaagtagctgggattacaggcatgcgccaccatgcctggctaattttttatttttaatagagacagagtttcaccatgttggccaggctgctctcaaactcctcacctcaggtgatccacccgcctcggcctcccagagtgcggggattacaggcgtgagccaccatgcccggcctgaatgcacattttttactggagcacagtctgggcagaagatgattggttggggaaaaatcacatagaatgtctagaaaccaggaagcctcagttctttctgagaagaatctcgccatcctctggagcctctctgatccttatccaaggctaacaaggcctttttgacccctgacctctgacccacaggctgaggcagatgtggcctccctgaaccgccgcattcagctggttgaggaggagctggaccgggcccaggagcgcctggctacagccctgcagaagctggaggaggccgagaaggcggctgatgagagcgagaggtggtcaggggcctcggggaggatggtccgggagggagaagggagcctgtctctgctggtcctgaccctacgctcaccctctccctgcctttcagaggaatgaaggtcatcgaaaaccgggccatgaaggatgaggagaagatggaactgcaggagatgcagctgaaggaggccaagcacatcgctgaggattcagaccgcaaatatgaagaggtgacagccttgcccctctgcctgctcgctgcccagcctgcaacatgcccagtccttctccactgatctaccctctctttctcactccccacaggtggccaggaagctggtgatcctggaaggagagctggagcgctcggaggagagggctgaggtggccgagaggtaaagatacccgggggtgacaagtgagcccattggccctggggccttccacacagtgggaaggtagcatcctaggcttggggctgtagggacaggccctgttctctgacccctgcccgctgcccccagccgagccagacagctggaggaggaacttcgaaccatggaccaggccctcaagtccctgatggcctcagaggaggaggtagtgacccctctgaacctttctgggcaatggcgccttctctcagctcaccttccctccgtctcagcaccgcaggctgctctttctcagctgctggggatcaggaagggcctggggcttctgagccctgcctgctgtcactctcacaactttgctcttctcttctctcctccacccgtcccctgctgtgccatctccactgtctggcttcgctgtgccctcacaccctgccccccccgccacacaccccctgcagtaaatgtggggacctagaggaggagctgaaaattgttaccaacaacttgaaatccctggaggcccaggcggacaaggtagaggggagcagaggggcagtgaggatggggtcccacaggggagggaggtgaggggcccaaggcagggaggggctgggtgttcaacggaggcaagatgaccaggagcctacggggtacaatggagaaatgaaggatctgtggtagcgctgtactgatggcgtgtgtgtgtccccaaaagtattccaccaaagaagataaatatgaagaggagatcaaactgttggaggagaagctgaaggaggtgagagtcctcttccagttcccagtctcccctcaagccaccctaatccttgccagagacggcctgtggcaggacacttgagggttgggatggacaagaagcttgacttaggcagtagtctgtgggagggcctaattctttgccatttctcccatcctgcctttacccccaggctgagacccgagcagagtttgccgagaggtctgtggcaaagttggagaaaaccatcgatgacctagaaggtaaaagaagcctttataagtaggtccacacctgccgtgattatcagtctgtcctgtaccttctcatcccattttatttgccaccaataaactagggttgggccacctaggaccctaccaactccccaactctgtgggccatgtctacaattcaagtaattgtagctgcccacggcgcaacaactccagtgcttctcaaacttcagcatgcatgagaatcactgggagagttttaaaaacagattccttgactctgccccaaagagattgctgactttgggctggaggatttacatttctagctagttctctggtactgccaatgctgctggtcctcatgccacactctgagtggcacccttatagacaattccgtccccgagtgtaacgcagtagagttctagtgcagagactggcttattaactagagagctgttggactgaacatctaggtctgcatgacagcactaatagaaaacactattttaagctagatttgacaaaagcaaacatccagatatttgtgagtctgtggctatttctattgttaatgatgatgtggctaaagttgcctttcctttttattctgtgataaccctttcactttcccacttctctcgcttccagccttctcaggcaagctccaattttacctccagctttaggaggtttgccctttctggctccagcaccctccctctcccctctaagcaagcactcctgcttgtcgagagcattgtacacacagctccctggagaggcaggagctgccatgggtagagccaatttggggtacagagaaggacagaaaagagatggggtagagatggggagaaggagttcctgacagctgtccagcctgttccctggcctccctctctcactctgtctttgtgtacctctgattctgtttttctttccattgctctctctccttcctttcctctttccctccactccctttcccacactcccacctggtcccctccctggaccccccccagatgaagtctatgcccagaagatgaagtacaaggccattagcgaggaactggacaacgcactcaatgacatcacctccctctgagccccacgccagcgtggccacctcagctctcttctctcctctcctttccattctctctatggggaggggagcaggcaggaggagcagaaattgccaacattgcacagccaggctgggagcagcctagggagagcccccatcatgcccaccacccactctggcactggcttcatcctttacctatccccttccaccctcctttgctgcttaataaattctgaacttggtctccatgctgttttcctgccctccagagagcacctctatcgccaccacggagcactggttcactcctgacaccctggcacttactgacacccccagcccctgcactgagcccacccacaaaacaccatggcccacgctgaaacccctctgcacaggcactccctggctgtcgctctctgattcaccactgcatgtgggcacgtgtggccccatcaaaccatgaccgcctctggtgccaatccctgacctcagagcacttagctggggttccaggatcaaacagagtgactggaaaggaagtagggtggtgaggtgcaggacaggggcaagaaggttgcaaaaggtctggaatggagcttggaaaaatgttggatatcagcaacatggggctttcactgcagcagcaggtctgttttctacctcaagtctgtctgtctggcccttcctttcctggcgcagtctttgtcttaccttctgtctccaacttccttaaaccttctaaagaagaggataaagtagtttatgactcagccctccccaccccacctctatgaccccaaggccttgagtgaggcatccacgtccgtcctgttcccctcatcctagtcagtccatctgtttgtccctgccaaggggccctgaggtccgtgaatgcatgtgtcttccttgacccactccatgtctatatgtcaccttcccctggccctgcctccccacgtctcccccttgtgtctcccttctccctcacctgctgcttcccctcacagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaaggccctttaatcctttctttggtgttggcaatggagtttgagggacccctgaatgagcagggcctgggtccttgctctgcattgggacttccttttcaggggaaactgggatggagggcctgggctcattgaggaggggctgtgaacaggctctgtgaagcagggagtctgacaggactgggggacatcgtgggccttgtgccctacaggcagaggagctgccatccatagcaccgccctgttccagcagccagctgggccagacagcacgtcctgaagcaaaaactgcaagaagtgacacattttccttgagcagggtgaaaacccaaaagcctgagtgtgatgttaagcctagggctgctgtctgccctacccctcaacacatacactgcacacacacacaaacacacacacacacacagccatcccaacagtatcagtcatttctgtcctcttcctgatagcatctgtggtaggcagaataattccccttctccaaagatgtccatgttctaatcctgtgcattgttcttatcttacatgggaagaaacttggtgattaagattttgagatgggatgattatccttggttatctagttaggcccagtgtaatcccaagggttcttgaggagacaaggaggtcaaatgtggaggtaggagttgtgacaatgggagcaagagattggagtgatgtgtggaaggaggaacaagccctactgacatctgactgctgacctccgaactgtaatagaataaatgcattaccactaaattcgtgctaataacagtaataggaaattcaaataccatccttctgatttggggaacaaaggtgactaacacatattttattataaatatttattttaaaaaatttcttggcagttaaaaggaagtggcataatgagcaggacaggacagttaccggctccccctcagatgcctctggctggcttctcacattctccaagatccagcctctaggctccagtctcggctacctctgctgggcggtagctcacaccccctttggttccccttctgtgtgtacacaacaggaaaggctaatcagaaaactggcccaggagcagctcatttgcatgcgctttgcatgaagtgactccacaagggtgggggaagcttgtgcctgaagaaagggtcagtgtaatacctgtgctgccttctcatctgcacaaggaacgcgacgctggtgacagcaaaaaggaggccaaaaaccagggctaggatgtcacctgcgatggagagcagagagggctgctttgggaaggaagaggggtctgcagagttcctcaacacctgcctcagtgcactccaccacccctgccccgagttctcaggcagcccctagtgcctcagtctccagaagaggccagccaagggatgagggtggatacacgagaaggggtaagataagcaccgtttttgcttcctaaaagccaagtaaaagggccgtttggggccaggcacagtggctcatgcctacagtcccagtgctttgagaagctaaggtgaaaggattgcctgagcctaggagttcgaggctgcagtgagctatgatcgtgccacaacaccccagcctgggcaacagagtgagaccctatctttaaaaaaaggggggggattgttttgcgagagggatgctgggagatttctcaagcttcattctaatcaattagcctctggggacaatgggggaatccccaccatgatctgcctctctaatattggggttggggtctgttctgcagaaaaggagagggagcagaggcggtcctgagcagccctggggctgaatggtgctgaggagtctcctggcatcaggaccaagaggaggggcagactcaccagcagccaggcaggaattcagctggactggagagaaaaaggagatgtgagaggcgggctgtgaccaccaatgacagacactggcacacacatgggaggataagggactactggctggggggaaaccagacaaagctgtacctggctcagcagcccgaggactgctgtccactccagcagggaaggaggcctcaatcactcgcccattcaaaggctgcgtcgctcggaagttcagctgtagccgagagtcaccaggtccccacagggtgtcagagagggtgtggagctagggaggtcagtggacagtgtgggtgggttcatggcatgacaggaaacaagggtcccaggccagctcacaaccagcacctcagggctccaccctccagctcctgtattccccatccagcctcttgatttcttttataaataaataaatgtatcctaaagatggtaggcagtggtgggatcatagctcactgcagtctcaaactcctggaatcaagcgatcttcccacctcagcctccttgagtagctgggactaggcgcataccaccatgcccggctatttttggttttgttggggtttttttggtagagatggggtcacactatgttgccccgccttgtcttgaactcctgggctcaaaccattctcccacctcagcctcccaacgtggtgggattataggcgtaagccacagagcccagccttgatttctttcttctcctgtttctcatctcatcttacatcctctttcccccgcacccactgtgtccacacacaccccaggcccacctgcttagcactcagcatcactgtctggttaaacacagtccagatgacaccctgggcacagggcggtgtagtcagagacccctcatattggaagtagcggctgaagtcagagggcaggagtgcagatatgtccagtcctgggacctgagtctctgagcctgtgaagaggatctatgttggggtctcatctacattgcacccccttaaagcttcagggtatagggatacagtttcacctcccagaagccaaggtaactcaactctgagaccacttcttcgctaagtgcaggcccttcccataagacgtaactcaaaaaaaagtacagggctttggagcaactggaagaggcctgaggaagcaagagaggaagaaagaaaggaaggagagaagggaaggtgggagggaagggaggaaggaagagaaggaaagaagaaagaccgtctgagtctacactcttaactctgtgtaccatcataaagtgctgggccacaagtttaagcccagagcaaattaaaaagaaaaaatgaatcccagcactttgggaggccgaggctggtggatcacaaggtcaggagtttgagagcagcctggccaatatggtgaaaccctgtctctactaaagatgtaaaaaaaaaaaaaaagaaaagaaaagaaaaaatgatctgaataacttgtaaataaatatgaatattgataactatacaaaacagacacaagaaatgcaaaggcagagttctacctagtctagcagaaacctaaaaggtctagtagagtaagtgagatttaaaatgacccaagagtgactaagaagagaacgatttccaacaaaagtatttacaaagttaaaatatttgatgcttattaaagataaacagttctcagaaaaagtttagctctccagacttgaccttgacaattccaaacaccattttttggtcttgttttttttgtctcattttggtttttgcttggttttcttttttttttttttttttgagacaagagtctcgctctgttgcccaggctggagtgcagtggcacgatctcggctcactgcaacttctgcctcccgggttcatgccattctcctgcctcagcctcccgagtagctgggattacaggcacccgccaccacgcctggctattttttcgtatttttagtagagatggggtttcaccatgttggccaggatggtcttgatctcttgacctcgtgatccacctgccttggcctcccaaagtgctgggattacaggcgtgagccaccgtgcccggcggtttttgcttggttttcaatctgtaggcagccgtttgcgggtaactgtgtctgtcagcttcatggttattatcaagatgagcgctggctcatgcttcaatccctcctgcactggagggagcccatctccagcctcagacctgaagctccaaagggtgattctttatgaactaggccacagagattagtggccagaccaacaaactgaccttcctcagcgatttcttccaagcgagacagcaactgctcataggcactgttttcttccgggccctcctgggggatgacattgtaagacagatgagtgcatgtatccagggccatggctgaaggccggaacatgaaggggggttcccatagacctctcccattcctcagctctgagaatgctgagggaacataaaattgtaatggttgttgctttttgttgttgctgttgtttttttttttagagacagtgtctccctcttaaaatcctatgtattatttcaaactctatgtactcttgctgtgcgaaccaacaagcttggtggactggttttcaatgacaagctggagagagagggagagagcccactttacttaggatactaggctctcagtgacccgtgcccttctgacgtttgcagtctcactcactgctgcctccgtacatactccccacaggaaaccatatatacacctttgtgttggtgtcacctctgcattcaccttcatgattctgtgtttggcttttcaggtgaggtcctgacatgccacttcttttatttattattcttttttcttattttgcttatgaacctaatgttaagaacattatgaacctaagagtatgaacatattgacatgctatgatggaggcatttctctgaactttgtgctgtgtggctggcattaaagaatcagtgagtgtggctgggcacggtggctcacacttgtaatcagcactttggtaggctgagtcaggcggatcacttgaggccaggagtttgagaccagcctgaccaacatggtgaaaccctgtctactaaaaatacaaaaaaaaattagctgggcatggtggcacacacctgtaaccccagctactcaggaagctgaggcaggagaatcccttgaacccgggaggcggaagttgcagtgacccaagatcacaccactgcactccagcctgggcgacagagagactgtcaaaaaaataaataaataaataaaagtgagtgagtgaacctagcaggcatctcaccatcccttccctttactggcctcctctaatcatggtgtatgtagccattccctaaataggccatattctgagtctttgcacattctgtttcctctgcaatgaacacctccttttcttttctaccagtgaaggctttaagtgtcacctcctctgtgaccaccatctttactatgtccttcctatgtgtctgtcatgtcagcctcccccactggctgtgggctccttagaggcaaggacctacagcttcagaatccttgttgggggctggtgcctggttcacagtgggtgttaaatgaacaaacagtgcgtgaatgagtttgtcagccaggggcctgagtgagcttgctgggatggggtctctggctccacgatagagtccgggaggagcatgggatgggaaagcggggagtagggggtgtccaggatctggtacctccagaaaggcggccaacacggccaggcctcccgggcgccccaaggcctcgtcaactctggcaaaggcggtgctgaggtgaaccacgtggatctgaaaaggacacgagggtaggagagggccacgtctctggccccgctccgccccgctcctttgccccttctcggccagctccgcgctcacctcggcagggaaacggtggccttccacagtgtgctccgagcccggacgacctgcagccccccagtgcagatgcagctgcagagcccggtactcccgcccgggacccagagccatctctagcccaggaggcagggtcagttgcactgcgtagggagaggcaagtgagccggccccgcccggtagggccagcccaacccccgggcaggcactgccgcgacggttcccttccctgcgccccgccccatccccaagtctcggcggggagaccccctcaccactgtggccattgttgcgcaggcgcagttctgggagcggcgggagctggaagcccaggagttccagggggcgcagggccgggcagaaggcggcgagctgggggcggatatccaccggggactggaagcggcccgcgcaggctggggacacccggggccagggcgggtcgcctggggtgggagagtatagtgaggaagtctgacgcctaggtcaggaacttagggaacccgggtagaaaaggtgagggggtgggacggtgggcggcgggtgggacgcccgggaccagtgttcagggacggctgtaggggagatccacagagctgggttcccagattgggtctgtgcagcgggtgggtgtctcacctccatagcgccaatgactctggtcatcccctgtataaatgaaaaggatgaaccgctcaagcttagagccccaatcccttcctggcgaccaaaacgatgtcacaaacgcagatgccttacaggagcattacgggtaacaaatgccttaagcgggccaggtgcaaagcacaggagaccgcacccaaactcaacaccgcagctgggtgggccaaacagcaatcctaccagcttgcaatcattgtcttagggtctgtaaaagtgagtggctgcttcaggccaggcgctgtggctcacgcctataatcccagcactttgggaggccagggtggttggatcacctgagatcaggagttcgagaccagcctgaccaacatggcgaaaccccgtctctactaaaaatacaaaaattagccgggcgtggtggcgcatgcctgtaatcgcagctacttggctagaggctgaggcaggagaatcacttgaacccgggaggtggaggttgcagtgagccgagatcgcgccattgcactccagcctgggcaacaaaagtgaaagtttgtctcaaaaaaaaaaaaaaaaaaagtgagtgggcacttcagtcctgagtcccaaatgagtgagtacaccatctttcctttctcccttctttcttctccccactcatccctctgccttgtatggtctccaacccctttccccaaattcctggcttgggagtcaagaagccacgtttctctacctgctgtgtcccttcttcctaggtctcaatttcctcattgtagcctaagatgagatgacttctaccagctcttcttgcttgtctctggtacccacttcacctcccaagctttccttttctcttcccctcaaactctctgactctccttctccacctatttttttcctctgtctgcacattttttctctcatctgcagttctcatccctttctcttctccagcctcccccttctctcccatctcatccagctcacctctctccttttgcaccctttttattttctctccacatctgtccctttctacctccgagagtggggatggggatattggtatgggacctctggaagggcttctgtggggagtacagtctcccctccttccctgagtgaacagagcctaggctggggtatgggaggggagtcatgaacctcctggaacctggatttggagattgatgaccacttaccttctttgtccctgtgggcattattctggggttcttgaggatctccaggagcctcaacagtaggtagatcctctaacttcagggagccctcttcttctgatttaggcttaacttcaggtagatcctcctctccaggtagatcctcctctccaggtagatcctcctctccgggtggatcctcctctctgggtgaatcctcttcactgggcagatcctcctcgcccagtgggtcatcttccccagaagagcctcctcccaagggggaatcctcctgcatccggggcaacctctggggatggacaggcaccagaagcagcagtgacagcagcagttgcacagtgaggcctggagcaggggccgggatcaacagagggagccaggggctggggcacaggggagccatgcggctgactgtggggtgtcccagcacacggtgtgtacgggctgtacgtgcattggaaacgagagctgggtgggggaggagcaagcctggaggggagcaggctgactcacagagcgcccttttgcagagatggagccaaagtctcacaggtttgtctggccctgtgccctctcccccataccaaagctaggatgggggtggagtgaggggcaggtgtgtgcacaggcagaaggttatcggggccatggactcagcttggaacccaaggcaccacctggcactatgcaggctctccctggcaccacccagctgcttgccagccagcctcagctaaccctggcctgcttcccagctccaggcacagaaggggaaaggcaggggagctggggcccccatgtcctctggctgagagggaaagcagctcatgtatacatccctgactccaccaggaagcaggtaaagaggtagggcaggctgctaggggagcccgagggtgagttaagtaatgggtatgtgggagacaaacttgagcttgaatgaaaagcaagtgtatgtgtcagaggggctctgataggtttaacctatatttatttttcaacacattactctcctgctcaaaagccttcattggctccccactgcctgccacgatatgcacattgtgtacttctgacttccaacttccttcaaaaccttgcccaagagacctttccatcttgtctcctactactctccctcatactctagccaaattaaactattatttttttctccaaaccttttaccacctttgttaatctagttcttgctccctgaaatgctatttactattgcattcaacaaatatttatttagtactaccataggtccagcactgggctatggactagggacatggaaatgaataagacacggtccctcattttgggaggctgaggtgggtggattgcttgagtccaggagttcgagaccagcccgggcaacatggccaaaccctgtctctactagaaatacaaaaaaattagccaggtgtaatggcatgtgcctgtagtcccagctactcaggaggctgaaatgggatgatggtttgagccgaggcggttgaggctgcagtgagctgagactgtaccattgcactctggcctgggtgacagagcaagaccctgtctcaaaaaagaaaaacaaaaacaaaaacaaaaaacgctacctgccctgagcagctcacaatctagtgagtgagggcaaaccctgtcaatatcatcatattgagggaagagagatgaattctgctttagaagataatatagaagtaggcaaatttgatcatgtccttgaagaaataccagttccattggtaaaaacaatagggagaatgatattctgggcaaagggaaggcataaaatattatgagcaggagagtgacagaatccagttctcatactaggtcacgttgagggcttgagggctagtatggagcacagattgcaggggaagactgggtgcaaggagatggggcagaagagtgtgaggacaccaagaatgggcttaggcctcccagtttttttcttttcttttctttttcttttcttttctttctttttttttttttttgagacagagtcgcactctgctacccaggctggagtgaagtggcgcgatctcggcccactgcaatctccacctcccaggttcaagcgattctcttgcctcagcctcctgggtagctgggactacaggcacctgccaccacgcccagctaatttttgtatttttggtagagattggggttttgccatgttggccaggcttgtcttgaactcctgacctcaggtgatctgcccgccttggcctcccaaagtgctgggattacaggctggtttttttttctaattaattatttttaaaatttattttagagatgggatctcactgtgttgcccaggctggagggcggtggctatttacaggtgcgaccctgttactgatcagcattgagttttgacctgctccaatttccacctgggtcagttcaaccatccttaggcaaccaggttgatgcagaacttagtgcagacacctgactggtatactacactacagcccagaaatcctgggatcaagtgatcctcctgcctcagcctcccaagtagctgggactacaggcacacgccatcacacctggctagtctgcccttttaacaatttattaagcctccgccagtccttcaggtgctgttctaggccctacagatgcagcattgaatagagaatagctctactgttttgtagctcacattctagtaaggctccattggcttaaacaaactaaaagagaataaggccatttcaggtccatatctagggctaatattcagtaggcacccaccaatatggttgtgtaggttaattaaatacattaagatatttctaatcctgttggcatatagccatggcccctagctccagggtacccctgctaccctagctcttccttagggaccctccagacctcctgatcccttatctaaagaggtattccctggcataacagagtccccaggagcccacttgagtgcctcagccaccttcaactctgataggtcagtgcttgtgcacttgctgctgtgtcacaaatagttttactggccaggtgcagtggctcatgcctctaataccagcactttgggaggccgaggtgtgcagatcacctgaggtcaggagttcgagaccagcctggccaacatggtgaaaccccgtctctactaaaaatacaaaaattagctgggcatggtggcaggcacctgtaatctcagctactcaggaggctgaggcaggagaatcacttgaacctgggaggcagaggttgcagtgagccgagatcgcgccactgcactccagcctgatcgacagagtgagactctgtctcaaaaacaaacaaacagacaaaaatcgtcgctaacatagtgaaaccccgtctctactgaaaaaaaaaaaaaaaaaaaattagccgggcgtggtggcggccgcctgtagtcccagctactcaggaggctgaggcaggagaatggcgtgaacccaggaggcaaagcttgtagtaagccaagatcgcgccactgcactccagcctgggcgacaaagcgagactgtttcaaaaaaaaaaaaaaattttactgtcctccctgtctaatctcttctgttctttgaaactcagatgaaaggccacctccttcaggaaactccttaaccaaccctctaccactagtctggaaaagatccctggcatctttgagccaacccagttctttgcctgccctcaataataactttgtccaccgtctaactcatataagggtgataactcattttatctgctctaacggccttcagctccataagggcagggtccgtacttgattgagtcagtcttttattcaacagccattattgagcattttctttttgcagattaccttgccagatgcttgagaaataccaaattgactaagatatattctctgccctcaaggagctcattgtcaatgacctgtgcatgtccacaactatcccataaacatgacataactttttacattattattatttttgagacaaggtcttactctgtcacccagactggagtacagtggcgtcatagctcactgcaggcttgatctcctaggctcaagtgatccccctgcctcagcctcctgagtagctaggaccacaggcacaagccaccacccctggctaatttttttatttgttttgtagagatggggtttcgctatattgcccaggttggtcttgaactcttgacctcaagtgatcctctgacctcaagtgatcctccaacctcagcctccaaaagagttgggattataggcgtgagccaccatgcctggcccaacaccacatttttgtggcactccaaatcatctgtgttgtcggatgactgtcatattgtacaacaaaatatatatgactgaataacagctgtcctccaaatggtcaacctcagatgtagtcagcctaagattctagggtgccatttctggagccaaattcagagctctccatggcagtgtggtccagggtacactctggatggccagctgattgtcttggtcagctctgtcattagcttggaacttgcttggcccctgacatatggaagtacatggtaatatctgaattggatgggcctatacaagacagaatgtggtaacgactaatccagctctctgttacagctcactcatttttcaaatgcgattccctatggctctgtttctctgtctctctcgtctctggtctgagtggagaatgtggactctgaccctggatcatgctgggagtctgccaaaccctcaaacaggtttgagttattgtttcctgagtctccccgggttgggacagagtatactcaggactgactgaccagggcaccccacacctggatcaggacctctctgtggttattataggccaagtgtttgctcatgagggtttgtgttttcaaacactgaggggtcatgttactaaaacatgtctctgcctatcccagcatggcagaggaggaaactattcactggtggggtagaagggaaaatgctccctctcccaagccatagcttgggggcaaagactgatcaaattccttgtagaaccttgaggctgacttgtagttctggctacctccccatctatattcatttccaagggctgctgtaacaaattaccaccaagtgggtagcttaaaacaacagaaatggattttttcacagttctggaggccagagtctgaaatcaaggttttgacaggactggactctctctgaaggctctggggaagaatccttccttgcctcttctagcttctggcggctccaggcattccttgacttgtagctgcattactccaacttcacatggccttctcttgcccctgtgtctccactgggtgtctctcactgagacacttgtcattggatttagggcctaccaacataatccagaatgatctcatctcaagatccttaactaattatgtctgcaaagaccctttttcccaacaaggtcacatatacaggtcttggggattaggacatggacatgtctttatatggggccaccatttagtccaccatcagtgcaggggaactgacgtggacgcacaggatgagaagggatgagttcgtattgaagactctcatgcttttgcccttatcctgctacttatctttgcaaggccgtgtcatccactcccatggctcctataaattgatgacacccaagtattcccaggctggactctctccccatgccagacccataaccatctgcctaatagacaagacccaagacatctccacttggatgtcccacaagtatttcaagtttaacaggccccaggttgaatttgtcttccccgcaaatctccttttcatcctccttcagtgaatagcaccaccctccacctagaagccagaaacctggtaccatctctactttcatcttttccttcaccctagcattcaataaccatgccctatggattctaccttctaaatttttcatctacatttttcatcttggctcatactttcgtcacctcttacctggatgactgcaactgcctcctgatgggtcttgctgagtccagccaaccagagtgatgtttctaaaatggcacatctgatgatctcactccctgtttaaggcctttcaatggtttcccattgcccttaggataaggttcacagtacctgacgtggccttcagagggccgccattgccctggtttccatggtgggcttgtgacctagggaggtccaatcagtgaagctctctgtctgaagtatttgatggctaagggaaccaactctgcggacaacacataaagaagcacacagccattgtaactgtgggcagccatcttgtacccacaatggaagccagccttaagatgaaggtaaaaccatggaaggcacagtggagtggtggaaagaggtccttggtaacatgattgagctgctggattaggccaacactagggcccacctgcttctggacttttcagttgcatgagccaataaattatcttaatgtttagccactttgaatttattattacttatatcacaattttactgatataaattccttctaagtttggcctctgtctacctctccagtctcctttgtcatcactctctcccttgcagtctatgctctcatcttacagaacttctagcagttccttaaattcatcgtatgcttgcatatgtgtgtgtccaagcctttgtccatgctgtttgactcttttttccacttcccttgctgccagcgcccagctctgcctagccaggttttattcatccttcaggtcatcagttcacatatcacttctttgagaagaagccttccctgactcctacactaggatcagtcccttcactgcatgcttgtgtagaagactacatgtctcttgtaatgtttcctcattttatggtgactccttactgtatctgccatgctggagtgtaagctccctgtgggcaggggtcatatgtctcttgcccaccatttcatcttcatgcctagcacaggacctggcacatgattggcatttaatttttttttttttttgagacagagttccgctcttattgcccaggctggagtgcgatggcatgatctcggctcactgcaacctctgcctcctgggttcaagcgattctcctgcctcagcctcccaagtagctgggattacaggcacgtgccaccatgcccggctaattttgtatttttagtagagacggggtttcaccacattggtcaggctggtctctgacaacacataaagaagcacacagccattgtaactgtaactcccgacctcaggtgatccgcctgcctcagcctcccaaagtgctgggattacaggcgtgagccaccatgcccagcctaattttgttgaatgactgatgattgttgttcaaagcatccctagtgcttctccagcatccatcggattgaaagcaaaatttgaggataattaaagaataaaggggttattgactatcctctgaacctcctcctgttggcccctcctatctttggctgtgggagcggagtttagcagctgttccaggtagagtatggtgtgcctgacttgctctgtgggagactcggtccccagggaattagttgtcaccaactgttttcagtgtgtcttctcggctttgccctcttcctcttctagagttgaatgattccccaaccgatgctcacaggaggctctattccccacccctcttccacccacccaaagcactaacacacactggcagcattcacaaacacacccatcaccaactgcaccccaggtgttgtggtctactctcatcacctgggctcacagtgacaccaattaccatgggattatctgtcctcttccatgtttgagctcttagtgtgtggactgtcccacattcacttgagacagtgtaaccagtcctttacctatctggtatcaccaccagtttccttgggacataagcccaaggtacagtctgatccaaactctccccttccttcatccaagcccttcaagttattcctccctggtctaagcccagcattattcctttcttagaattcttagaatgtcagagctggtggggaggtggtagagacctcagaaccctgacaatcctctggttcttggcttgcggcccagattcctaggagtccaaaacagtagggagggagcctaaagtttctgacattttgttttttttaataactttttttttctaactacaaagtaatgcatgcttaatgtagaaaacttgggaaaggcagaagtataagagaatttttaaaatcaccctgtttgtcccattcatccctttagcttcagtgatccagtgcctggcacagatacagattaggtacttaatacacatttgttaaacacattatcttcaattccattacccggagataaaaaccacagttaactttttatttttattttttatttatttattttttttttggagagatggagtctcgaactcctgggctcaggtgatcctcctgcctctgcctcccaaagtgctggaattacaggtgtgagctcccgtgcctggcaacagagttaacttttgattgttttgccttccaacattttatatatgttttatacaaaggggattatattatacacctttgtagcctgctttttttcctctcagcaatatacttactatgtgcgttttcccatatcgatagcttctttacaacaccatttttaatactttcatatcattccttcaaatggctataccttttcctagccaattctgggaacaactgaccccctggcatttggcatgggcccaggacagaatgtgtactgtaatgaccgccccccgtcccaattctccagataggacattaagttcctgccagcatctgcagcccgtctcctgactcaaagttcaggctgctgctccaacatagtgccactcagaggagggctccacacctgcccccaaccttgccctgccctgccctgccttggccggcgccgcgcacctaaagcgccgctctggcggtggggctggacagaagagaccctgcgcggtccggccgctcgccgcgcatgctccttcctgcgcgctgccctccccggccccgcctccgcggctcccgcccgcgagcggttgggatttgaatctgccgcggactgcagccggaagtgtcgatccctcagccagggcatggagctctcctgccccggttcgcggtgcccggtgcaagagcagcgtgcccgctgggagcggaaacgcgcctgcaccgcccgggagctgctagagaccgagcggcgctaccaagaacagctggggctggtggccacggtgggggacctggcacacgctcccattataggacagggaccccagggtgtgggagggtctctgcgaggtcggtaacccggagcatgtagggagcctgggcagacttctgcggtttctgggggcgcttggcgttagccttctcttcctctaggctaagaaccaatgttctctccttccgcagtactttttggggatcctgaaagccaaggggaccctgcgaccacctgagcgccaggccctgtttggctcctgggagctcatctacggcgccagccagtgagtggaaggggcacagggagaggaaaggagggagagtcctggcctgtggccgtgcacagagcttggagtcagacttaggttctatttggagtccgccagttagctcacctgtggccttggcccagggccttagcatgcccttgttctccatctgtacaatggggtaatagcactactattagtgctattctcatgaaaactaaatgaggtggtgcttgagtggttctagagctgcccttttgctgtccttgcccacacagggagctgcttccctacctggaaggaggatgctggggccaagggctggagggcttctgccgccacttggagctctataaccaatttgctgccaactcagagaggtcccagaccaccctgcaggtaacctggagatgacctcaaatcttgccccttacctttccccttcatctggagacccaaacttcatacatttcctgcatttatagagccctctgggtgctcagctctgtggtaagttccttgtagagaaacgagagtttctctcaggagcacagcttactgaaggctgggaatgtggatacagatgaatgcaatataaggagtggcttctctccctgcttccaatcctttctccctcactccaggagcagctaaagaaaaataaaggtttccggaggtttgtacggcttcaggaaggccgccctgagtttgggggccttcagctccaggacctgctccctctgcctctgcaacggctccagcagtgagtgaactcttgattccagccgcctctctcttttagtttgtatgactgctgccctcagctttgtgggatgccttggggtcgatcccaaactcttgcctcgaccctgagccaaattgcttctaaaaaccttttgcaagagtaaatgtgaacccattggagtacccagggtctgcagcctgaggccctcagctggaactgtggaactttaaattgaagtgagggggcctgtactagggcctgaggcacggtttctggaaaagtttcagatgcggggctggcctgggttagaatttctgtctctgggttaagcctgagttaagggctatagtcaggctgtctgtagcatcctccttgggttgataaactttcatcttccaatctggcctcctgaagtatggctagtctgccagtgactcttcagtgtgggatggaagagggctgtgtggtgtgagcctggttctgagtcctacatgaaagaaggggatacagtagccagaagcagatctttcctggccttcaattgaagtatgggtagagggtgatctgcacatcaggcagggggaattctgcctggctctgcttcccctcagacttcccactgttgaattccaggtatgagaatctcgtcgtagctttggctgaaaacacaggtcccaacagccctgaccatcaacagctcacacgtaggttcttgctcctcggcaacgcaggctggaggcttcctctcctgtattcctttctgattctgacctccaacaatgtctggtatgaccctatcttccactgacatgtatacagtgtccctactgctctgccttttcttcaagaagtcagaccctgaccctggtcccttccagaataacctctttcacaaccatggcacccaaagtcaaagttgtatggggagtaaggtgggagatgttattccaggggctgcccgactgataagtgagactgcccagagagtccatactattggtcagaaacagaagaatgaccagcaccttcggcgtgtccaggctctgctcagtggacgccaggcaaaggggctgacctcaggtagcttgcctacttccccttcaatcctcaactgccccatcttttatttttatctaactccaaatgccgaccagctgctcttttcttactcacccttcttcctgtactgacccagcacataacccctattttctcagcctccctttcctcttattcccatgtatcttgaagctgcaccagaataacagcgctcccatcccccagggcgctggttcctacgccagggctggctgttagtggtgcctccccatggggagcctcggccccgcatgttcttcctcttcactgatgtgctcctcatggccaagcctcggcctccactgcacctgctgcggagtggcacctttgcctgcaaggccctctaccccatggcccagtgtcatctcagcagggtctttggccactcaggaggcccttgtggtgggttgctcagtgtaagtaataggtgggaaccctagacccaaaatatgtctcagatgcttatgggctggtttatctccctggtctgggtcccttttcataggaacagagccatctacattgagagaggatagctggggctcgggcttcatacctagtcattgtctcatccctgaattagctccatggaaacagcaagggcttcagctttagcctggacctttctgagccatgcgctaagaggtggtctctctctagctgtccttccctcatgagaagctactgcttatgtccacagaccaggaggagctgtcacgctggtaccacagtctgacttgggctatcaggtaagttgtgtcttcccccaggaagggtgctgtgatgaggcccacaagcaggaaatatgcagttcctgtctcatgccctacattggtctggcacaccccagccaccaacccccagatgattttgtctgaataaagcactcataccagtgcctgaactgactgtcttctctccacagcagccagaaaaactagaggaatcttatagattccagaactcaggatacctcagggataggtcacagccaagagtacaaaggaatcttcagtactgaacaaaacagaacccttcatgatttgacaaaggtcactttctgtttgcctggaccaagctactccagatcatctgaccaactcttaaaaatcacggccaggcacagtggctcatgcctgtaatcccagcactttgggaagcagaggtggcaggatcattccagcccaggagttcaagaccagcctgggcaacacagtgagtgagaccctgtctctatttaagaaaaaataattaagaaattttattaaaaaagaagaatcaggaaaccaagtccaacccaactaaacctcaaatgaaccagcccctaacacagatgaggggatttgggactgataagctctgtgctgtgtccatggcccgtcatttatcaaggctgcagctttgtaaatgtggctatttttatgttgtgtatagtttctatcatttatttttccactggatttgagtaaagttttttttcttttttttgggaaagacccttctgtctcagttttgctatgagaaaagggatttttgggccctgaacgcgggcatgctggtggcctcaggaatacgaggaaaagagctggagctccctctatcttctctgctgtcacactggaaggcagcctctttttgtcctaataaggacagctcttcaagaaggcccagttgtccttaggcacctagtatgggtgtgtacaaccaactaggatcgaaaaaacacacaggagcactccatcatgaaaacagactttgttttagtcgaccttcagctgtcgtccctccttcccagccaaggctgtgactggggccctttgccacagcctggctgcaccttctccgtagtccccgccccacctcccaggaagtagctaggttccatgtctctgtgctccagtttgtgggctcctcccaggcctgactgtcaccaatctcctcctcgtcctcctttaaacagaagtcctcaggaagaggtctgctggcctctgtgtggggagagatcaggaatgttccagtttcagagactttgtctccacctccagcagactcgcctcccgagccttcacctggttctgaagcctccatatccttgtccggcttgctatcttgcagcagctcgtggatggtccatagcttcatgttcagaagctcctgctgggctccagccagagtagtcacactgaagaaatgtccactcagtggctcccaacctatgtccccattcctccctcctgccacaaattccccaaaaattcacagaatcattgctctcctcaccgctcaaaaagggggtccagctgggccatcaggttgttcaggtgctgctctgtctgggccagctgttgtgtcaactgggccagctgttgctctggggataagggaaaaaagggggcagaagtggttatgtatcttctgctgtcccctaaactcccccgacccagcacagacttctgctaaacccacctgactgcagtggctgctgcttgcttgcctcctcgtggagaaccgcagtttcatctttcccctgttgtggaagaaggaaagggcagtactgaagcaacaaggttctgctccatcacctcagtctccagagccagccaagagagagtgcaatttgagatggagacagtgattgggtttttacctcagagaatcacaatcctagtctatctagctcctcacccagcatatgaagcgacgtcctatgtcccacacatggtcagtttgctgaaacacctccaggaatgagcaactccctccggtttgaaaaaagctctggtggctgagtgctgtggctcacacctgtaatcccagcacttcgggaagccaaggtgggtggatcacctgaggtcaggagtttgagaccagcctggccaacacggtgaaaccctgtctctattaaaaatacaaaaattagccgggcgtggtggcaggtgcctgtaatcccagttacttgagaggctgaggcaggagaatcgcttgaacctgggagccagaggttgcagtgagccgagattgcgccgctgcactccagcctgggtgacagagcgagactccatctcgaaaaaaacaaaaactttggttgttagacagttcatgcacaaagccaaaatttgtcctttatgtatcttctttccatagtgcttactggagccttccaaaataatgtctcctcaaggtgacagcccctcaggaatttgaaggcaatggtcacaccctcacccactttcctgagttttttctggtttattaacgtcagtctttacagtcagtgctcattgacggtggttttctctggttgtttcctgaacacgtagtgctcttaaagcaatgccctgaggagaatacaattctccaggggcattctgattggcaggtgaagcacagtgccatgttcccagcactgatttgggaagtggcttgtcacatcccacagtgaactcagtcaactggaatgcctaactctctttcataagacctcctgctacattatgtttctcccagactgtactcaggtccaagaacagaatttactagtctatccttctcaaagttcatcattaaattcagtcattcatcctagcctgtcacatctacctggggtcattattagctatctcttctagtttcatatatctaaactggttccatcggttctattttataatgcaagtacgtaatagggtcacggctaaagacacagccctggaaggtactgtttttcaaaatgtactgtcaacttacatttcagggcctcctcccaaggagaacatgagaccacttcatatctggaactctagaaacactggctgcagcaatcaacctcctgtgccaaggctggccccactcttgtagcatggacactgctagctgggttcaaatcccagctccagcagttgccagcgctgggtgacctcgagcaagtgactactcctcactggattgtaggagaactaaatgtgatagtcattatttacagttcaccacacgctcttcacatccgttacctccctggatcctcaaaataacctcataatattggaaggccaacggactactgtctttattttacagacagggaagctgtgtcttgttcttggtaccctggcacccccatgggagattcgggctcaggggatccccacgcccggcggtcccgcacctgcaggggcacccctacccccggccgccccgtacctgcaaacacttgtacagcacaaaagccgcgacggccgcggtgtacagcgcccccagaggcagcgacccggcccgggtccgctcgcgttgatccttgagcggtggtcgccgccggggttccgtggctccagagccggggtgggctgcgttccctgcggagggaggatacaggcgagtcagccgagctggggcctgggacccgtgcgcagtcccagccctcctccagcagccctagctggtacctgggtgtgcccggaggtcgggattggcgcggtctcctaggaccccggacagcgcagacacaagcagcagccccaccacacccaagagcgaaactgcgcccgccattgccggcccacgggtggagggatcgggcgggcggtgccgaagcggtccggcattggccggccgccccaacgcgcacgcgcacgcgagcaggccggccggctccggggaggccacgcccactccccgtagggcggggccagaccatatttgcataagatagtgtcattctagctttcctgtatttgttcatttcgtgtctattagctattctgctagccacaatgcctctgaaagcctatagtcttagaaagttatgcccgaaaacggtttttttaatctcacgccaccaactttctcaccctaatcataaaacacaatttctttagggctataaaatactactctgtgaagctgaggacgtggttcgtgctgaaggcctgtatcctaggctacacactgaggactctgttcctcccctttccgcctaggggaaagtccccggacctcgggcagagagtgccacgtgcatacgcacgtagacattccccgcttcccactccaaagtccgccaagaagcgtatcccgctgagcggcgtggcgcgggggcgtcatccgtcagctccctctagttacgcaggcagtgcgtgtccgcgcaccaaccacacggggctcattctcagcgcggctgttttttgttcccgagaccacggctcactgcagcctcgacctccccgggctcacgcgatgcctcacctcaggctcccaagtagttgggaccgcaggcgcacgccatcatgcctggctaatttttgtattttttgtagagacggattttcacctgttgcccaggctggtctcgaacgcctggtgtcaagcgatcagtccacctcgccctcccaaagtgctgggattacaggcgtgacaccgcgcccggtcaacgcggctgcttttcatgcgcgggcagctttacgctgttcttggccttgctatgaagtccttgtgctcattactccaaatatggagcattcctgaaacagcctcctcttctacctccctctccctttggcaaacgccatagtagccaccattcactgtgtagctggtacacaacatatggactctgcttgggctagaatcctgcctcctgtactcaagagcggtgaccttgtgaaacttagttctctctccgtgccttcctttccactctgaggaatgaagataagcacttacttcaagagctatgatgattaaatgggatcactcaagttagaaccgtgcctacttattagtgatttttttttttttggaacggcgggtcgctctcttgcccaggctggtcttaaactcctgggatcctcccgcttcagcctcccgggtagttgacattacaggcacgtgccaccccgacggactctagtgattttttaacttgagcagctactactgtaagccagacagttgaaattacactgactctccctgacatgccgctgcattccctttctgcatactgggttctacacgaccttcagttctcagctcaagtgtgttcccatcattcggaacccttaattcaacttctaatttattctttagtgccgctatttcactttcttcaataccactagacaagcagtccccaacctttttggcatcagggaccggtttcgtggaagacaatttttccatggacgaagcggggtggagggatggtttccggatgaaactgttccacttcagatcgtcaagcattagattctcacgaggagcgtgcaacctagatccctcccatgcacagttcacaatatggttcgcgctcctatgagaatctaatgccgtgctcatctgacaggaggcggagctcaggcggtaatgattgctggccccactgcccacatcctgctatgtggcccggagcctaacaggccacaggctggtgctggcctgtggccgggtgttggagacccttgagctaggctggtcctaaattccacaagggcaggagccacctctcttttttctttaccattttactcccagagcctagcacagcacgtggcgcctggcgatagcaggcactcaatgaatcgttgttgaatgaaattaatgaatggttaaaatgacccaaaagggtaatatagttaagctctttcaaagaatgaggcaactgcaattcagcaaggttaagtatgctactaatcaggtaagaggcagggtggtgatttcaccagttttttgcctgtctctataccttctgtcgaacagcctttccccatccttgtcttccatgacttcaccaggcaggcaggtattccttctgttccacagagccttccatggtctcttaattgggatacactgggtcatctgtctagttagatcaagagctccctgacatgaaaccatttccattcatcacatttttatctccagagcctggcatacaaacaggcaatcagtacatcatgtgtgttaaataaatgaatgaagccaagatcggtggcttatgcctctaatcccagcactttgggaggccgaggcaggaggatcacctgaggtcaagagtttgagaccagcctggccaacatggctaaatctcgtctctattaaaaatagaaaaattagccgggtgtggtggcgggcgcctgcagtcccagctatttgggaggctgagacaggagaatcacgggaacctgggaggtggaggttgcagtaagccgaaatcgtgccactgcactccagcctgggcaaacgagtgagacaccgcctcagaaaaacaaaacaaaaacaaaaattaaccaggtgtggtggccagcacctgtaatcccagctattcaggaggccgaggcataagaatagcttcaacctgggaggcggaggttgcagtgaacagagatcgcgccactgcactccagcctcagtgtcagagcaagactccatctctaaataaataaataaataaataaataaataaataaataaatgaaatatgggtgtgtcttcttgtttttcctgaaaggaggaggaagggcaggacagggagaaaccctcaccaaggggagttatcatagtgtagttcaagggtccccaacactattggtccatggcctgttaggaactgggccgcacagcaggaggtgagcagcggaggagcaagggtgagcggcggagtagcgagggaagcttcatctgtatatacagccactctccatcctggcattaccgcctgagctctgtctcctgtcagatcagtgcagtgttagattctcatagggccacgaaccctattgtgaattgtgcatgcacgtgatgttgtgggctccttatgaaaatctaggccaggtgcagtggctgatgcctgtaatcccagcactttgggaagccaaggtgggtggatctcttgaggccaggagttcaagaccagcctggacaatatggttaaaaaaaaaaaaaagtctctaataaaaatacaaaaattagctgcgcatggtggcgcatgcctgtaatcctagctacttgggaggctgaggcataagaattgcttgaacccaggaggcgaggttgcagtgagccaagattgcaccactgcactccagcctgggtgacagagcgagaccctgtcaaaaaaacaaaacagaacaaaaaaaccacaatacctgatgatctgaggtggaacagttttatcccaaaaccatcccctcctcccatactcctgtgcatggaaaaattgtctcccacaaaacctgtccctggtgccaaaacggctggggaccagtggtctagctgatgacccagtgacagcctgggtacgcaaagcagggtaatagaaatcttgaatctaagccagttggcacagtcggtgtaaataaggggttcaggccagatataataatgataagtggtccccaactgattattgcctttagagaactcagggcactattgccagatctttttttgaaggaatcaacaaattagaattttaaaaatttgaaatctcccaatttttaactgttgacaaggaatcagtggcatacttagcatatttgacaccaagtggtctttgtgtgtgtgtgtgtgtgtgtgtgtgtgtgtgtgtgtgtgtgagagagagagagagagacagggtctccctctgctgcccagtcaggagtgcagtggtgagaccatggctcactgcagccccaaatttcttggatcagcctcctgagtacctgggactgcaggtgcacaccaccatgcccagctaatttgtgtgtttttttgttgttgttttttgtttgtttgtttgtttgttttttgtagagaccagggtattgcccaggctggtcttgaacttctggcctcaaggaatctgcctgcctcagcctcccaaagtactgggattacaagtgtgagccaccttgcctgttccggatcatttaaaaaacatttttctttcttttctgtctttttttttttttttttttgagacaagctctcactctgttgcccaggctggagtggtgcagtggcacaatcatggcttactgctgcctctatctcccaggctcaagcaatcttcccacttcagcctcttaagtagctgtgactacaggcacacatgcccccatgcctcgctaattttttaattttttgcagagatgggaatctcactatgttggttaggctggtctcaaactcttgggcccaagctatcctcccacctcagcctctcaaagtgctgtgattacaggtgtgagccatcacacctggcccaaatttttctttctttctttttttttttttttttgagatggagtcttgctctgtcgcccaggctgcagtgcagtggagtgatcttggctcactgcagcctccacctcctgggtttaagcaattcttgtgcctcagcctccagagtagctgggattacaggtacctgccaccatgcccggctaatttttgtatttttagtagagacgaggtttcaccatgttgaccaggctgctctcaaactcctgacctcaggtgatccacccacctcagcatcccaaagtgctgggattacaggcgtgagccaccatgcccagacccaaatttttcttgttttctttctttttttgggggtggggggcagggtctcactctgttgcccaggctggagtgcagaggcttgatcttggctcactgaaacctctacctcctaggctcaagcaatcctcccacctcagcctctcgagtagctgggaccacaggcgtgcaccatcacacctggctaattttttgtatttttggtaaagacggggttttgccatgttgcccaagctgttcttgaactcctgggctcaagcgatcctcttgcctcaccctcccaacgtgctggaattgcaggcatgagccaccatgcctggaacaaagttttatttttcaagtggatcatttaaaaaaatgctttatggccaggcacgccacttctctccagcctgggcaagtgagccgagattgtgccactgcggtctggtctgagcgacagagggagactccatctcagataaataaataaataaaattaaaacaaatttaaacattctttatatgacaaaattattctcaatggcaattataaaatgaataataagggccaagaaataaactcagtgaatattttctttccttgaactttgtaaatataatcatgtcagcataaaaacagccatgcattgcttaacaacagggatatgttctgagaaatgagtcactaggcaattttgtcattgtgcaaacatcatagagtgtattttcacaaacctagatggtgtagcctattacccatctaggctacatggtatagcctggtgctcctaggccccaatgcttacagcatgttaccatactgaatactgtaggcagttgtaagacaatggtatttgtgcatctactgtagagacagggtctctccgtctgtcgcccaggctggagtgcagtggcataatcatagctccctgcagcctccaactcctgggctcaagtgatcctcccacctcagtctcccaagtagctaggactacacgcttgtgtcatcaggcctgtctactgtttttgtttgttttttggtagagatggagggtctcactatattgctcagactggttttgaactcctggcctcaagcaatcctcctgctgccttggcctccaaagtgctggtattacaggaatgagccactgcacctggtccactacagcaatttaaaagttagatctgggctgggcgcagtggctcatgcctgtaattccagcactttgggagaccgaggtgggcaggttgcttgaggtcaggagttgagaccagcctggcaacacagggagacctatctctacaaaaaatgaactagattagctgggtgtggtggcacatgcctgtagtcctagctgcttaggtggctgagatgggaggatcacttgagcccgggagatcgtcaaggctgcagtgagctgagattgtgttactgcactccaacctgggagacaaagtaagaccctgtctcaaaaaaaatataaaacttagatccataaaatatttttcagggaggataattttatcactgattttttttttcagaatttctggaacatggtgataataagaggactgatttttattttttaaattctctacagacaatgcacccccttattgcctgcaactcaaggggcaggacttctgccatccctattgttggcatgccactgcactgattttaaacttttaaaaaatgttgtatgggctagacaaaacacatctctgacttctggtctcaggtttatatttgcaacttaaaatccctcttcctacatcaatagccttgcacgtgatggagttagctctaggtatggcaggtactacacccgctgaagtgaacatgtgcaagatagggctcagtttcccaggacagtcctacagcaaagagttttaaaatgcaattaattattgagagtgacagttcttacagacagtttggatgaagtgggttgaaaggggaggtttgggggtgtcccccaaattataatgcccccaatgaaacaataacaagcatcatctaaacacatatcctctcagatcagccttagggtgtgatgggatcagaggtaccaggaggctcccccgacccttccactttataccatactcattgaggaatacatctttcttctgggaccagagtcagggaggaaggtgggcatcctggagcagaaggggtgttcctgtccttgttagtcctgcttcacaccacttctgcccccaccccccgccctcagagtcctcagggactcaactgcccgtggcacattacccacaggcctgcttctcttctcaaggggggcaaagggcctgggcagcgagggtgggggaagctcaggagctgcaggagtggcgcaggtgcaggcacagggcggggtctttgttctttttttcatccctcccctcccccttcctccccggaaaccagagactttgccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggtgagctgggcagggcaggggctggtgggggaggggtcatgtggccccaggtcccacctgctgggccctgggggtggggcggggctgttacaccccccttcctttcacatccacaggaatcccctccataacccaggcctggggactgtgggtcctcttaggggctgtgacgctgctatttctcatctcgctggctgcacacttgtcccagtggaccaggggccggagcaggagccatccggggcagggacggtgggtgaaggacaacagggatgggttgactgagagttctctcttaccgagaagtccccactcatcccctaaactctgcgttgcagctctggagagtctgtggaagaggtcccgctgtatgggaacctgcattatctacagacaggtagggagctggcagagaggaggggcacagaggccaggtcctgggtggctgggatgggggcgtgcaggaggaaggacaagttgctgaccagattcctgttccccgtcccaggacggctgtctcaagacccagagccagaccagcaggatccaactcttggaggccctgccagggtgagtcaactgtggctggagaaaagggggagggaaggaagtggggggcttttcgggcttttccgagggtccagtgaacttctaacagccttgcatctccaggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtgtttagatttttacctagaaggctgaagacttgcaaagggccctgcagatgggggtgtgagctttgctgtctgcacggagctctttctgggggtgcctagctggggatgaggggccaagaggggctgcggcatcaacagtgcagaggtgggcaccggggtggagggccagagcccagctcctcagctgctgttgctgctgctagaacacccctgggatctgcactcagagccactgcattccccctggggctgcaagctcacagtcctgagctactctccccttgacctctataactgccatcacctccacaacctgccagcctggttccttcatcaagtcctccaatctgacctccgtctgtccgctatgagtcccacctatacccctgttttgacatcagtagccttatctgcacttagtcatcgtatacccctagaggccttctccttaccccatcactatggcagcggtccatctccactcactctctcccactctggcctcccaaagtgctgggattacaggcatgagccaccgtgcctggccttcactctctcagttgtcacctgcagtcttggcaacagttttgcttgtcaccactttcattttaatccccatctaatttgtcctgcctgtccacccatcacctgctgattcttaaccccagcctcctaccccatatagcatgctacatcagccagttggcacagagattaggactctgggctcaggagccggactgcctgcattcaaattccatgtctaccacttaccagctgtgtgttcttgggcaactgtgcctcggtttctgaatctgtaagattgagaggatattaacggtgtttacttcaaaaaaaggtggttgtgaggctgaatgagttaccatttgtaaagcacttagacaataaatgctcaataatgctaggcattattaaaataagagaaatacaggatcctctatgggagctcataggtgaagtgacttctaggtagagacatgacacatagtaggaatctgccaggagaagcgaaggacagaaaatgctccaaggcaaagggaaccacaggcaaaggagaggcttattcagaggacctggcagaagtgcattaggcacagcggagggtagagtgagatgggggcaatggtaagatgaggctggaggggcagacagagccagatcacactgcgcccataagtcatgccaaggagcttgggctttatcctgcaggggaggtgaaagggagtcactgaaagttttaagcgagggatgaacacagtgagttaaaggctctaactccactggctgctgtgctgatctagtggtcagcagtctggagtcaggcggcgcctttcaaaggctattgcaagatttgagtgagaggggatggcggcagtagcggtagggatgcagaggagggatggattacaaagagatgtttagggttttttttttttttaaaggccccacctatcacatcttccagatttctggttagagcctgtaacaccccccaacccaaatcctcatcatcataatacagcatagctccaagttggtttcagctcatcaccttcctcacctggcaatctctctctctctctctctctctctctctctctctctcacaaacacacacacaccctccaccccttaagcccatctgtgatccatctgtctagcaaaagctccaacctgtcaaacctcttctaggatatttcaaggtctagaccatctccccagggcctctgtagaggcgggccgcgcttgacagatctttctgaggcttgaggggctgaagaaaggagaagctgaggctttcacttccaagcttctcttcttcccacttggagtgccacaggaagccacagaggaggaacccgtgcgcctgattcctgcctggtggtcccaatttgaaagggaccacccttcccttaagcccacccccctacagaccccacaaatgcccctgggtccctggacctctgaggaccccaccctgggcctccccaggagaggcccaggtcgcggttaagggcaggtagctggggatgcggaggagggagggagggaggcttcgggggcggacaccggatgcggggaaccaccggcagcgggatgtggggttctgagggctgcggtgcttctgaagatggctcagcgtcgcgccaggtggacgtgagagctttaccctggaggaggcgggggttggagtcccgcctacccactgggacaagccaaggggtcaaacgcccccaacccagcccgcagatctcctcgaagcacccggttctcctggcccgcccagacccacggcgctcgccgccttcgcccgcttaggactgagtccgcagcgccgccgcctggcgaggggcggagttgccaccacttctgcgcaggcgggatgcagcctggcccgcggcatcccgggagttgtagtctcgacgcttcggggccaccccagggtctggtccctgacgacgcgcagtgagggccccgccgctaccccagcagtcgcctcccaagttcgcggaacgcagctgaccggctccctctggactgggtgacatgactgctcccaagcagtcgtttgtaaactgagtttctgtaaaacaattttatttttcatatgtgactgtagcggggtatgatttgaactttgttttccgtcccccagcccggattctctgtcttctcctgtacagccgttccgttttcttacctcgtctccgtcaccgaggccctcagccctgaacacaaggactgggcagtttccctattgattcctgaacctggaacttaagacatcttccgaggggcccccccttgccacaccctctagctgatcgactcacaaatacctgtgatttctctccccgtctccacctccaggtacttccctagtggactcctttccctcaccggcgtagcattccagccagaaggagtgcccgtcctagcgccccgttcccagggacagaccctcagggggagctcctagggccccagctgtccctcctctttcttaaagcctagctaggaggatagggacacattgaaaacggaagagggagggtctccgggacagtcaaaggttcaacagcaggaagttctttttttttttctttttttttgaggcgaagtcttgctcctgtcgcccaggctggagtgcaatggcacgatctcggctcactgcaacctccgcctcccaggttcaagagattctcctgcctcagcctcctgagtagctgggaatacagacgcccgccaacactcccggctaattatttttgtatttttagtagagagagggtttcgccatgttgggcaggctggtgaactcctgacttcaggtgatccgcccacctagacctcccaaagtgctgggattacaggcttgagccaccgagcctggccaggttcttaagaaattacttataggtggggagggtctttggaagccatccggccagggcacctccatctttggccctgctctgtagtctctcaaagatgggtttaaacttccagcttggttttcttacaaggagggaaacagagctgggttgtggagagaaaccaagtgttttttaattcttaatttttatgggtacatagtaggtgtatgtatttatagagtacatgagatattttgatatacgcatacaatgcataatacagaccaagtttttttttgtttgtttttgttttttgagacggagtcttgttctgttgcccaagctggagtgcagtggtgcaacctcggctcactgcaacctctacctcttgggttcaagcgattctcctgcctcagcctccctagtagctgggactacaggtgtgcaccaccatgccctgctaatttttgtatttttaatagagacggggtttcaccgtgttggccaggccggtctccaactcctgacctcaagtgatccacccgctgggattacaggcgtgagccacagcgcctggcccagaccgagtcttaatgacttcatttgaaaccttgaatctagacatgcccagagctatatttgccttctgaactttttggctatgtaagctaatgaattcctttttttttttttttttgagacggagtttcgctcttgttgcccaggctgaagtgcagtggcgagatctcggctcactgcaacctccgcctcctgggttcaagcgattcttctgcctcaacctcccgagtagctgggaatacaggcatgctccaccacccccggcttattttgtgtttttagtaaacggggtttctccatgttggtcagactggtctggaactcccaacctcaggtgatctgtccaccttggcctcccaaagtgctgggattacaggcgtgagccaccgcgcccggccttttttttttttttttttggcttcagtcaaagttatgttttctatctctcgcagtcacgagttctgactaattctgtgggggaaagaccaacagacaggagccagctgaagatgctgaacctctgatgtcttcacttattgcccaattcctccttgagccaccctcctctgacttaaatgtactgtcatgccatttggccctaagatatttctacttaacgtgtgagttaatcagatcccttgtctagcttataaatttctagaatcatatagccaaaaggaggctgacagatctggcccaaagttacacccactgcaggaactgccctatgatttcttcttgaacacttccagaagctgaacctctccttggtaaggacctcactacctttccaaggactctcttccaatctttctgattgatagaacttttaaaatttggaaccaaagttggcttccttgttacttgtctcactggttctgtcgatactggtctgacagccctggaggaattgggagccagtccttacaaataacctaggtctttttttttttttttttttttttttgagacagagtttcactcttgttgcccaggctggaatacagcggtgtgatcttggctcacttcaacctccaccccacccctggtttcaagcgattctcctgcctcagcctccagagtagttgggactacaggcactcgccaccatgcctggctaattttttgtatttttagtagagatggggtttcaccatgttggccaggatggtctcaaactcctgacctcatgatccacccaccttggcctcccaaagtgttgggattacaggcatgagccaccatgcctggcctttctttcttttttttttttttccttttcaggagaagcgttctaaagtgccttctacagtttgtttgtttgtttgttttgagacggagtttttctctgtcacccaggctggagtacaatggtgcgatcttggccccactgcaacctccacctccagatttaagcaattctcctgccccagcctcccaacctctggagtagctgggattattggggcgtgccaatacgcccggctaatttttgtatttttagtagagatgaggtttcactatgttggccaggctggttttgaatgcctgacctcaggtgatctgcctgcctccgcctccaaaagtgttgggattacaggcgtgagttacccagcccggccccttctatagttcttttacagactttatttgcagcttactcatcactccctttcggcttgatccttaacgtgtggcactaagaagtcaatctagtactgggaacacatagttgggggccatctctttgactcggcgcgcttagtctaccaggcctttgtttgtaaggaatcaagtctttaagtgaagcgttgtttattgtaaggacacatggggcaatcaggaggcctaaatggaatgggaatcccagagcagtggctatggtgtgagtagacctctgcagactgttattggatctcagatctctgcagtgctggggactgtcacgcgcgtctgtgatggtccagggggcttccaaggcgattgggcagtgtcggtcttcagctgctaagccgagcagatgtgggaaggagtcagccaaggaacgttgggtttgagctccaggagctttaggaatggtggcgatgtgagtcggacagtccaacctccagtgggggcccacacagacagggcacggcctaggaggaatcccgagctgtgggcattctcaggcccagtggccaggcttttggcatttgaagccaggtccacgaggaggttttgaaggagcccctgggaactgtggcttggatgttctgaagtttttgtgtgctggagacgtggttgtgggttgtcttacagcagaggcgagtagctgtaactcagagatgccttgtcacttggctgcctcttctctattattgtacaccttgaaggcaaggttaattaagtcctgttgtggggtttgagggccggaatccaattgttggagttttttcctaatatcaggagcagattgggtgataaaatgcatattaagaataaggcggcaacccaaaagcaactaagagggttccttggcataacaggcttctgccgaatatggattcccaggtacagcgaaatagccaggccattatatacactaattaaggaaactcagaaagccaatacccatttagtaagatggacacctgaagcagaagcggctttccaggccctaaagaaggccctaacccaagccccagtgttaagcttgccaatggggcaagacttttctttatatgtcacagaagaaacaggaatagctctaggagtccttacacaggtccgagggatgagcttgcaacacgtggcatacctgagtaaggaaattgatggagtggtaaagggttggccccattgtttacggatagtggcagcagtagcagtcttagtatctgaagcagttaaaataatacaggtgatcttactgtgtggccatctcatgatgtaaacagcatactcactgctaaaggagacttgtggctgtcagacaaccatttacttaaatatcaagctgtattacttgaagggccagtgctgcgactgtgcacttgtgcaactcttaacccagccacatttcttccagacaatgaagaaaagatagaacataactgtcaacaagtaattgctcaaaccagtgccgctagaggggaccttttagaggttcccgtgactgatcccgacctcaacttgtatactgatggaagttcctttgtagaaaaagggctttgaaaagcagggtatgcagtggttagtgataatggaatacttgaaagtaatcccctcactccaggaactagtgctcagctggcagaactaatagccctcactcgggaactagaattaggagaagggaaaagggtaaatatatatacagactctaagtatgctcacctagtcctccatgcccatgcagcagtatggagagaaagggaattcctaacttccaaggaaacacctatcaaacatctggaagccattaggagattactattggctgtacagaaacctaaagaggtgacagtcttacactgccggggtcaccacaaaggaaaggaaagggaaatagaagggaaccgccaagcagatattgaagccaaaagagccacaaggcaggaccctccattagaaatgcttatagaaggacccctagtatgaggtaatcccctccaggaaaccaagccccagtactcagaagaagaaatagaatgaggaacctcaagaagacatagtttcctctcctcaagatggctagccaccgaagaaggaaaaatacttatgcctgcagctaaccaatggaaattactttaaacccttcaccaaatctttcacttaggcattgatagcacccatcagatggccaaattattatttactggaccaggtctttcaaaactatcaagcagatagtcagggcctgtaaagtgtgccaaagaagtaattccctgcactgcaggccatacatttcaatccctgtatctttaacctccttgttaagtttgtctcttccagaattgaaactgtaaaactacaaatggttcttcaaatggagccccagatgcagtccatgactaagatccaccacagacccctggaccagcctgctagcccatgctccgatgttaatgacatcgaaggcaccccccccgaggaaatctcaactgtgcaacccctactatgccccaattcagcaggaagcagttacagcggtcatcagccaacctccccaacagcacttgggttttcctgttgagagggggcactgagagacaagactagctggatttcctaggccgactaagaatccctaagcgtagctgggaaggtgactgcatccacctttaaacatggggcttgccacttagctcacacccaaccaatcagagagctcactaaaatgctaattaggcaaaaacaggaggtaaagaaatagccaatcaccttttgcctgagagcacagcaggagggacaaggatcgggatataaacccgggcattcaagccggcaatggcaaccccctttgggtcccctccctttgtatgggagctctgttttcactctattaaatcttgcaactgcactcttctggtccatgtttgttacggctcgagctgagctttcgctccccgtccaccactgctgtttgccactgtcgcagacctgccgctgactcccatcctgctgctgactcccatccctccagatccggcagggtgtctgctgtgctcctgacccagtgagactcccattgccactcccgatcgtgctaaaggcttcccattgttcttgcacggctaagtgcctgggttcgtcctaatcgagctgaacactagtcactgggttccacagttctcttccgtgacccacggcttctaatagagctataacactcatcgcatggcccaagattccattccttggaatccgtgaggccaagaaccccaagtcagagaacacaaggcttgccaccatcttggaagcggctcaccaccatcttgggagctctgtgagcaaagacccacggtaacactaacagggtcatgggaatcaccaaatttatagctagttgttcagaagtgtgggtgacctggggacccccaaagtacagctggaatctgaagagaagatttgtgaaggattaagcccttaacttatggagtctgcactaactgtagatggtcagtgccagaaatggcttttagtacaccaattttggttgaaacagaaaaatgtcacagaatgaaaaccattttagtaaatagcaataattcagtcatttttggtggaaattctttgatgtgatctaaaccaaaatgagatcagctttgcttcaaaaagattttgccaaataagagaaactgctgaatatttaacgtttaaaatatcaatttctatgtattttttcctttttcatggtgttcaggaattaattttgttagcagtcaagattgcttaatcctcagagttacatttccattttgcaaagtaacaactggttggtttttactcttagtttccctttccccagccagcatgtaaacaacctgccatattgttgcaaaaaggcaaatagggttaaaattggagacaagacttccatcatttttgccaagcagagagggaagaactcagtaatcacataattctgctcaaactaagtgtatctgagaactattcaaatgttcacaggaggacagatgacctcttttttctccatttctctttggatgttacactttgtcatttgtcatcaaaattggccttttcctttatctctttgtggtaaagcttgatggcatctgaatttacactgtctccttgacagttgtgctgcttctgcttctttctggcagtttctacttttcctttcattttattatcctgctttttatttcaattttgtttttatagtctctgtgtactgtcttgacctttagatggtcttaccttcaacatggcaaggatgtcacactaccacgtacaaataacaatgtgctttcttagctcatttccctagcatgactttttttgagatgtcaaaagcaagtttttgagaaaccaattgcatttttattttgccctaagggtgcttaacccaatgtctcttcttttattattattttattacccaagggaaaaaaaatttacttagtttatttttttaaagccagtactttgctcatcaattaatgtttgttgaatttattcctactggatgagtagttgtattcttttgaaataatgtgtcaaatctttgtgcccaaagattaaaaaaataaaagtaaaatacatctaaaaaaaaaaaaaaagaataaggcggccttccggcccctctgggtctagggcggtaaagcgtctaagggttgctgccaagcgggccaggaactgggctgggttttcgcctttaccttgggtagtttcctttagcttgtcagaattaacagctttgtgtgctgcctttttaagcccttcaactaggcaggaaatcatgtaatctcgcctagctatacctggggaatctgcctgatagttcctttgggggtcctctcggggaactgctctgatgccttcctggaggcctggctcatgaagccagcggttgtcagcgtgagactgggctagagaaaaaactctttcctgttcatctggggagagggtggaagtcaggatgacatttaagtcactgcaggttaacttgcaggacagagttagatatcggaattcctgtatatatttagcggggtctgatgagaaagagcccaaacactggctgatttgggaaaagtctgatacagaaaaaggcgcatgtacccagactatgccttcagctccagccacttctctaagaggaaattgttgggcaggtgggggagagctagtcgcagaacaaaactgtaagccagactgggtgtgaggaggggaggtgatagaagggttatagggtgggggagcggaggctgaagaggagctggagcctgattcagcctggtggggagcgacctgaggaggagcagtctggggaggaggggagaggtcagatgggtcggtagaaaaggaagattcaaaagacccagcaacacttggggttgggactgaagggacaggtgggagggaaagaaggaggatttgggacaagtcgcattgggaacagagactagggagagaatgaagtgtgaaagacgcccggatgtacggcacctccgaccatttgcccatttttcgacaaaaattatctaggtcttgtaggatagacaaattgacagtgccgttctctggccacttggaactattttcgagtttgtattggggccaagtggtattgcagaagaaaataaggcatttaggttttaggtcaggtgtgagttgaaggggttttcaagaacacaggctaagggaaaagatgggggaatcgagggtggaaggttgcccatagtgaaggaggtaagtttaaagagaaaggtagagacacggagcagggggtgatgagcagccctgggctgcaatgtgggtgagcagccaaagcaggcgtccccacaattgacttgccaccaagggaatgtgggtgaatgaccaaggcaggcatccccgtggtgatcagacaccaatgaaatgtgggtgaataatcaggcaggcatccccgcagtgattagacaccaagggaaggctgtcttcctgagtccatgaccagcgccggagttttgggtccacagataaaatgtgtctcctttgtctctactagagaggaaaaagaactggaattggaaggacagggagattgaagggtagcaagagagggagattgaagggtagcaagagaggctggagaagagagtgaaaagaccgcttacccaatttgaaattggtgagatgttccttgggctggttggtctgaggacccgaggttgtaggtggatctcctcacagagttagggcgaggacaggggacccgcctcccgaaggagtcctcctgtcccgggtcttcagcaccaaatgccatgcacgtctgtgtgaagagaccaccaaacaggctttgtgtgagcaataaggctgtttatttcacctgggtgcaggcgggctgagtccgaatagagagtcagcaaagggtgatgggattatcattagtttttatagttttgggataggcgatagagttaggagcaattttttgcgggcagggggtagatcttcttacaaagtacgttctcaagcgtggggagaatattacaaagtaccttcttaagggtggggagggtgtatcgtacaaagtacattcacaagggtgggggaatatcacaaagtacttatcgcaagggtggggagggtgtattgtcacaaagtcaattgatcagttagggtggggcagaaacaaatcacaatggtggaatgttatcagttaaggcaggaactggctattttaacttcttttgtggatcttcagttgcttcaggccatctggatgtatccgtgcaggtcacaggggatataatggcttttcttgggctcagaggcctgacagggacctcagtgacaggactatgtgggacttcaggatcctgctcctctagttccaagactcagatactctcttcatttctgacctcgtgatccacccgcctaggcctcccaaagtactgggattacaggcgtgaggcactgcgcccggccagaaagttcttaagaaattacttataggtgaagagggtctttggaagcgatgtggccagggtctctccatctttggccctgctctgcagtctctcaaagatgggtttaaacttccagcttggttttgttacaaggagggaacagatttaagtgattctcatttcttcatttctacttcttttatttatattccatttcttcccactttgctaacttgcttccctatcctttactgtatattctctacttagttgttctggttccttataacagcttcatatttcctcttcggtcttgtgacctcagttaaatgtttaattatagaaataatgtgcacgtggttaaaaaaaaagtcaaatagaaccaaaggctacacaacagtggttctcaaccaggggtgactttgcccccaccccctgcaggaaacatttagggcatgtctggaaacatttttggttttcacaactggggagggggtggtagtggaaagaggtcaaggatgctgttaaacaacctacaaaactcaggtcagctactcacaataaggaatttctcacccaaaatttatagtgctgagggtgagaaatcctagcataggggaaaaaataaaagtaaaaacctctctcccccaattccaattcctactcccagtcatagttcccagaggtaactactttcaacacttcctggctttaagtgttttggtgactttttatttgttaatagtgatacttagacctcttagagcaagagaattctaggaaactctagtgaggttctccattccacaccccctctgacaactccagctataggtgacaaactttaagtgggctcctctgggctccaagcagagagaattccttatagacaagttctggaaaacagcctcagagccaaaagcaaggactttcaggaagaaagcaagtctcagagacagcctgcttcccaaggacaatcatgactcttctgggtcttaactaccagcaaaactaatggtggatttaatttctcagcccttgaggctgggagaatgcagaaaaaccagagggcagaggaacctgctggcagagacagctgaatccctgacagaaaaaatgagagcctggaagagatatgtgtgaagctcaaacacaaaagatttccttgaactagaaaatgtgatctcagaactaaaaatttccattgataaatcaaaggagaggacagtcattgctgaaaccccaaaataggtctagaaaattaaatagaaaaaaagtctcaaaatctagcacaaaaatatagaattgcaaatatgtggtagaaggtagaagcctggaacagatagagtagacttaacctgcaaatgctgtgggttccaggagaaaaaggaacaagagaggagagatcataattaaataatagatgaaatttctctaagctgaagaaagaatgattccagctccaattgaaacgaaaagacacacactcagctacatataggcaaaaattccaaaactctaagaatataggaaatcttacatactttaaggcagaaagcaagttattttttctcatctgcaaccctgaaagttaaaagacccccagatggaatgtgggctaatgaaagaaaaggcctgcaacctatacccagccaaggaagaaaaaaagatttgcaaaaatcactgagtacctcatctgagaaatacttttgagaagagactctaataaacaacaaatgaatcctaacacagacttcaagacaggggaagagaagaagcaagaaaccagtggggagcaacgaaccatgtctgtttatgaggtgtaacatatatgctaaataaggactcttgaaacagatggaacacactataagggaaattctaataaggactaaattatctcattaaaactgtggagtcaggcggtggggataaggggaaggtaaaagtgttccagaagtctaaggcagggagaggtggggaggaaaaatgggagaaaggaagggaagtgaaagtaatctaaaggtcacattttggccagccgcggtggctcacgcctgtaatcccagcactttcggaggccgaggtgggcggatcacctgaggtcaggagttcaaaaccagcctggccaacatggcgaaaccctgtctctactaaaaatacaaaaattagctgggcctggtggcgggctcctgtaatcccagctacttgggaggctgaggcaggagaatcgcttgaacccaggaggtggaagttgcagtgagccaagatcgtgccactgtactccagcctggggaacaagagtgagactctgtctcaaaaataaaaaagattacattttattgggatggggaggaaatagaaggtaattaaagtattctggaaatagtagctgttgttttcatacactagaaaagtcatgtgtatctatctgagagcagggacagggatggtaactattaatagaatgacaaactccaaattaatgaggagaaaaattgaatgagtagtaatttatttaatctagcaaagattaaaaaaaagaagagttaacaacaatataaaaaaactttaaaacaagtaagatggaaataagaaaatcaaatacatcactcattacagtaaataaaagcggactgaaatctaccattaaaagactgtcagattttgttataaatcaaatttaggcacacattacttaagagaaacacacttaaagtgataaagttttaaaataaagacatggaaagagataccaggcaaatattaaatattattttaaaaaccagaggctatatacagacaatccccgacttaacaatggtttaacttaggattctttgactttacgatgggtttatcagggtattaaatgcattttcgactaacattactttctacttatgatgggtttttcggaacgtagtcccatcctaagtcaaggaacatctgtactgatatcaaacaagagaaatttaagttacgggctgggggaggtgggagaagacttcctgcaaagggataggaggattttgggagagataggaaggttttgtatcttaattgtggtggtaattacacaactgaatacacttgtcaaaactcataggattgtacacttaaaatggatcaatttgttgtatataaattacaatgcaataaaactggtttttaaaaaaagaatgaaaatactatgttcacaaaataaaaatgtgaaatgagaaaacagcgtaacatgagaaactctctcaattaccctgtatcatatattatactgtcaaaaagatagcaagctttaaacaacacacgcacaggaaaaataaagggagcacttatttcaagaaattatgaaaagaataagaaaagaaatcaaatcagaaaataataactaaagctaacactaatgaaatgaaaaaaaaaaaacaaaaaacaaaaatactaagaaggcccaggcacagtggctcatgcctgtaatcccagcgctttgggaagccaaggcgggagaatcacttgagcttaggagttcgaaaccagcctgggcaacatggtgaaaccccatctctgaagaaaaaaaaaaaaaagtacaaaaattagccaggcatggtggtgtacgcctgtagtcccagctacttgggaggctgagatgggaggttagattgagcccaggaggtggaggttgcagtgagctgagattgcaccactgcactccagccagggcaacagagccacaccctgtctcaaaaagaaaaaaaaaaaaaaactaaaaaggataaataaatccaaaaaattgtcttttaaaagagctaataaggctgggcacagtggctcgtgcctgaaatcccagcactttggtaggctgaggcaggcagatcacctgaggtcaggagtttgagaccagcctggccaacacggtgaaaacctgtctctcctaaaaaatacaaaaattagcagggtgcagtggcagacacctgtaaccccagctacttgggaggctgaggaaggagaatcgtttgaacccaggaggtagaggttgcagtgagccgagatggtgccactgcactccagcctgggcgacagagtaaggctccctctcgaaaaaaaaaaaaaagctaataaaataaacctcttgcaagccaaattaaagggggaaaaagagagaaagattaaatagacaagattagttatgagaaagaaaacattcttacaaatagaggagaaggccgggcacagtggctcaagcctgtaatcccagcactttgggaggccgaggcgggcgcatcacgaggtcaggaggtcaagaccatcctggctaacacggtgaaaccccgtctctactaaaaatacaaaaaattaggcgtggtggtgggcacctgtaatcccagctactcgggaggctgaggcagaatggcgtgaacccggaagacggagcttgcagtgagccgagatcgcgccactgcactccagcctgggtgacagagcgatactccgtctcaaaaaaaaaaaaagaggagaaaattgaagaattataaaacagtacaactgaaaatcaaccaatttgaaaatttagaggaaatggatatctttcaagaaatatataaattaccaaaattgacccaggagaaagaggaaagcttgaagagcccaacttattttagaaaagactgcaataggaaggtgatgagagactccttttgggaaatactgcattcacatggcaccagatatgagttttttctaaccttaaataataatttctatgccatttatttatttttatttatttatttatttattttgagtggagtctggctctgtagcccaagctggagtgcagtggctcggcgatctcggctcactgcaagctccgtctcccgggttcacgccattctcctgcctcagcctcccgagtagctgggattacaggtgcccaccaccacgcctaattttttgtatttttagtagagacggggtttcaccgtgttagccaggatggatctcgatctgctgacgtcgtgatccgcccgcctcggcctcccaaagtgttgggattacaggcgtgagccaccgcgcccagccgttctatgccgtttaaactggtcaagagtatagaaaacgaagaaaggctccaagatttaattgtaaagctagtacatcttgatactattcccaaaaaaactctaagtaaaaaagaaaaagaggaaaactgcttaaatataataaagactagttactaaaacctaaaagcaaatatggttctcaatggtgaaacactgaaaccacttcaattaaaataaaaatttagacagaaatgcctgctattatccttattatttgacatatcttggaagttttaccaaattcagtaaaacaagacaatgaattgttacgctcatctgaaaagaaattataatattatcttttttgctgctgacatgattgtaccagaaaaaccaaaagactagtaaaaataaaaagccatagtaaaaagcaatataatttggagggctgactggatacaagataaatataatgaaaataaattgtttttactctagcaataagcatattgaattgaaaatggaagcagtttcaatttagagttacaaagttataaaattcttaggataatatatagataatgaagctactcagaaaaaaaaattcttaggataataatgatagccaccataatgccatgaactattcttagcactttgtatcaactcaatcaagcctcacaacatcctcttgaaacagattactattattattattttgtattttttgtagagacgggcgttttgccatgttgcgcaggtttatctcgaactcctgggcttaagcgatccacctgcctcagcttctcaaagtgctgggattacaggtgtgagccactgcgtccagccactattattgttcttattttacagaagagaacactgaggaacacacagattaagtgatttagccccagattactattaatagctggtaaaatctcagagctgggatttgaaccctggcagtttggcagatacttcccttgtaaccactatgatatggtacatacatttactcatatttaatcaagaaacacataagtattcatatgaataaagttatacagtaaaatattattaaacactataaaacaagatgggaataaacagaaaattaaccatatccttttgggaagagaaaatatcataaaaagtgtcagttctccaaaaattaaagtgtataattccaattagtaaaacaaagaacaagcaaagaaaaaactattttttaaaaatacaaagattttgatagggaaaatagtgagaaaaaatagagaaattcactttagcagccgggtgcggtggctcatgcctgtaatcccagcactttgggaggctgaggcggggggatcacctgaggtcaggagttcaaaaccaggctggccaacatggcgaaaccccttctctacaaaaatacaaaaattagccgggcgtgatggcacatgcctgtaattccagctactcgggaggctgaggcaggagaatagcttgaacccgggaggtggaggttgcagtgagctgagacgcgcggctgcactccagcctgggcggcgacagggcaagactcccatctccaaaaaaaaaaaaaaaagaaaagaaattcactttaccaaatatgataacataaggccacttaatcaaatgaataaagcaaaggggaaaaattagtcagtggaataaaacagagaatcccaaacaaggtgattgtatatacaaaaacatgacaattcaagtcattggagaaagtgggctgacataatcagtggaactgaacatctagctctccttactgagtgctaccatgtgctgggactgtgcactagcagggcttgcatacccatgtagcagcagagcatggtgggtaaaagcacaccttctgtggcaggacattcgcgtcatcaaaggtggaggcgggcagagactgacttgggttccagtctatgttcacgggttctggcttatccttgctctgtcccacttttgcccatcttcccttcctggctgcctggcctgcagaatccgagctccagcagcagaagcaaagacaacacctttcagagactgttgagcttgctcccacaaatgcataattgagcaattctctgtaccaaataagagcaattctgtgtactaaatctcttaattgaaaaaatatgtatgtgtgtgtatgtatatataaacatacatacatatgcttatgctagtggttttacttctctgatgggccttgactgacatactaaatgaaggatatacaagtgttcatgatattctttcaactttcctttaagcttaaaatgtttcaaaataaaattctggggggatagaaaaatatacacaaaggattctaacctcagttgaagagctaatccaaatggttaagaaacatgaaaatacgctcaaattcactacaaatcagggacatgcagcttaaagtaaaaatgagatgcctgccgggcgcagtggctcatgtctgtaattccagtactttgggaggcccaggcaggaagattgcttgagcccaggagtttgagaccaacctgggcaactagagagacccccatctcttaaaaaaaaaaaatttaattagccaggcattgtggtgcatgcctttagtcccagctacttgggaggctgaactgggaggatcacttgagcccagcaggttgaggctgcagcgagcagtgatcatgccactgcactccagcctgggcaacagagcaagatcctgtctcaaaaaaacaaaaaacaaaaaaagataccacttacatgcatggcgaaaaactggagcttaaaaccagtggggaactctgagagccagtgtagaacatgcgcccacacagttactctcccactcccagggtgaggtggctggtgtattcatataccagttcccaccagtctttgtttgagagctgctttacagggggaggcatggattctccagcactcctggccctctgctctgctcacctaccagagaaaagcttcaggcaaggagctgcaggcctgcccttagcctctgggcttatgtgcagccagcggtgaggcctgaggagaaatggctgaggcactgacagtatctgccgagcagcgagcatcactcagatccacttatgtcttgtgttaaattcatgctgtcactgtttcttactacaggtgcctgccaccatgcccagctaaatttttttgtatttttagtagagatggggtttcaccatgttagccaggatggtctcgagctcctgaccttgtaatccaccggcctcagcctctcaaagtactgggattacaggcgtgagccaccacgccccgcccaggtcatagtttatttaaaaaggaggaggaagaagaggaataagctggccctggtaacacgtgcctgtagtcccagatacttcggaggccaaggcaggaggattgctggagcccaggagttcaagtccagcctgggcaacataacaagacccctgtctcttttttaaaaagaagaagccaggcagagtgagtcatgcctgtaatttcagtactttgggaggctgaggcaggaggattgcttaaggccaggtgttcaaggccagcctggtcgacatagcgaaaccttgtctctacaacaacaacaaaattagtctggtgtgatggtgagtgcctgtagtcctagttacttgggaggctaaggtgggagggtcacttgaacccaggagtttgaggctacagtgatctatggtcgaaccactgtactccagcctgggtgacagagtgagacgctgactctgattaaaaaagaaaaaaaaaagaggtacaaaaacttatcataggagcatcagtgggacaagctaaaatccccagtgctgtggttggttctgagactgcaactgacattcttcattttcctccccttctgtccacactagactcccctcactctcaagcagtacttcttgctggactgaattacttgcccagtgggtgagccagaccttcatttctgagccttctgataactgggttctttccaggctgtggtggttaaagttgcccaatatatcactgagcatggaacaccaaggggcacccatgaatcccctaacatgcagatacaggcatacttcagagatattgtgggttcaggtttgagatcactgcaacgatcacaggattttttttttgtttcccaatgcatataaaagttatgtttagccgggcgcagtggctctcgcctgtaatcctagcactttgggaggccgaggtgggtgaattgcttgagctcaggagtttgagaccagcctggggaacacggtgaaaccctgtctctactaaaaatacaaaaaaaaatttagcctgtcctggtggtgcatgcctgtaatcccagctacttggaagggtgagacaggagaatcgcttgaacccgggaggtggaggttgcagtgagctgagattgcactccagcctgggcaacagagtgagactccatctcaaaaaaaaaaaaaggccgggcgtggtggctcacgcctgtaatccgatcactttgggaggccgaggtgggcagatcacgaagtcaggagattgagaccatcctggctaacacagtgaaatcccctctctactaaaaatacaaaaagattagccaggcatggtggcgggcacctgtagtcccagctactcgggagtagctgaactcccaggaggcggagcttgcagtgagctgacattgtgccactgcactccagcctgggagacagtgcgagactccatctcaaaaaaaaaaaagtaatgtttatactatactgtagtctattaagtgtgcagtagcattataccttaaaaaacaatgtaataccttaattaaaaaataccttattgttaaaaaatgttaatgatcatctgagccttcagtgaatcataatctttttgccagtggagggtcttgccttgatgttggtagctgctgactgatcaggatggtagttgctgaaggctggagtggctctggcaatttcctaaaataagacaacataaagtttgccacattgattcttttcacgaaagatttctctgtagcatgcaatgtttggtagcattttatgcacagcagaactttcaaaattggagtcaatcctcgcaaaccctgacactgctctatcaactaagtttatagaatattctaaatcctttgttgtcatttcaacataatcttcaccagtagattccatcttaagaaaccactttctttgctcattcataataatcaattcctcatctgttcaagtttgatcatgagattgcaccaattcagtcacatcttcagactccatttctaactgtagttctcttgcagtttccatcagagctgcagttacttcctccattgaagtcttgaactcctccaagtcatccatgagggttgaaatcaagttcttccaaactcctgttaatgttgatattttgaccccctcccatgagtcgtgaatgtttttaattgtatctagaatggcgaatcctcttcagaaggttctcagtttactttgcccagatccatgagaggaatccctatggcagctgtagccttacaaaatgtgtttcttaaataaggtcaaaattacttcttgacccacgggctacagaatggaagttaggcgtgaaaacaacgttaatctccatcagagatcttgggtgactaggcacattgccaatgagcagtaatatcttgaaaggaattttctttctgagaagtagtaggtgtcaatggtgggcttaaaatattcactaaactgtgctgtggacaaatgtgctgtcatccaggctttgttcttccatgtatagagcacgggaaggatagatttaccataattcttaagggccctaggattctgagaatggtaaatgagcactggcttcaccttaaagccacgagctgcattagcctctaacaagagagtcaacctgtcctttgaagatttgaagccaggcactgacttttcttctccagctatgaaagtcctagatggcctcttctccaataaaaggctgtttagtttgcattgaaaatctgttgtttagtgtagccaccttcatcaatgatcttagttagatcttctggataacttgctgcagcttctacatcagcacttgctgcttcaccttgcacttttatgttatagagctggcttctttccttaaacctcaggaaccaacctctgctggcttcagatttttcttctgcagcctcctcaattctctcagcctccagagaattgaagagagttagggtcttgctctggattaggctttggcttaagagaatgttgtagctggtttgatcttctatccagaccactcaaacgctctccatatcagcaataagactgttttgctttcttatcatttctgtgttcactggagtagctcttttaatttccttcaagaacttttcctttgcatttgcaacttggctaactggcataagaggcctagcttttggcctatcttggctttggacatgccttcctcactaaccttaatcctttctggcttttgatgtaaagtgagagatgtgcaactcttcctttcacttgtacacttagagaccattgtagggttattaactgtcctaattttaagattgttgtgtctcagggaatagagagacccaaggagagggagcaagacagggaatagccagtcagtggagcagtcagaacacacacaacttttattaagttcaatgtcttataggtatggttcatggtgctccaaaacaatgacaatattaacatcaaaaatcactgatcacagatctccataacagatacaataataatgaaaaaagtttgaaatattttaagaattaccaaaatgtgatgacacagagacacgaagtgagcacgtgctgttggaaaatggcaccagtagacttgcttgccacagggttgccataaaccttcaacctgtaaaaaactcagtatctgtgaagcgtaataagtgaagtgcaataaaatgaggtgtgcctggacattcctacagtatgtagcagcagccctaacccctcatgataatcaggcaatcaggttcagtcacctctgccagggtaatcgctccccactaagtatgtgagctaggagtagccaggcacgatcgctaggtatggagaattctgtgggtcaaggtagatgctctctatacatcctttcatctttaactcccactgccaactcagtggtcatctccatattttcccacttaaattcctgaaaattggcatttgataaactcatcctgatgtccaggtcgctggcttgtccatggactggccagccttaggcagaggcccacttgctcattttatatttttattaaattaaatttattattattattattattattattattattattattattattattatttttgagacagagtctccctttgtcgcccaggctggagtgcagtggtgtgatcttggctcactgcaacctccgcctcccaggttcaagtgattctcctgcctcagcctcccgagtagctgggattacaggcatgtgccaccacgcccagctaatttttgtatttttagtagagatggggtttcatcgtgttggtcaggctggtcgtgatccaccgacttcagcctcccaaagtgctgggattacaggcgtgagccactgggcctggcctttataaatttgtctttttaacccatttttttctgagacggagtcttgctctgtcacccaggctggagtgcagtggtggaatctcggctcactgcaagctccgcctcctgggttcaagctattctcttgcctcagcctcctgagtagctgggattacgcatgtaccactatgcccagctaattttgtatttttagtagagacggggtttcgccatgttggccaggctggtcttgaactcctgacctcaggtgatccgcctgcctcggcctcccaaagagctgggattataggtgtgagccactgcgccaggcctcgcttgctaattttaatcagctgaggtcaaaggggttggaggtcacaagacacaatttctggggactagggctgcctcatcagcaggggtttgcctgcttaaaaagggctataggtagtatttaagtatgggataaaaaacacaaagtaaaaaacaaaacaaaaaaaaagggctataggtgtggctggcacaatgttagatgtatttggtaagggggctacagttctatgtggcagccttttgtcacaagcttctttccagtcactgggtcagtttataaggcgcttacagcctgctgagtccagtttcccaatttgtaaaataagcaggctgggctctctaagatcccttcaagtgtaaaataataactgcctttctcctcaaactttgttacataaacaattgttaacccaggactccctccatcctatgcttatgcaatttattttttgaattccaaatttcatttttcaataaatgcttgctgtattatcttttttttattttaattttgattcatttattttttgagggagggtttcactgctgcccaggccagagtgcagtggcacaaacatggctgacagcagcctcgccctcctgggctcaaacaatcctccccactcagcctcccaagaagctgagaccataagcatgtgccatcacacctgcctaatttttaaattttttgtagagatggagtctcgctgtgttggccagtctggtctcgaattcctaggcccaagtgatcctcccacctcagcttcccaaagtcttgggattataggcatgagccattgtgcctgactttgctgttattattattattattattattattttttttgagacagagtctcgctctgtcacccaggctggagtgcagtggcaccaccttggctcactgcaacctctgcctcccgggtttaagcgattcttttgcttcagcctcctgggtagctgggactacaggtgtgcgccgccatgcccggctaatttttgtattattagtagagacggggtttcaccatattggccaggctggtctcgaaattctgaccttgtgatctgtgcaccttggcttcccaagggataacaggcgtgagccatcgtgcctggcctgctgttattatttttatgacatttcattctgtggtttggagccatcattttgccttgttgcaaggcttgaatcttgagttggccttttgatgtatttgcttttcagctctgtgccattaagcacagagaacgtgctttctgtgtcaccatttgaggcaggaccaaggagaggcctggggcaagtcaccgaagacctatctgtactctttggcttcagtgatcaaagaaatccaagtctccctcatggtgcaatcaggtggcccatttttctccctcctgactctgaagcctttgtgacagattttaaagaggcgtttgtaaagtccacacctagtgtgtctccagcaatcatactcttgattgaggtcagactatcttgtattttacagatggaaaactgtcacttgcccaaagtcacatactgtggcaaggctggtctctttaaccagagtctccctattctttctattacatcatgcttcctccacagttcacgaaactcttgctgctctaataaattacacacttggtggcttaaacaatacaaatttattgtcttacagttgtggagatcaggtcgacacaggtctcactgggctaaagtcaaggtgtctgcagggctggttcctttctggatgctgaaggggaaaatctgcttccttgccttttccagctctcagaggcttcttgcattccttggctcaaggtcctcttcctgcaccttcaaaatcaggacctatgggttgagtgtttctcctgtggcgtctctctggccctccttccctcaccgaatctctttcttcccatgatgggaaaggttctccctttcaaggactcatgtgatcagagtgtgcctaccaagataaaacaggataatctctctatctaaaggaccttgattaacatagccacatctacattttgtcaggtaaagtgacatagtcacaggttctggggattcgggtgtgaacatttttgggaggccattattctggctaccacaccctgtcagtaaactagggcttcccggaggccagtgggttaaagtaatgaagacagatatagcctgactttcagagtcttaggagatgctcccgatgtcctgacatagactgtatcaatgacacaaagttgatcaggtgagcccccttccacatggcaaattctatctgatgccctcatggttgggccccctcctcttgtcaaccgtaaacacccattccctgtaatgagtagtggggaggccaggagagggcaaaacatgggtgttagtgtctgccctccaggctctcagatgatgatagtatggttctggaaaagctgaaatgtacagcactgacccctcacctcttaaaagttccctgatatttgggcagtagaggtacagcttggagttacaggtatcttttctgatgtccagcctctaaatgtaatgtgaatgtcaaaactgtaaagaccccaagtgacacacgtggggaaggggaaggatcctactctcttaccctgttcacaaaggaaggctacaagctggtctaagacagaagcgaatgcggcctgtgatgaaaagatatgtaaccatcaccaaaagagctaaagaggagaaaaatatagaacaagcctggttaagacattcaagatattgcggtgtgcagttccatctggggatccccttcttttttttatttttttttatttttggagacagagtctcactctgtggcccaggatgggcacaatctcggctcactgcaacctctgcctcccgggttcaagcaattctcagcctccctagtagctggaattacaggcacatgccaccattctcagctaattttgtatttttaatacagatgggatttcaccatgtttgccaggctagtctcaaattcctgacctcaggtgatccgcccacctcagcctcccaaagtgctgggattacaggtgtgagccaccatgccggccaggagatccccttcttaagcctctctacaggtcaagttaggcagcaagcccatgtattccatttttttttttttttttggagatggagctttgctcttgttgcctaggctggagtgcaatggtgtgatcttggctcactgcaacctccacctcctgggttcaagcgattctcctgcctcagcctcctgagtagctgggactacaggttcgagccaccacaccaggctaatttttttgtattttgtagtagagacggggtttcactatgttggccacagacacctttttgagtgcagactagaagcttggttttggcattttacctggcatctacatcatgttcacctgtgtattggatctgaaaactgggacattctacagtttgtggaactcctgcaaatgttcctgcaattgatttactcacacactgcccacacccaccccctgtacaccacaggttcaagtatttgactcttcccaccccacccacccctgccaccagctgctctataccctcccactcactctcagggcccctgaggtccccagggagtcaccaccacataccactctctgtatctgggggaaggtctaggttgttggaaactttaatcaagcaaggacagttaacagctgcagaggcaccttaggaaacagtgagcttcaaaaaggaaatacttgtaggatctcttgtgatgacctttgacgacttttctgaaaatgacccgtcattctctgccatggaaaataacagtgatcacaggcagccttcagcccacagaaggcttcctcctccaggcaggctctgacatagccgctcacctcacagatgccctaacagactgcaaagtcctgggaacatgcatatccatgcacacacatgcacacgtgcctctctacaagtacatttttgaggtcacagctttgcctcagtggccacttcctctagggctggctgggcggagctattggcagagctctagggtccctggcagtgtcctgccacacaccaccaatcatccgagctgttggcatgtggtgaggaccttttcccccttcctttttcctccccacagctgcaggagggggattctgcggggcggatgtcactttgctaggggcgggttcttcccacccccacactacatcttgttctagctccttcctatcccggatgtaggccattttggggttcctagtaggggtcacatcccggtaaaagaacattagggagcacctttgggcacccctgctcagcagccccctttcccccaactggttccctctctcctccatcagccaggcccccaccacctatgagggcctcgcggtccctgggtcctccgccacaaatgccccctttttccttggggctgggtgggaagggacagctttgggactttttaaagaaagaactttgctaggaaagtaagagacgaaccaaaaccaaaccaagaaaatgtcaagacctccgctggtccggaatctgcgctcggcctctggctctgttctgctcctctgccttgacttcacctaggaagctgcagccttcttaagccctctgcaactcccttgctcacctgctccctggctccccatgagggtgcatggggggcagtgctgccacttgcctttccagaggtgctgcagccatggctcttccttaccttcacctctggcccaggcctgttcctgaacccccagttactggaacccccaggatgatgagaagcgagggatgcaaaccaggaacccccagtctcatggggagaacggagcctcaccctggagctggggagatcgtctgggtcagtgcagctccagctacacatcataagccccagtggacaaggcagccaggaggagggtggggcagatcagggcagataaccagaaggaccgagtttggggcccagcatggcccatatgggtttaagatgcatggagaggaagcacagggaggacatggggacaggcccatcccctacccctgtgttctggacctcagcgtcccctccgtggcccctctggccctggcccagggatgccttctgcttcattgagcccatctgtttgagacttgctaacaccttcctcttttgtgactggaagtcacagggccaattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacagggtaagggggatgaggcctccccttgatcctgcatccccacttcccgccccacagatcccattcccaaatcccaccttggtcccttttctcttctctctagacccaggggctgatgatgatggggaaatcacctacgagaatgttcaagtgcccgcagtcctaggggtgccctcaagcttggcttcttctgtactaggggacaaagcaggtctggagagcctgggggatgtgtgtttgttggggggctgtgtcttgagctggggagtccacaatgtttttgttgttgttcttgagacagggtcttgttctgtcactcaggctggagtgcagtggtgtgatcatggctcactgcagcctcgacctcctgggctcaagtgatcctcctgccctggcctcccaaagtgttgggattgcaggcgtgcgcccccatgccatggccctcagtattcttgagagcacaataccctggggaaaggaggagggcggttcttaggaaacagaagaataggaacaggataaatgggagccaggggaggaagaaagattcctcccgcaaggtggagacccctttcggggagataagggctgcggagggatagggcagccctgtgggggatgagttctaatgggaaacggggagccatgggagggaaaagaggtgatgggagatggatgagagcaaagggggagagggtttggagccgacagataaggggcctctgaggaaacgataaagggagaactaggagagatgagggggtcccgggaaaagatacagtgagacccaggaggaagccgagagagtcccgggcagaggaggaactcaggagagtgacactgtgtcccagagcagctctagcaggcaacgtagggcagactggagtttcccagtggcgagggcgaagcgggtgcgcaggaggagaaggggcaacactcggggcttccggtctcacactggatgctcccctcgacagcggtcaagtcggagcagccaactgcgtcctggagagccgtgacgtcaccagctgtcgggcggattctcccctgtgagtgtgcctgtgcggggcagccgcggggccaagtgctcgcgcctgtcccggctgcggatggcgctgggccccgcggggtgcagctccttccgggataaacccgggcgcagtccttccgacgcccgggctgccgtgccacattcaccttcatccggtgcgcctgaatccgacgtgcaccgcccccctgcggatggtcccaattcacctacctgccccccttcccctctctccgtctgatatttccttccccttctcccaggtaacgcccccgagtccccaccagcactgattctggaacaccctctcccctacctgcgaaacaccccgctacccgacagaaaccaccatgcttgccccctcagctctgcaccgccctcctcttagggatgccttccccaggggtctcccccacggacctgtcccttcctctctacattctttacgggggctgactgccctcatccatcccactgtccccctaaggccgcacaacctgcctgcgatacctcctgctcggcctgctcctcacctgcctgctgttaggagtgaccgccatctgcctgggagtgcgctgtgagtaaggctgtccctacttcccacttacaccgaacgactttcgtcccgactctcgccccaaagctgatcttcctcagcagggatcatagtcactaccaccacctccttagctttgggtttggtttccagccagggctgttgtcttcctgaattgtcctcacctaatccagtacctccttacgctttagtcagtcaaatcttgtatttcagcctgtgatgcaaaaagttgcaagaagcagaaaaagggctgatgctgcagtctcagggcactagggcagggctggagaagacatccaccaaatctctgtggccaaacagatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcaggtatccgctctggggagaggagagaagggagggatggattggagcaaggagatagtagtggcaggagtctatcacccaggggcctgtgaggtgttcaggaaaggggcagtgaaccagagtggtggctgacatgagctgttcagccttggccaacagagagaaggaccaagctgcatactagatttagggggacccacccagctccaaggctcatcctgtaggggagaggaggatggcagccagcagtccaaatcacactgtccaaggtttcttccggttgatatcagtgacaaggatctgggaacgcccccaaatttggatgtgaacttggcggtttgcacatctttctaaagacagggacctcatttttaattaattttcgttatagctgagatctccccaaagggtaagacttactggctgacatggagtgcaacctggtggtggggcaaggcagtgaggcgctcagcactcacagtgaggtggagctgggagttgtggtgtagggaactaggatggggtgtccattcattttgaaagcaggaccccagccagtaagtggagatggggaaagggacacataaaagaggcaaggctgtatcaaaacaggctgagggtctaggcaaggtgccacgcctaaggggactggggtgtttttgggctatgatcaggtttaggctctgtctagcttgggggtcatctgggtgatctccccaggcataagacagcaagattatgtgcagacaccccttgccctcatttccttaaccttaccctctgtgaccatcagttccatgccagggctgctcttagcagcatgttagacctctacctcccaaattgctcttccggcgaaaggatggtttcagacttccactctgatcacagctgcccaccactcctgcaggttttccccacacttttttgatctcatcaaggcctccaatctgctgactcccctttttctcccttcccatcagtccaggcctccaatcaactgattcccctttttctctcttcccatcagcttctcctgtccacacttctctccctacctaacatgggtttggagcccatcacttcaactactcacttatttttttaaatagagacaaggtctcactatgtttccctggccggtatcgaactcctggactcaagcgatcctcctgcctcagcctcccaaagtgctgagattacagtcgtgagccaccgcacctggctcactcacttctttgttccattatccttctagtgtacctgatgggcaaaatttgaactctggatgaacccaactgcccatggtcagcatcaaggtgtgacaaattgtggaatcattctgctcagtgccactgagactctagtctctcagcactgcctggcaacctttgcaatggtcagcttgctctccatagtaactccttctccctcactttcagcagatgtcctcatcttccactctttcagagaggaattcccttcactttccatcaccaagtctatatatccatatggatttttgcccatcctcatcttttgcaaggatatctgcaacagctttctaaatgtttttcctactcactcctctccctgcagtccattcttcatattggagccagggtaatcttttacaaacaaaaatctgatcgtgtcacccaatctacagcattccagttaattgattacataaacagttatggaatacataacatataatatgttctagcactgtgcccaggcacttgggatatagctagtgaacaaaattcctctatgtaaaaccctacactgactttctcttcctcataatataaaaataaaaatccttaacatggcttccatcactcctgcctacctttcagtgtgccacttatctcctcaccctcttccatttggccatacagatttctttttttttttttttgaggcggagtctcgctctgtgagactgaagtgcactcccaggctggagtgcagtggtgtgatctgggctcactgcaacctctgcctcctggattcaagctatccttttgcctcagcctcccgagtaactgggattataggcatgcgccatggtgcctgggtattttttggtatttttagtagaggtggggtttcaccatgttgaccaggctggtcttaaactcctgacttcaggtgatccaccccgcctcggcctcccaaagtgctgggattacagaagtgagccattgtgcccagcagggatttctttttattcctttaagttgccataggacagtagctcaagggagtagcagggtggggacatgagcatatgtagagagaagagagggagctagtggagagggaatgatttttgagtgatgaaggtaggactgatggaacaaagcaatggagagaggtggcctgggatcagaagtgcacattgggatgtaggatgttgaagaaagagggatatttatttcttatggatagtcaggaaaagaagaacagagaagagaaattttgaggtggagaggagggaaaaggagagagctcagtttctgcaaaacagtacacaacattttctgcttgtaggaaattggagagggacggagggggccagtgctggaggagtggaggatgtgcagtgaggggtgctttagggagtggaggagatgggcccaagagatgttaggtaaagtgtcagggtggactgcaattgttcagaaattggggtaataaaatcagccctattaagacagacctcccagattgctaagaagtaatgttgttgaatgttaaagtctttttactaagtaaggacaggtatggtgtttccaggggatgcaaaagaaagattgcaaagatcatagaagtccatgaaggtgctgagattagctctgggggaatattgttagcaaaagattgctgagtagtcactttcatcccaactgttgctgctatcacactctttctgctttttagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcagtaagcatatccttactcacagactgcagtgggtactattaggtaaagggacatatgtcatcaagtcaggaatggcagtgcacacatggctggggtggccattccttttccatggaagaaactgagaatcataatactcttgacctctgagcttggaaacaacctctgcatcttctcagcacagtggtccaggcagcccctagtaactgattagagttggcatgagaatggaaacttaaccatatctacatttttttttttttgagacagagtctcactctgtcacccaggctggagtgcacttgcataatctcagctcactgcaacctccgcctcctgggttcatgcaattctcccgtctcagcctcctgagtagctgggactacagtcacatgccaccacgcccagctaatttttgtatttttaatagagtcggggtttcaccatattggtcaggctggtctctaactcctggcctcaggtgatccacctgcttcagtctcccaaagtgctgggattataggtgtgaaccactgcgcccggcctctactttaatgtgtatctcatctcagcttgctggtcagctccctgggctgcttgacaggttcctggactcttgtggcctctcaggcagagaggtcccacacctggtgggctggattgtagggattagttccttggggccagaacagcacacagaatgactcccctccaaaggctggcagagattcttactcagctggaaggcaaatttagcagtgagcctgcatctgcagggtggcacttgatggattcagggacaagttaccaaagagctgtcatatatacagcccccttgccaaagctgaggcctccctagggtgtgcattttcttccatatttctcatcactctccatgtatctctggtctctctgaatctcccctcagcactcttactacttcttaaattcactgttgccaaatggtggttcagggaattcatattggactggcctcagctctaacaaggattggaagttgactgatgatacacaacgcactaggtaagtttgttaggacttctgggtattttcaactccataatcccctccataaagacatggtaatcagatttccttcccacctggtcccctcaggactctcccataaatcaacactgtaattgcctatttgtctgtttcctctatttgattaataacttcttagggcaatcttattctccattctatttccacctagaagtccctggcacatacttttttgtttcagtaactactaggttgggacctacgctatcttttagggggagacattaaggatttagttaaggctccacagctgatgacagcagcgtttctccatccttcgagaaggccacccaaactgaggttgtactttctcagtagcggccacttggggcactagagctgcctcagtgaagtacgcaagggagcagcgggggtaccatcgaagctccacttcactgtgatcaagacagcagtggggtaccattgaggatcaaccctagggaccctgaaacagggtggcaacctccttatgttcctcaattggccttcccatcttttttttttttttgagatggagtctcgctctgtcgcccagactggagtgcagtggtgcaatctcagctcactgcaagctccgcctcaggggttcacaccattctcctgcctcagcctccccagcagctgggactacaggcgcacaccgccatgcccggctaattttttgtatttttagtagagacggggtttcaccgtgttagtcaggatggtctcgatgtcctgaccttgtgatccacccgccttggcctcccaaagtgctgggattgcaggcatgagccaccgtgcccagcctggccttcccatctttaagatctcgagttatttttccctctgctggttctaaagtctgttttagttgaactccagacatctgtcctgaaccatgcccagatgtggccttaggcaggcagggtgagttaggatttaggttttatacaggggaaggggagagaagggagggtgggatatgtccagagcatatcccagctctaccttactactttttaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttggtaagagtgagggatggggctgaggcatggggagtccaggggcagagggactcagagcagggactcagagcaggggcccaggggcccgagagaaaacttgtacctgggatgaaagttcctccacagcctccagttgcttggtctgcttgttagggtggggtgggcagggagggacaggtaaggcctacaacttatgggaggctggtggtgtggctgtcgagagctgaggaggagatggggtgagtgggatgagggttcagttaagtcaaccatggagctcactgatactttacttttccagacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattgcacgtgttagtctcatgtgtcagcaatgctgtgtctggttcagtgatccccacgggaacgcgagccggggggtcgactggaagtgctctgtcccttgagtccatgctggggctcccctacacggggagaagagccggtcagcccatctggaactggcactgtccagcaagtgtgctctgttcttacagggtgtcctgaaggccaaagttggaggcctgagaccacgggctccactgctaagagcgtgccccaggcagctgcaggctgggtgtgggtggcttggcgtggtgccctcggtggcagaggagactgcccgcctcacagttcaggttgcggtagcgggcaacagctggtgtggggcgggggcacatggacaggaagccaaagctgaaggggccgaggcagcagccaggacagggcagcccctcatcgggctcccggggagctgaagggggtggcgagggttctgtccgctccagggctgccgcccggggcaggctatgctgggcccggttccagggctccccagcccagccttgtggggagttcaccaccacagctgggggattgttattgaggacgggtcctgatctaggggaccagggttgggaggccgaggaacaggtgctgatgaagttgtctgtggccacagccagaggcagctggggcgctggccctggaggttccggctcagggctgctgccctcgcactccatcttctcttcagccgaggggcccacagcgggagggccaggacctggcagtgctgtctccatacggcgggggagctcgggggatgagggtagtgagcggcagcggcgggcaggtgtcccaggctggaccagggtctccggagtggtcaccaagggcagctgagtggatgggaatggtgatggtggcacaagaggcaggactggcttgctgggtgtgtctaagagcttgatcttgccacccctgaggtcttcccgtagtgagaaggggttgactcgagtcagattgtccccccagttggggggtgattctggtgatgggggcaggaagaggtctgaccggcttcgggaaagccggggatctggcctgggaagcgtggcagagggaccccctcttgcaacagagcctgtagatagagaagtctggaatcactgtcctcagcatttgatcacagctccttgagggcctcactattctccaggaggctggtgggactagagcttgaaaaagggagtcccacctggtgctttggaaaggggtgatgtcatctccaggccccttttacttctttcccctcctctccctcaagctttagcattaggaaactgtcttcttggagatgtcctcccaccctaccccagcccgacccccagccttttcaactaataaatatacttagcctcccccatgtcacctctgaattctagggaggacaaaggccaaaggactcaagctggatcaaggtcaggctcccttaccctgattgtgtgtcagggcggtcctggtgagtggggctggctcaggcagctgctccaggatccattccaggtgctgggtaatttcggtgaagggggcacgggtgctgggttccagctgatgggtagagacaggaacggcttcactcagtgctccgaaagagggtctctgagtttcctcccatcacctgggtcccacagggcagccatggcagcttacggatgggggcagggtggggcaggaaggagtgtgaggctcttacgttgcagcagtggatggccaggagcaagaaaggcagtgggcagtcatcccccaccagagttcggaaagcaggcacatccaggccaaagtcctgtggggacagaaggagggacctccaagtcagcttttcttgggttctccttctgctccccagtcagaacctcaacctctagggaatcctccttggttatgagccagctagtctggaattctttctttgcaaacctagaaacattcacctcagtgcgtggtaggtagtcagggtctgcaggtactcgggcgatgagctcacagaggacaatcccgaaggcaaagacatcagcctgggggtcagagataatagtgtcggggaagaattaacagttttcatttcagaattttgacagaatatagcagaatttggttgagggtgggggatcttgacagttttcatgtgttagaagggtgcctgtgaggggcaaagggatcttggggactcctgaagatctggtagggttgttttggggatggatggggctttatgagaatacctcaagggtctcggaaggccttggggatctgaagggttgatgtctcaccttctcatcatacagctcaccccgtaacacctctggagccatccagtatggggagcccaccacggccaatggctccttccttgccccctccctgcaggggcaggggcagagtggtcagaagcatcctattcaggcatcccccccaggcaaaaggggatgaggtgaactccctccgttccccaagggaaacatccctggggctctggggacatcagataggggcactctgggagatttggggggaacagggacattcatctcacctatacacaggaatcttttcggccagcccgaagtcacccacgacagcggtgaagcctcgatcttcccgtcggactagacagttctgacacacacacacatagtatccccacgcactcatcaccttctgctgtctggcctcccaatgtataacccaaagccctgtcactccagcataactccaaccctctctgctctcccagtttttcaaggcacttcaatattgcaacatcatccaacactccaaacacagggtgctactcagtccctccgagcactcccctcaccctggtcccccaatattctccaatgccttgccactccaacatcctaatatatctgttatccatattccaacatccacaggccagttacaacctaatagcctcaaaccctctttcatgtctccacccaccctgctagcctaccttggatgtgaggtcgcggtgaaatacacctttggagtgcaggtaccgcaggcctcgggcaatgtccagggccaggtggagcctgaccggccaggacaggggttcaggggagctgagcagctgttccaatgtccccccattcatatactggtgcataggaggagaatgggaatagatgtcagacttcagtctgtattctaggtcccccacttacacgctaggggacactcccgaggatcacagaggtcataggggtaagactgtgctgtaggaccccccccatccatgttctaggattgccccgttcaactcaatagccattagccatgtgcaacaatttaaataatttaaaaaattttttaatcaagttgacccacaaaaaataatctaaacaatgaaaataatttaaatttaaccacatgtggctagtggctactgtattggacagcacagatagagaacatttccgtcactgaagaaaattctattggacagcactgttctaggggatacagagaataagaccagttgaggccttttatatgtggtttgcctaaaggaaagttcaggaaagcctcccctgagaggagatcctgttgcctctcactagtcctccgtagatccaccaggcctgttgactccctttatccttgggggtgaaggggggtggggatccctccttcctggcctatcctcacctctgtaagagcgtgcagctgtccctggtgcacacagactcccatgaacctgcaagaggatggggaagatagaaggataggctattaaaggcctcagctcctcctcagttccacttttcccgcgggatctttccctttctctcccgcccagcaagctgcccagagactggggccgctcaccttaggatgttggggtgcctgagccggttcatcagctgcacttcccgtagtgtgttgccccggttactggggagcttgttcatcttcagcaccatgacttgccctgactgtcggtgccgaacctgggggcaggagcagccggcgagggccgggcaggtcgggcgggtcgccggagtctggaccctcttccccgcactcccggccccctagtttcagcctctggttgaaggctcggtcccgcccctctgccctctcggccggtcctaccttgtagacctcagagaagaagccggccccgatcttctccgcgcagtgaaaatcgtccacacgcgccaggctagacacggcgctgcggagagcccggtaggaggaggggcggccccggcccgggcctccgcccgtgccccccggccccgggggcccctcccccggcacctctccaggcccgggcccagggccccgcagtgggggccgttccccggccatggccgggcccccagcccgggcctgcctcacatggcagggtccccagggcccgggcaggccgcgcttgccatgggcgcgggcccagcccgatcccgggcgcccggactccggctcccgccctgagaatggaagatccgccgaagatcctggacccgcccccgccgcgccggctggctgggcccgggtggacgccgcgccgctccgctccgcgcagggcctgggcttgggcctggaccgggcggtggcggtgacggtggcggcagcgctccggggcgccggcgggctggcttgccgcgggcggaggcgggcgggcgggcgggcggcggctgctccgcttagccgccggggatcaggctccgcggcctgccgggggcggggctgggccgggcctccgcttaactccttccagcccggcctcccggcagcggccacgccccctcaggtgcgcacccccgcctccccgctttccggccgcgatgccctgggccgcccgggtcaaataagctccggcctgagcttgaataacgggagggaattaagggctgatggtgcgcatgcgaagcttagctgcccagggagtcccctctcctccctgggttactgtccgttgagggtcgggctcagaaacctgccggattcctgggctccagggaccaacggggcagaaaggtaggcccctcaggcccagccgcaatcagaggtagcctagcaacctgtccaccttcctggcctgcgccccggcccagcctgcccatttcccaggtctcttcgactccgacaccttgaacctctggcctccctaacaccttctaccttcacgggaggttgtgataccccggggctataggaagcctttggccggcccatacccagcttagccccgactcctcctcacttcatcctgccgcctcccaataaagaagagagtccaggtcctccgccctgtgaccacccagccgggacctccctcttactactttgcccaaaagactctaagagagaagcctccacctgcagggaagcccgtccttccgcaagatcccacccccctcaaagaacgctgtccctcggagacccctcccttcctcagtgagacacctccctttcgggggcacttttccccagtgtggcactgccaccgtcagtgtgtcagaacccctcagtgctgcacccccttgctctgtgttcctcccacgcagtgagaccccacctccgaggaaatccactagtcattgtgacccctcctctcaaggtgactcctcccctcagtgtgacccagccctcctcagtgtgagggttccgccctccacgtaggaacacggtctgccccctaaggccggaggaggggctgcaactggcctctttaagtcggcgcggtgcctgggtgcgcacgcagtctcaggactccgtgcactcgccgtaccagacgcttccggttctgccgctggttcctcctccggcctcggcgaaatagccaatcatcgctagggttgggtggtgacacgcgatcccggcggtccactccggggcaaacggtttaaaagggcgtcgttgagccgcctgccacctagcggcggaacggtgggcggagggagagaaagctgccgtctcgagtgcggaggcaggctgagagctcctcgaggaagcgaggctgagtcctgcaggaattctcaagtactgtattgatatttctgtagtaagcttaaaagagaattaatacaagcacagtccgtatcgcgtggggttaccgtcttccaatggagtctggttacacgtttatgagacttggagccaagaaatactactcgcttgtcgagggctactgagaaaagaataaagacggtcataaatgatacatgatgccttagagtcaagagaaggccagatgctgtcttggtgcgctgtacaagggaaggtattgcacaagtttggagcgagaggaatgggagacattcgcaatccttccacagccggtggaggcaggccaacctcacagaattgcacggggcacgtgcatcctgttcttttttctggaggcgtttggtcttcagcacacgctcattcatcacattaatgttaacatctacaactaatttgtgaatttgctttttattgtatgacatctgtaaacactaggaatttatgcctcattttgtttaatatcatagatcttttaaccgacactgggttctggccctttatcacgtttgagaattactgtagtagttggtgatggtaatgccaagccaaagagccaggtgcctattttttgtaagatgattgcggtggttgtatggaggccgggagactgattaggaaggaggctgtgactgtggttcaatcaggaaaggatgagaccagcctggccaacgtagtgaaaccccgtctctactaaaaatacaaaaaaattagcctgatgtggcgagcgcctgtaattccagctactctggaatctgaggcaggtgaatcgcttgaacccgggaggcggaggttgcagtgagccaagatcgcgccattacactcctgtctaggcgacaagagcgggactctgtctcaaaaaaaccttttgttgttgtttgtatggtggaaaatgtcttaacacacacacacagaatagaaaaatgaatgtttatttaccttggattagtaagaccattttgttggaaacccatagtgcaaaattggctttcctttgcctcagttgtactgttgccatatttgacctggcccaggtgaaagtacctactttcatttacccttctatgtcagtgattctccaatgagcaattcatggccaatcttgtttcatctatacccgtgccctcttccccactccatatttgtgtatatttctgacatatcatttcatcctgtaaatgtttcagtacgttatctctaaatgataaggattcttctttaaaaccaaatcacagtattgtcacaccaaaaaaaaacaatagttccttcatgtcatcaagcatccagttgtttacatttccctcactgtcttacgtttgatttttaaaaattgtttatttgaatcaaaatctaaattaggtctgtactttgcaggtgatatgtctgtctgtctgtctctctttttgtgagacagggtctggctctatcacccaggatggagtgcagtgggttgatctcggctcacagcaacctccacccccgaggctcaagcaatcctgcctcagccttctgagtggctgggactactgaggtgtgggtaccaccacacctgtctaatttttgtatttttgtagagatggggtttgccacgttgcccaggctggtctcaactcctgggctcaagcattccattcgccttggcctcccaaagtgctgggattataggtgtgagccaccacacccagccatatgtttcttaagtctttgcagatctatgcttattctccatcttttttcttactattttttaaaactggttcatttgtcctgtagagtttcttagagtcttgatttctgtggtaatttagcatgttcctccatcctctgtatttgatataaattggtaacttaatcaaatttagatttcttttggcaaaactaatttgtagatggttttagcacttctatcaggaggtatacaggaggtatacagtggtggtctttttgtgattttaataactgatatttgtttctcaaccgtggcactattgacattttgggctggaaaattctttattgtaggggctgtcctgtgtattgtaggatgcttagcagcatctctggcctctacctaatggatgccagtagcacctcctcctgactgtaacaataaaaaaatgtgtctagacattgccatttgtcctctgggggacaaaattgaccctgaataagaaccactggtctaggttcattaatagaggagttaaagctgggcatggtggcacgcgactatagtcccaactacatgggaagttgagccgagagggttgcttgagcccaggagttcgagtccagcctgggcatcatagcaagaccctgtctcaaaataaataaaaagttagaaaataatattatcattccttctttgaatgaattcctatagaagtattaggtagaataattctataaggagaaacttttccacattaactatttgttacacagagatacatttcctaggaaaggcagaataaatacttgattgtttctcacttattttaccagctttcaaagtaatgagttggttccccagcatcttccaaagttgaccgatgaggttttttttaaagtaccattatgaactcataatttaacacatatgtgatatactcaattattgctagttatcttttttttctttttgagacgggtctcactctttttcaggctggagtgcagtggcacaaagctcactgcaaccttgacctcccgggctcaagtgattctctcatctcagcctcccaagtaactgggactacaagcacgtgccatcacacctggctaatttttaatttttttgtagagacagggtctcaccatgttttgcccaggctggtctcaaactcctggcctcaagtgatcctcctgccttggcctcccaaagtgctgggattacagacatgagccactgcacccagcccagttattgattgattgattgattgagatggagtcttgctctgtcacccaggctagagtgcagtggtgtgatctcggctcactgcaaactccgcttcccaggttcaagcgattcccctgtctcagcctcctgagtagctgggattacagacacctgtcaccacgcccggctgatttttgtatttttagtagagacagagtttcaccatgttggccaggctggtctcaaactcctgacctcaggtgatcctcctgccttggcctcccaaagtgctgggattacaggcgtgagccactgcgcccagttatcatttttggtgcttgtcctattgttacgggatctttggggcgtcctttttctggccagaaacctctgtggctggtggtgcttttgccccagttttgctcaggccctctgggcttgtttcgcctacccagcctggcagcctgtgcttggctcacgctaccagcctgggtcccatgcctgccaagggtgagacaggcgtggaacagttaggggtatgtgagtgagcattgggtccagccactgtgcacagtcagacattccgggtgctgcagtggggcgggcagttccaggtgccagcatggcaccatttccctgcaagcctgcggccggaccaggcacatggcaagcagcttccacagctggcactgggggacacattggtgcctggaagcttggagatgccaggaacagcaggtcctcaaagaggaagtcacagccctggcttggggagctcccagggctaggctccccgaagggctgcagttcttctttccttgccttcacccacaacgtggcaagcaagggtcatgtctcacccccgtttgttacagctcttttagcctcaccatttggtgggtcctgagttcttgtcctgcgacaggaagaatgaggtacgcagacaagtgaagagtgagcaagacaaagagtagctttattgagcaatagaacagctcaaaagaaacctgcagggggcagctcctttccctagcaggggtgtcctgaggcatgttcagctcctagcagagagggtagctcctctctgctaggcaagtcgtcctgacaagtgttcagctatcagcagggagggtagcgtctctctgcagctggttgtcctgtcatctgtgcagctctcagcagaggggaggccctagagtgggtggcttctctctgcaggtatgtcatcctgtagtctctgcagctctcagcagagaggaggccccaaagttggttgctcctctctgcagctggttgtcccaacatctgcggctctcacagagaggaggccttggtgtgggtagctcctctctgcagctgattgtcctgacgtctgctcagagcctgggcttttatgggccttagaggggaggaagtgcatgccagttggtcctgggcagccatgggtgggcctggaagtgtcaccacaagttcccactcccatagtgtgatgggcagcccggtccccagccttcaggccctccctggcctgaaagtggggccttaccagggacctgccccatccgctcagaagcctgtctgcctcctgctgccattcatggtgcccaggctgtaggtgccaagaggcgcctgcaggccagtgctgagctgccttcagaccccacttggcttccctcctatgctcattggcacccaaaatctgtaggggaccaaagcagcaggggactggtgtgtcagcactgctccgagtatgtgcacactcggccaggctgtgacagtgcccaggctctgctcggactttgttctgagattggagtgggcaccaacagcaggaagaagccaggcagttggagcaggaatttctgagcctgtgaggccttctggggccccaagagggcagggattcctgagtctgcagccactctttgagtggctgcacctacacctggcaggggcggggctcctgcctgctctgctgagcaggaggcctgagtctgcagctgtggtttgggtggctgcagctgcgcctggaaaggtagggctcctgtctgctcccggtcctgaaagcacagggatgcctgggtccacagccgtggcttgggcggctgcagcagcacccagggagctcccaccccaacttggaagggacaaggatcccgcttgtccccagctcctgttggctccatggaatgtgcagccctggccatgcctccctgctgcagctggcatgatggcagcagccactgcagacagcctgctgctgccatcactattttgttcccactggccaaaactgtcctattttggccagtgggaacttattcaagttagttcctgagtccttctgacataaatttccagttttcttgctatccaatatgataaaatgttctggactcattttgtgcatatctagaccagagctggtatcagctactttttttccccagtgattcatggtcttttttagtgggaaatggtgtttggataccacaacctgggtattagaggaatataaagttattgaccttaaaagcagttaaatgaatgtggttgattactcattattctcaaaatagtatccccatgttgggcatgggggctcatgcctgtaatcccagcactttgggaggctgaggcaggaggatcacttgagcccaggagtttgagacaaagctgagcaatgaagtgaggccccctgtctacaaaacatcaaaaaattagccaggagtggtggtgcatgcctgtggtcccagctacatgggaggctggggtaggaggaatccttgagcccaagaggttgaagctgcagtaagccataatgctgccactgcactccagcccaggcgacagagcaagaccctgtctcaaaccctcaaaaacagtcaccctaatctctttattatgaaaaaattcaaacatgcagaaaagttgaaggaatgcataatgaacacctgtacatcattcatgtaaatccaacaattgttaacattttgtcctattagttctctctaatatagaataggtataacatataatagtaataatacaatataattttttttttttttgagacagagtcttgctccgttgcccaggctggaatgcagtggcatgatcttggcttaccacaacctctgcctcctgggttcaagtgattctcctgcctcagcctcctgagtagctgggactacaggcgcttgccaccatgcccgactagtttttgtatatttactagagatggagtttcactatgttggccaggctggtctcaaactcctgacctcgtgatctgcccgtctcagcctcccaaagtgttgggattacaggtgtgagtcaccgcacccggcctataatataaatcttattgtagcatttgaaaatatgtcgaggccaggtgcggtggcccatgcctgtaatcccagttactccggaggctgaggcagggaattgcttgagcccgggaggcagaggttgcagtgagccgagattgtgccactgcactccagcctgggcaatagagcaagactccgtctcaaaaaaaaaaaaaaaaagtatgttgaaggtgtcatcctcatttcaaaatcattagcagtgtctcctaaggtcattttctatgaaaacataataccgtatcttgaatcactttcttcatttggtttcttgattctcctcatatttcactggctccttctcccaggtctcttttgctggttcttcttcagcttcctgacctctaaacagtggaatacacagggctctgtcattggatctcttctcttctccctctacatacacattgtgggtcatttcattaactctaaggccttaaatgctatctacttgctgatgacttccgttttctctcccttgcccaaacctttcctctgaactctagattcctatgttcagttgcttactcatcattttctttttttcttttctttttttttgagatggagtcttgctgtgttgcccaggctggagtacagtgatgtgacctcggcttgctgcaacctccacctcctgggttcaagtgattttcctgcctcagcctcctgagtagctgggattacaggggcttgccaccatgcctggctaatttttttttttaattgttagtagagacgggctttcaccatgttggccaggctggttttgaactcctgacctcaagtgatctgcctgcctcagcttcccaaggtgctaggattacaggcattagccactgctcctggccatcattttcacttggatatatctaattggcttttcaaaatcaatgggtacaaaaaataattttctttttttacattttcggagatggtcttactttgttgtccaggctggagtgcagtggtacaatcacagctcactgcagccatgccctcttgggctcaagcaattctcccaccttaacctcccaataggtgggactacatgcatgtgccatcatgcctggctaatttttaaatttttggtagagacagggtctccctatattgcccaggtaggttctaaactcctgggctcaagccaccctcctgccttggcctcccaaagtgctgggattataagcatgagccattgcacctagcccaaaacagaactctcgattcctgcccctcttctccacctttttctctctcttccctatctcaataaatccaatgcagcggccaggcatggtgcctcatgcctgtaactccagcactttgggaggccgatgtgggaggatcacctgaggtcaggagttcgagactagcctggccacagtggcaaaaccccgtctttattaaaaatacaaaaaattagccgggtgtggtggtgggcacctgtaatcccagctactcaggaggttgaagcaggagaatcgcttgaacctgggaggcagaggttgcagtgagccgagattgcgccattgcactccagcctgggtaataagagtgaaactctgcctcaaaaaaacaaaacaataaataaataaatccaatgtattagatgctcaggcaagaaaattcagaattatccttgactcttttctttctaccccatagccagcccatcagcaaagcatatagctgtacctttggaatctatgcataacctgactacttctgacatttccactacctctgacccaatctaagccatcaggtcttttgcctggattgttgcagtagcctcctttttggtcttcctgtttatgcctttgcccccattcagcctattctctatacagcagtcagaatactcttttaaacatgtaagtcagatcattttacctctgctcaaaaccctctgccatcacagaatcaaacgtaacatctttcctgtaattttatttctttcattctcatttttatacctttaatttccatttccttgcctaagatcttcaatacaattttgagtgaatgtgacaatagatactcttatcttgttatattttgagacagggtcttgctctgtcacccaggctggagtacattggcatgatctcagctcactgcaacctccacttcccaggctcaagtaatccttccacattagcctttcaagtagctgggactacaggtgtgtaccacaggcctggctatttttttttttttttttttttttgccagagagagggttttactgttttgctcaggctagtcttgaactcttgggctcaagtgatccacctgccttagcctcccaaagtgctgggattacaggcatgagccactgtgcccagccaaataatgtttttaatggtttactattaagtatgatgtttactgtttcttggtcactacctatgccaattaactgttaccacaagaatgccacataactaaccatatcaaaactcagttggctgggcgcaacggctcatgcctgtaatcccagcactttgggaggccaaggccagtggatcacttgagttcaggagttcaagaccagcctggccaacatggtgaaaccctctctctaatacaaacaacaacaacaacaaaaaaaaaaaaccccaaaaattagctgggtgtggtggtgcatacctgtaatcccagctgctcgggaggcagaatgctcaggagaatcacctgaatctgggaggtagaggttgcagtgggccgagatcatgccactgcattccagcctgggtgacagaatgagactccatttcaaaaacaaaacaaaacaaactcagtaacatgaaacaacaatcatttattcttataaatctgcggattgactggagttggcattctaaatgagaattggctagagaggttttgctctgctccacctgtctgtcatactcctcctggcaccagcaggatagccgggaatgatcttacggtgatagaagaagggaaagaagataagcacagttgtgcaactgcttttcatgtttttgggtcacatcatgcctgccaccattgcaatgatcaaaggaagtcatgtggccaagcccgaaatacactctttctataaaggttggaagggagaaaatatttctaaactatggtacattacattttctcaatttacatctttttatgttgcctatatttctaaactatggtatatcacattttctcaatttacatctttttatgttgcctatctcttaacaggttactgtagttattattttggatagatttgtcttttagtcttcccacttagaggtatgaatggatcatacatcacaattatgaattatgatattaactttttttttttttttagacagaatcttactctgttgcccaggctggagtgcagtggcgcaatcttggctcactgcaacctcccctcctgggttcaagcgattctcctgcttcagcctcccaagtagctgggattacaggtgcatgccaccacgcccagctaagttttgtatttttagtagaggcagggtttcaccgtgttggccaggcttgtctcgaacttctggactcaagtgatccacccacctcggcctctcaaagtgctgggattacaggcgtgagccaccctgcctggccacaatattaaactattctgaatgtatctatgtacttacttttaccagtgggttttttgccttcaaatgttttcttttttcatgttagtatccttttcttttagattgaagaattctctttagcatttcttgtaagatggaactaatagtgatgaattctctcagcttttatctctcatatctgaaggaaagttttgctgggcatagtattcttggttgacagttttttttgttttttttttttttccttcagcactctgaatgtgttatcccactccctcctggcttgtgtggtttcctctatgcacctgggtatatctttctctaggtttggcaagttttgtgttatcatttctttgaataaggtttgtaccccttgttctttttaaactcccttttgaacaccaatgactctgagatttgcacttttgaggttattccttatattttgtaggtgttcattgttccttttcatgcttttttcttttttctgttctgtgtattttcaaatagcatgtcttcaagctcaattatttttttcctctgcttatccattctgctgtggagaacctctaatgcatctttcagttcagcagatatattggtcagttccaggatttctgtttaatttttttttttgagacagttttgctctttttgcctagattggagtgcagtggtgtgatcttggctcactgcaacctccacctcccaggttcaagtaattcttttgcctcagcctcccaaatagctgggattacaggcatctgccaccatgcccggctaatttttttgtatttagtagacatggggtttcaccatgttggtcagggtggtctccaattcttgacctcaggtgatccacccgccttggcctcccaaagtgctgggattacaggtgtgagctactgcacccagcctctgtttaatatattaaaaagtattttttgttgttgtttttttcaaatctttattttatgtacaaagaactatcatggtctttcattgagcagatgccttggataatcctttgaaggaagataatttagtccaacttaatgaaaccgatatccttcgtgtactgacggaaacactggcggcacatattgaggccctatttccagatcagaccgtgccggtttgaacagacgcgacaagagggagaaccctggccgaattttcgcaggtggctccagtacaactgctggtgacccatcttgctctcaggagtgcaacgaggtaaaaggttaaaaagtctttctaagtttctctgatacatttctgaattgttcttctgtgttatctcagagttcactgagtttccttaaaactgctatttttaattcttgatctaagagttcaacattgctgtctccttagggttggtcactggctcctttctttgtttggggagctagggtttccctgttggctgttgttttttttgtggatgtacatctatggctttgcattaatagattgttatttattctagtcttcactggctgacttgtttaggtctttctagggtatgtttgcttagaggttctttgcagttgcccagtgagtccccttattcctagatcaccatctcctttttggtaatagatggtgccttaagcccaggtttgccttggctcttgcaaacattcagagcactgcccgtctcaaatggggttgtagggggaggtcccaaagggaatgtggggaggctggctaggcgtttgtgaccggaaaacctgtggagtatttctcttaacagtgtggagctattgagaagtcactttaatttggcatctcctttggctgagatgaagaacagagttacatgggctagggttgctagtcctgtctcctctctttgtttctagctgttcttggggattttttcttctacaggcacttgtgatgcctcctgtgggttgaagcaggaatggttttcctgcaagggaatgcaagatgatgggaaagctggttgtctacctcagtctcacattttctggtgtagaaactgtgaacccaggagcaattttccatgtgtggtgcctggaaaactgagtgagggttgtcacagatagagaagtctgtttctctatctgctcaaagtttttccacttctgtgtccctggggattgtctcagcctcatatttgagttctgggatattgctgatgataattttggtcctggatatttgtttttggttttctgtgggagggagtgaagccagattacttctactctgctattttggtggcatcagtcttctacattaattaattttctgttaaaccaacattgcatttataggataaatatattgttatatatatttaataactttcttagtggttgctgtagggattacaataataatcactgggtggggtagcttatgcctataatcccagcactttgggaggctcaggtgggaggactgcttgagccctggagttcaagactgacctgggcagtgagagtgggacccccaactctataaaacttaaaaaaaattagccaggtgtggttgcatgcacctgtagtcccagctcctcaggagtttgaggtcggaggattgctggagcccaggaattttaggctgcagtgagttatgatcctgccactgcactccagtttaggtaacaaagcgagaccctgtctctaaaaacaaaaaaagaatatataaataaaaattaaaagcaatcagtcagacagttgaattacaaagttttttttttttttttttttttttttttttttttttttgtcgaaatggggttgttctatgtttcccaggctggtcttgaactcctgggctcaaatggtccacctgcctcagcctcccaaaatgctggaattacaggcatgagccactgcacctggccaaagataagatgttgaaagtagcaaaagaataatgacttatgatgtacaggggaacaacaatatgattaatggctgacttcttaggccagaaggcatgtatgtttaactttttgaatgaataccaaactccttttttgttcacttagtttcaatttctgttgtttatttttattttttttatttcagtaggtttttggggaacaggtggttttttttttttgttaggtggataagttctttagtggtgatttctgagattttggtgcactcatcacctgagcagtgtacactgtatccaatgtgtagtcttttatcccttgacaccccgtaccctttcccttgagtccccaaagtccaaggtatcattcttatgcctttgcgtcctcgttgtttagctcccacatgtaagtgagaacatacgatgtttggtttttcattcccgagttacttcacttaaaataatagtcttcatttccatccgggttgctgtgaatggcattatttcatttcttttaatggctgagtagcattccatggtgtatatatatatgtatatatatatatatacacacacacatacatatgtagacacatgtgtatgtatatatatacacatacatatatagacatgtatgtatacacatatatacatacacatatacatatatatacacgtatatataggggtgtgtgtatatatatatatatacacacacacacacacacacattttctttactggttgattgatgggcattcaggctggttccatatttttgcaattgcaaattgtgctgctaaaaatgcctgtgcaagtatctttttcgtataatgacttattttcctctgagtagatacctagtaatgggattgctggattaaatggtagttctacttttagttctataaggaatctccacactgttttccacactagtacaactagtggttgtactagtttacattcccaccaacagtgtaaaagtgttctcatttcactgcatccacgccgacgtctaattattattattattattattattattattattattattattttgagatggagttttgctcttgtcacccaggctggagtgcaatggcatgatcttggctcactgcaccctccgccacctgggtccaagtgatatctcctgccttaggctcctgagtagctgggattacaggtgcccaccaccacgtccagctaatttttgtatttttagtagagacggggtttcaccatgttggccaggctggtctcaaacttcggacctcaggtgatccactcacctcggcctcccaaagtgctgggattacaggtgtgagccaccacacccagcccacatctgttattttttgattttttaattatggccattctcgcaggagtgaggtggtattgcactgtggtttcaatttacatttccctgatacttaatggtgttgagcatttttccctatgcttgtttgccatttgtatgtcttcttttgagaactgtctattcatgttcttagcccactttttgatgggattgtttttcacttttcttttcttttttttttttttttttttgagacgaagtcttgctctgtcacccaggctggagtgcagcagcacaatcggctcactgcaatctctgcctcctcagttcaagccattctcctgcctcagcctccccagtagctgggattacaggtgcgcacaccactaggcccagataatttttgtgttttagtagagacggggtttcaccatgttggccacgctggtctcaaagtcctgaccttgtgatctgcccgccttggcctcccaaagtgctgggattataggtgtgagccaccgtgcccgaccctgggattgttttttgtttttttttttttcttgatgatttgtttgggttctttgtagattctggatattagtcctgtgtcagatgtatagattgtgaaaaatttttcccactctgtgggttgtctgttaactctgctgattatttcttttgctgtgcggaagctttttagtttaattaagtcctatctatttatctttatttttgttacatttgcttttgggttcttggccatgaagtctttgcctaagctaatgtctagaagggtttttctgatgttatcttctagaatctttatggtttcaggtcttagatttgtcttttatccatcttaagttttttgtataatgcgatttttgtataacgtgagagatgagaatctggttttattcttctacagttggcttgccaactatctcggcatcatttgttgaatagggtgtcctttccccacttgatattttttgtttgctttgtcaaagatcagttggctgtatttggctttatttctgggttctctattcagttccattggtctgtgtgcctatttttttttgagacggagtttttgctcttgttgcccagactggattgcagtggcacaatcttggctcactgcgacctccgcctcccaggttcaagtgattctcctgcctcagccacccaagtagctgggattaaaggcacctgccaccacacctggctaattttttgtatttttagtggagagggggcttctctatgttggccagactggtcttgaactcctgacctcaggtgatccacccgccttggcctcccaaagtgctgggattagaagcatgagctactacgcctggccatatgtgcctatttttataccagtatcatactgttttggtgactatggccttatagtatattttgaagtcaggtaatgtgatatctccagatttttttttttttttttttttttgcttaatcttgctttggctatgcaggctcttttttggttctgtatgaattttaggattttttttttctagctctgtgaagaatgatggtggtgttttgatgggaattgcattgaatttgtagattgcatttagcagtatggtcattttcacaatattgattctacccatccatgagcatgggatgtgtttccatgtttttgtgttatctatgatttctttcagcagtgttttgtagttttccttgtagaggtctttcaccttctttgttaggtatatttataaatattttattttttttgcagctattgtgaaaggggttgagttttttattttattctcagcttggtcactgttggtgtatagcagagctactcatttgtgtacatcaattttgtatcctgaaacttcactgaattcaaattttgtatgaatctttagggttttctaggtatacgatcatatcatcagtaacagagacactttgacttcctctttactaatttggatgccttttctttctttctcttttctgattgctctggctagcacttccagaactatgttgaatagaagttgtgaaagtgggcatccttgtcttgttctagttctaaggtggaacgctttcaacttttccccattcagtgtaatgttggttgtgggtttgttgtagatggcttttattaccttaaggtatgtcccttctgtgccagttttgccgagggttttaatcataaagggatgctggattttgtcaaatgctttttctgtgtctattgagatgaccatgttttataaatttgggaactccagtgttaggtgcatatatatttagaattgtgatattttcctgttggactagttcttttatcattatataatgttcctctttgtctttttaaatggctgttgctttaaagtttgttttgtctgatataagaatagctattcctgcttgcttttggtgtccatttgcatggcatatctttttccacccctttaccttaagtttatgtgaatcctgtgtactaggtgagtctcctgaagacagcagaaatttggttggttaattcttatgcattctgccattccgtatcttttaagtggagcatttaggccatttacattcaatgttagtattgagatatgaggtactagtctattcgtcatgccattttgcctgaatacctttttttattgtattattgtcatataggtcctgtgagatttatgctttaaggagattctattttggtgtattttaaggatttgtttcaagatttagagacccttttagcagttcttgtagtgctagcttggtagtggcgaattctctcagcatttgtttgtctggaagagactatctttccttcatttatgaagcttagttttgctggatacagaattcttggctgataattgttttgtttaaggagactgaaaataagaccccaatcccttctagattgtaggggtttctgctgagaaatctgctgttaatctgataggttttcctttatagtttacctgatgctattgcctcacagctcttaagattctttcctttgtcttgactttagataacctgatgactatgtgcctaggtgatagtcttcatgcgatgaatttcccaggtattccttgagcttattgtatttggatgtctagatctctagcaaggccagggaagttttcctcaattattccctccaatatgttttccaaacttgtagttttttgttttgtgttattttgtttttgagacggaggtttgctcttgttgcccaggctggagttcagtggtgtgatcttggcccactgcaacctctgcatcccaggttcaagcagttctcctgcctcagcctcccgagtagctgggattacaggcatgcaccaccacacccagctaattttgtatttttagtagagatggggttttaccatgttggtcaggcttgtctggaactcctgacctcaggtgatccactcgccttggcctcccaaagtgctgagattacaggtgtgagccaccacgcctggtctctagagggtatttaaaccccagaaaattctgtaactgatgctcttgagccacttgcttgagcccactcctaccctatggggtgtgcttttacttaaaataagtttctgcttttactgccttgctttgtgtgttttgtctgattatttgttcaaaacgccaagaacctggacaactaccctcaaccagtaacactattgctcatttatttctggtgttcttgggtcttacggggttatagactgtgtgactcctggaggggaaagggtggccaacatacagtcacctctgtttcatgtttttgatatacaagggaaagctattcttaaaagaacaggtgactccccagggagtcaggagtggttacagggcatgacttcttcccactcatggccacaaacaaaaacaagcccagttggagcacaaacagggtccctacggggtgcgatgcctaccctttgctgccaagttgtgtctatagagatatttttccctgttctaattggggtggttgaacaatctttgttttccaaaaggggaggaggtactcccaccttcccagactaaatagttgtttttctcccatgtgttcctttttttttttctcctgtatgttctgatccaggggaaggaaccatagatggtctcattgcttacaagttctatcccatttactttgctgtggcattgggaacttggcaactaaggctggatcagagcattgcaggaaacttggcttttgtgtcattaacacaacactgggtgccaaagatagaatcattagtgcactagaagtatagatacccaactttccaggtccacataatagcagtgagggggttcaggtggaacccattaagtgggggagagttccatctaacaagtaatagtctggggagaggcagtgagatttttccgggtaggccttatggacttgctttttaatcagctgtaactctgcctcagcctcctttgttaattgttgagggctagtgagactaagatctcctctaaggatagaaaatagattactcatggcataggtaggaatgcctagagcaggttgtgtccaattaatggtctttagtcatttttgaaagtcatttaatgttttcaattgatctctacgtatggttactttctgtggcacaattgtagtgtcatttactaaggtccccaagtaggagtaaggagtagtagtctgaaatttgtcaggggctataattaaactggcaggaaaaatcaagttttgcaagtgatcataacattggagtaatatttctcgagtgggggcagcacaaattatatcttctatacaatgagtaatgtaacactgtggaaattttttacgagtcggttcaattgcttgtcttacataagtctggcaaattgttggactgttcaacatgccttgaggcaacactttctaatgaaaatgcttagcaggctgcaggttgtttactgcaagaattgtaaatgcaaaccattcagtcttgcttagctaaggggatagtaaagaaacagtcttttaaatctatgactattaaagaccagttttttggaatcatagcaggagaaggcagtcctggctgtaatgtccccataggttgtataattgaattaatggcccttaagtcagttaacattctccatttacctgattttttcttaattatgaaaactggagaattccaaggggaaaatgttggagctatgtgttctttttctaattgttcagtaactaagtcctctaaagcctccagtttctctttactcagtggccattgttctatccaaattggcttattcattaaccattttaaaggtataggttctggaggcttaaaaatggccgccatcaaaaataataatcttaaaccttggtgggaaatttgtctttccgcttgaagcggttccttcgaactttgcaaattttttcctagtcccgtaccaggaacataccccattttatgcatcatatgttgactttgagggctgtataattgttctggaattagaacttgtgctccccattgttgtaataaatttataggtacagaagttataattggttgaatagtccaggttgtccattgggcccttcacaatgcaaaatataactactttaatatacttcaggggctttaccaactccaactatgttaaattgagcgggttgaattggccacgtggacggccagtgctgtagataaatgattgaaacgtccactcctgtatctaccaaacctttaaatttctttccctgaatagttatttcacaggtaggatgtttatcagtaatttgattcacccaataaactgctttgccttgtttatttgtgcttccaaatcctcctgttcatttaatttcacttttccccatttctacatatggcacaatcaggagttgtgttatatgctgtcctggctctgctttccagggaacagaagtagatataacaacgtgaatttccccattgtaatgtgaatcagtgactcctgtttgtacttgcactccttttaaatttaaactagacctgtctagaagtaatcctattgtcccagctggcaagggtccacagacccctgttggaacttttttgcagaggttccccaggcagaaggctccacagcttttgtgcagcataaatctactgcggcactaccggctgtggcaggggacagacattgtataggggtgagggaatggcctgagccggaaatgccccggtttggaacgggcctgggacgggccctgaacgggcccctcatggcatttcccgaaattgggtttccatccttatcaaatttagaatgatgctgattggcccaatgttttccttttttacacttcaggcatatacctggttcatactgatagcctgtttaaactctttaagtaatttaaagagaaaagcctcaaatatagctataatatttctctgttgatctggggggtatatcctaacagggaactgccaagcctctatatcaccctctccttttctttctttttttttttttttgaaacgggtctcactctgtcacacaggctggagtgcagtggcacgatctctgctcactgcaagctctgcctcccaggttcatgccgttctcctgcctcagcctccccagtagctgggactacaggagcccgccaccatgcccggctaattttttttgtatttttagtagagacggggtttcactgtgttagccaggatggtctcgatctcctgacctcgtgatccgcccacctcagcctcccaaagtgctgggattacaggtgtgagccaccagttccggcctatatcaccctctcttctagcttgctggattcctgcctgaatagaactgacagcagtcactcgaagagctgctcgaacagtcactggggcaactacttttcgcccagtgtcctccgtaaaagaaagatctggagggtcaggctgctctttttcttcaaaataaggagggagtgcagaaaggtagggatgaactcttcctcctttgcctctttagctttagctggcaaacaaacctgctctgttaccttttctgttactttgttatactctccttcctcctcatcatcagtgtgaaaaggttccaaggtgggacgaaccagagcccacacttgtcccattgttaccctgatgcttctgagctccccttcttactcactacagggattgcttaagagtacttgggtgtcctccagcttagttccacattctccaaccattgctccggcaacccttcgatctgggttcgagccccacttgctgagaccagctccgtcgtggagaccctaacccagccgtgctggaggaattaaagacacacacacagaaatatgtagtgtggagtgggaaatcaggggactcaacagcctgcagagctgagagccccaaacagagtttgacccacatatttattgacagcaagccagtgataagcattatttctatagattatagattaactaaaagtattccttacaggaaacaaagggatgggccgaaacaaaggaatgggctctggctagttatctgcagcagcaacatgtccttaaggcacggatcgctcatgctattgcttgtggtttaggaacacctttaagcagttttctgccctgtgtgggctaggtgttccttgccttcattccagtaaatccacaaccttcagtgtgggtatcatggccatcacgaacatgtcacagtgctgcagagattttgtttatggccagttttggggtcagtttatggccagatttggggaccagttcccaacacatggctgtaatcccagctactcaggtggctgaggcacaagaatcacttgaacctgggaagaagagttacagtgagccaagattgcaccactgcactttagcctgggcaacagagtgagactctgccaaaacaaaacaaaacaaaacaaagagtacctgagactgggtaattgtaaagaagagagttcaattgactcacagttccacgtggttggggaagccttaggaaacttacaatcatggcagaaggcaaaggggaagtaaggcacatcttacatggcaggagagagagagagcgagggaggaagtgctacacacttttaaatcatcagatttcatgagaactcactatcgtgagaacagcctgggggaaatccgcccctaagattcaaccgtgtttctcccccaacattggaaattataattcaatatgagatttgggtggagatacagagccaaaccatagtattccgccctggcccctcccaaatctcatgtccttctcacattttgaaacacaatcatgccttctcaatagtcccccagagtcctaactcattccagcattaacccaaaagttcaagtccaaagtctcatctgagacaaggcaagtctgttctgcctatgatcctgtaaaataaacaaggtagttccaagatacagtgggggtataggcattgggtaaatgctcttattccaaatggtagaaattggccaaaacagccgagtacagtggcttacgcctataatcctagcacttttggaggccaaggtgggtagatcacttgagtcaggagtttgagaccagcctggccaacatggtaaaaccatgtttctactaaaaatatgaaaattagccaggagtggtggcacacacctgtattcctagctactggggaggctcaggcaggaagatcgcttgaacctgggggatagaggtggcagtgacccgagatgatgccattggactccagcctgggtgacagagtgagacttcatctcaaaaaaaaaccaaaaataacaacaacaacaacaaaaacacaaaggggctacaggccccatgcaagtccaaaacccagcagagcaatcattaaatcttaaagcccccatataatttcctttgactccatgtctcacatccagggcatactgatgcaaaaggtgggctcccaaggccttcgacagctccacccctgtgactctgcatggtatggccccttggggggctttcatgggctgggattgagtgcctgtggcttttccaggcacatggtgcaagctgtcagtggatctaccattctggagtctgggggacagtggccctcttctcacagctccgctaggcagtgccccagtggggactcttgtgggggggggtgctccaacttcacatttcctctccacattgccctagtagtgattctccatgagtgccctccactgcagcagaattctgcctggacatccaagcatttccatacatcctctgaaaactaggtggtggctttcaaactcttgccttctgtgcacccacaggtgcaacaccacatggaagccaccaaggcttggggcttgcaccctctgaggccacagcctgagctgtaccttggcccctttgagccatggctggaactgaagtggcagggtaccatgtcctgaggccgcactgagcagtggggccctaggcccagcccatgaaaccatttttctctctaggcctctgggcctgtgatgagagaggctgctgtgaacatctcagaaatgtcctggaggcattttccccattgtcttagtgattaacatttggctcttctctacttatgcaaatttctgcagccagcagcttgaatttctcccaagaaaatgggtttttcttttctaccacataatcaggctgcaaattttctaaacttttatgctctgcttctcttttaaacataagttccaatttcagaccatctctttgtgaacacatatgactgtacactgttaggagcagccaggtcacatcttgaacactttctttcttagaaatttcttccaccagatatcctaaatcatctctctcaagttcagagttccacagattccttagagcagaggcacaatgccacctgtctctttgctaaagcatagcaagagtgacctttgctccagttcccaataaattcctcatctccatctgatcatctccatctgagattaccatctcagatttcaccgtccatatcactatcagcattttggtcaaaaccattcaacaaatctctaggaagttccaaacttttcccacacctccctgtcttcttctgagccctctaaactgttccaaactctgcccattacccagttctaaagtcacttccacattttcaggtatctttaccctactcttggtaccaattttctgtggtctgttttcacaatgctataaagaaactacctgagactgggtaatttataaagaaaagagatttaattgactcacagttccacatggctagggagccctcagtaaacttacaatcatggtggaaggcaaaggggaagcaagacacatcttacaatggtggtatgagagtgagttagcaaagtggggaagtgctacacacttttaaaccaccagatcttgtgagaactgagtcactatgatgagaacagcatgggggaaatccgccttcatgattcagtcacctcccatcaggtccctcccccaatactggaaattacaattcaacctgagatttgggtggggacacagagtcaaaccatatcagaagggtagtggggaattgctgggggagggtggggatggtgaatgggtacaaaaatagaatgaattaggcccattatttgatagcacaatggggtgactatagtcaataatttaattgtatattttaaaataaagagtgtaattggattgtttgtagctcaaaggatgctcgaggggatggggaccccattctccatgttgtgcttatttcacattgcatgcctgtatcaaaacatctcctgtaccccagaaatatatacacctactatgtacccacaaaagttaaaaagaaattctgaaatgcccatcagacattggcattcaatggatgagaaccattccaccattttaggattttaaacctcacattaagctcactatttaagcatgtattccattcatatatacttaacctttttacttttaacaattgtatctagcccacctcccagaaccaagataccatgcaaagctagtcaccatttaaagccattttaaccattttaaagcctatgaacatcagtgatttacctatgtaaaaattcttaaattttagaagacacaacatcctcttcaaactaataagcttagactagtcttatttatgagtgcttgtttgtttataagccaatttgatagcatgctagacacaatgctcatcaccatacctgtatatacacctaaacaagcacattaaataaaacgacttatataagacagctggattcaagttagtttcacaattggaacccatctacctagccaaatgttgtttgcccagataggtttggaagacaggaagaggcagggaaggggatcctatagcatcaaataaggaagggaaggtgcaacctgcattgctcaaggggagattctggagtccctgagctgctggagagctcacccagcagccaagacaccaaagagaaatgtttgggcagccacttatctgccactgtgggaagctgtcagttaggccaaggggctgagaactttagtaaccttacttgagcaagcaacttgttggggctagtggaaggttagctctactattgatagggagccttttcctctctcaccggggatggttaggatgctgtgattgccagtggcctttttgcttatagtaggcacactgatcgtggcccagggaccagtgagtcgagggatcttttctgggcatcccagatgccgatctcgcaacgctttcttgggatgggtaattctgagatggcagggggcttaaagtaactgttaacaattgcactttttggctctttctttttttcttttttttttttaacctcttttgcttcatccctattgtcgtaaactttaaaggccgaatttgagttggctcatagggatttgaggtcccattgctgctttctgtagcttcctgctaatgtcaggggcagatagagtaataaaatgtaacgcaggagagcttgcccttctggggagtctgaatctgcattagtatatttcctgagtgcgtcaacaaaatgaccctgaagcagagtgggatttttatcttttcgctgagttatttttctaaccttgtcatctttagctggcttaaccacatacttttttctccactttttttccccatggcacaacaagcagatgacaatacttgcaagtcatgacaaattaaatcaaagaatgtggtcaacttaaactcctctgaaaactggccaaagttctccttgtataaagccaaattagacataaaaaatggcacatgcactccaggtgtcccccccatttccatgggctacctcccacaatggacacagtttgactttaggggcagtcccactcctggtggtactggttgggcatactttcttgggcagttgggggtataggctgaggctaattggaaaagggggagaggtgcctgatgaccttggggtggagtcctttgttagagaactggtgggacccgcctcacaattgggagactgaggagattccagggagggcatagaccttctagggggagcagctaggaggagatcccttagatgtggctttctggtgccttaactaatgtgagccagtaaagggtcataatagccctttactgtacataagggacctcttccgattttccttcttttttacagaaaaagtccaactgtaaaatatcatagcatataaaaccatgtttaggccatatctgttggttttatagtttgtattgaacccaaacggttttgcaatagaaaatgaatttttctttaagctgaattagcctgaagggcgtcctaatggtgagttatctggaatactcatcattgtccccatgattaacaaggatttttatgcgcacaaatttttctaagcaagagggaaagtaactaggcccttgttatttttcccttttagattcccactccctgtagagaaggtttaagtataggtaagaaggcattacaaaagtggattacaagccacaaaagggcagtagaatgttgagcttaaattccacagagtgagggttgttcagagaaggcggctaaacacatggagactgtggaagagaggaagggaaggggataagcagcgttgcctgaggagagaccgcagaggccctgacttgccagagacccttcccagtagtggagacaccaaaaaaaaaaaaataataataataatgttcaggtggccactcgtctaccgctgttgagtggttgtccatcaggccaggggcctgggaactcctggtccgtttgatgtagaggggcttgagcaaagcagttctaagacagaatacggtaaggggcttgcaactggctgtcaggaaaacaataacttctaacttcagggcagaaaaagttgataccaatattcccgtagtgggtggggctataacctataatcctagagggaatgtcaatcctgaaaaccccagagcatctgggagtggcctatcataccaatgctggaaacccagagtgcctgtttcagccaatgagggtcccctcaccaaatgccaaaaacctgggggcaccaagggagtggccaacagtgaacccaagaccaagttggggtcatagaacaatgtgactctggtgtcccagagttgacgcaacagagcacaactaaacatccagccttaaacaattgctcaaacacagttaacagaaagtcaaaaggaaacataacgcttcaaatgaaacgtaaatttttggactcgaaataaaaataaaatgattggtggaacaataatatggagtcagagaagaaagcacaggggggagaggtcacaaggatgtgcctcagggcactcatactgtgggggacttttaaccacttagccgaaggctttttattccccagctcactagatgttatggagtaggggaagaagggacacttacccatccataggagccaaatggcaccagccagtctttcatgtgggaccctggtgaaggtccctccaggaccccccagcttgggtgggctcagctgtcacacagggggcaagcatagggactggtaacccactggcctgccatggtcagagctcacatgaggcagtgacattatggccattagtgtgtctgcttggccctgccgcctgccagggaaaatgatggctctgaaaagagcctttggttagtgttagcagctctttattgttacagcctcagtgttatagctcttgcagccttgatcacagaccgctttgcggtctctcgctgtctctgcttggtcttgtcagtctctcactgtcttcccagttgctgtctctcatagtcgtcacctctccactgaccgctgattgccaccgtctctgctgtcccaccatctcacctgtctgctgactgccactgtctccactgacttgctgcctcttgctcattatctttttcctttcattgatcaccagatgatgggagggcaggtgagcccccaaattggggcttagccttgggaggttcttagctttgcccaggaaagaaaatccaaggatgagccagtggtgttagacagcaacttttattgaagcagcagtgtatacttaaaaaatttggtaacagagtacatctttcttttcccattatgctcttccaagatcctaataaacctgcagaggtactggtccttgtggagcagggctgtcctataggctgtatgctcagagcagcagctcagaggcagtgctgcattcagatttatacccacttttaactacatgcaaattaaggggtggactatgcagtaatttctgtatgtaaagggtggtaacttccagttcattgggtcattgctgtggaaaggggtggtaacttctgggtgttgtcatggcaatggtaaactgacatagcacactggtggccatgtcatatggaaaaccacttctgccccatccctgttttagctagtcctcaatttggtccgctgctgagccctgcctctggagtccagtcccacctcctacctcattatcttgatagtatttcagactactcaggtagagtgaattccatctgcaaatcacgcatgagccagcttgtagttatgaagttttaggggaaatatgtccccctttttcacttggtaccaagttttgagataggcaattttctttgtagtcccctgaggaaggatttggggggcagatggatttctaggggcaaggtggggtgcggtgactcatgtgtataatcccagcactttgggaggccaagacaggcgggtcacttgaggtcaggagtttgagaccagcctggccaacatggtgaaagttagtctctactaaagtaaatacaaaaattagctgggtgtagtggcggcgcctgtaatcccagctactgaggtggctgaagcatgagaattgcttgaacccaggaggcggaggttgcagtgagccgagattgcaccactgccctccagcctgggtgaccgaatgagactccatctcaaagaaaaagaaaaaaaagactaaagggacataacttgatgcatgccagttttatgcaggaaaaattttctgttagactctccatcttgggtggtcactgagttttatctccttttctcagtacttcatgaacctgtgaaaatgaacctccaagtttgtgtggcttggccaatgccattaagccaaaagtgccttctatcctttgcctagtttttggcctctgatgatttccctttttaaaaaatcactttattgacatacagaaagttgtacagcaggttctcaaatgatgtttcactcactgttgttactttataacattgatatgaaaaaatattttatttttatcattttttaaactttttatttttatagagaccgggtctctgtcacccagactgcagtgtggcggtgtgatcatagctcacttacagcctcaaactcctgggctcaaacggtcctcccacctcagcctcctgagtagctgggactacaggtgtgtaccaccttgcctggctaattagtccagataattaattttaattaaattaattttttaaattttattttttatttttgtagagaggggggtctccccgtcttgcctaggctggtcttgaacccctgggctcaagtgatccttccacctcagcctcgtaaagtatggggattacaggcgtgagccgttgcacctggccaggggaaaaaaaggttgattcaggccaggaccactgtctatatggagtttgcatgctctcctcatgtacggtaaactctcgtacccatcatttcacatcatttctctgaaagttgcaatttccaagaacctattgacaatactgaggacttacaatacatatttagtgtatacagcttgaacttggaggtaagtatagaaccatgaaaccagcgctatagtcaatgccgtaaacatatccatcatctccaaaagtttcctcctgcccaatttatttagtgataagaacacttaatataagatctaccatcttatggtttattagtatcttagaagagcataatggaaaaaaaatctaccctgttagcaaatttttaaatatacatttttcagtataatttaaaaaaaattttataataatacaatattattaactataggctctaagcacaatgttgtgcagtagatgtctaggacctactcctcttgtataaccaaaactttgcaccctttgatgaatacctccccctttctgtctctccatagcttctggtaatggccattctgctctgcttctatgagttcgaccttttttttttttttttcctttgagacagtgtctcactctgtcacccaggctggagtgcagtggcatggtctcggctcactgcaacttccacctcccaggttcatgcaattctcctgcctcagcctccccagtagctgagattacagacatgtgccaccacccctagctaatttttgcatttttagtagagatagagtttcaccatgttggccaggctggtcttgaactcctgacctcaaatgttccgcctgccttggcctcccacactgctgggattacaggcatgagccaccacacctgtccttacgttttattgtttttgttttgtgttatttttgaggggaaggtatgttcttgaagactcctttctttgtgagagctgcaacacctcacatgacctatgtaatatatagttgattgctgcagataatcttctgaactatctgccataatgctggaagtggaagtcctccagtgtgtcatctaactggtaatgctgcctaataaagctattgatatttgaatatatttttcaggtaataagcatcttacagtactcttattagttctcattgttcttcagttgcttctcaggattttgtagttaggccgatgatgattcttttctttctttctaatatttatggttcttattaattatttttgttttatgcattgtctatagtaactttgaatagtaaaggtgataatgagcattcttgtcttggttctgacttttataaagtgaaggactatgaatccgacatgctggcattcatcttatgcccatggcaaacaaacatagttaatccttcttagtaccttttcctgctaagctatggccctgtttcagaagctccccagtaacattcccataagtgactatagctgatttgatttggtacaacagataagatttatttcccagtcctctctctgatgtttcttctggatatagtttgatattggctattcatttcaaatattctttatcatgtttatattcctggtttactaaaagtcctttttaaggagaatcacaagtagatatttagttttataaaatacctttccaatatctgccagggtgatcaaatggcttttatatcctttggtttatcatatgttaattgcactaagaaattttctagtttaatcactgtggtagttctggaataaatcctactagtctctttttttttttttttttttgagggtctctctctgtttcccagactggaatgcagtagcacaatcatggctcactgcagctttgacctcctgggctcaagcaatcctcccacctcagcctcctgagtagctgggactgcaggaatgtaccaccacatctggctaattttttatttttagtagagacaaggtctcactgtgttgcccaggctgatctcaaattcctgggctcaagtgatcctcctgccttggcctcccaaaatgctgggattacgggcatgagctaccacacttggctctactagtcttaatgtatattattcttttacaatattactagacttgtgtagttcatactatgtgccagacacttgtgcttgatgctgaggatataatcatgaacaagatagacagacatggtttctgcccttactgagctgtcagtcaattcaggggtgataaagagcagaacatttgccaccactcccctcatctgaagctttggcagaaatcactcaaaacatgctgtcttgcagagtcttggaagatctcagaaaggggactgggatcctttattggcatctgctatgaattggaggaaagatgacagtgatagtaagcatcctgcttttttgctgttgctagtttgatgttttatttggtggcattttttatctgtagaacttgtgtgaggtttgttaggtattgaatttgttgtcttgaattaagtttttgctaattttgtaaatcaagtggcgtgtgggtcttttggtaggggcatctacttgaccactttttccattctttctttttctttttgagacagggtttccgtcacccaggctggagtgcagtgatgcaatcatggctcactgcagcctcagcttcctgggccgaggtgattttctcacctcagcatcctgagtagctaggactacacgccaccatgcctggctgattttttaaaaattttttgtagagatgaagtcttactatgttgcccaggctggtctagaactcctgggctcaagcaatcctgaaccttggcctccgaaaatgctgggattacagatgtgagtcactgcacctggcccaattctttctattgttattttattcagatgttccatcattttgagttgattttgatttatattttccaagacaatattcattcttattgacattttctagtttatttatatagagtttcactagtattcttttgtagttaaaacacaaattcctggctgggcgcggtggctcatgcctgtaatcccagcactttgggaggccgaagcaggtggatcacgaagtcaagagatcaagaccatcctggccaacatagtgaaaccctgtctctactaaaaatacaaaaattagctgggcgtggtggcgcatacctgtaattctagctacttgggaggctgaggcaggagaattgcttgaaccccggaggcggaggttgcagtgagccgagattgcgccactgcactccagcctggcgacagagcgagactccatctcaaaaacaaaaacaaaacaaaaaaaccccccacaaattcctatgtgcctgtttttagccacttcctcaatctgttaggggtgttgtatagtctttctcttggctaactttgccagcagtttgcttgttttgttgttgttttaaacaactcttataacagttcaattgtttttctgttttctgatttattggtttctatcagtttcattctcctatatttgttagctttatgacgttcttctttttctagccttttgaattgactgcttagttattagctagttaatttagttagctggctagttgcttttagactcatttgcctggctagtctgtctgcagcctgtcctgctgaagccatcatggtctgcacacatgccctcctccctccccagctgcctggttgaggtggtggcctctgcatctgcagtgaggccaggccgagagagatgagtgaggtcaggatggtgatgctcacctgtgtctgtttctctttccttctgggacgcatgggagactatacttctgagttgcaaaatgtgaacaactggtaagtcaggtaaaagtgacatttgtcttgcaacttttctataggtttgatatcgaaactctgggtaattctgcagcacactctgcttaagcaatcactgttgtagagatgatgggggatgtggggtgtagaaatttcctgatgaacacatgcataccagagttatcagggagtagaaactaatagtgacaagtccatttggaaaagggagcgagagagacagatagagacagacggagttgagcagatgtgcagagagaagcacctggccccagggtgagagtgaaaatagctgcctcagctcctgttcactttcacgttctcaattcccgtttcacgaggcctagctatatggcagtctgtacagtatacagttccttccttggatactcaggaaatctatccattcttaagatatcctctcttccttccactcttggctttcttcttttacttggaccagccaaggtaggcaattgtttcttagagcagctcccactagaacatttgttagtaatgatattgatagtttatttattattgtgctttattgtaccgtttaagttaatccttacactattagcattttcattttatagaggagggaaaaagagatacagagaggtttgctaacttgcccaaggttgtacagctcataagtgatggagccaggatcaagcctatatatatatatatattttttttttttttttttttaattttttgagacagaatctctctctgtcgcccaggctggagtgcagtggtgcgatctcagctcactacaagctccacctccctggttcacgccattctcctgcctcagcctccccagtaactgggactacaggcgcctgccaccacgcccagctaattttttatatttttagtagagacggagtttcaccgtgttagccaggacggtcttgatctgaccttgtgatccacctgcctcggcttcccaaagtgctgggattacaggtgtgagccaccacacccagcaggatcaagtctatattcttaatcatgaggccagtatgtgtttgaggctaaaagttgcctctgaattcatctttgattgaattctcatttatttataaataattgtgtataactggaattttttctttgccccaagggttaaggtgtttttgttttttttttaattttaatttttatttctttaagagacagggtctcactgtgttgcctgggctggagtgcagtggctattcacagatgtgatcatagcgccgccctacagcttcaaatttctgggctcaagccatcctcccgcctcagcttcccaagcagctgggattacaggaatgcaccaccacgcccagctcaagggagtatttttaaatgtctaagtgttaggttggttgtttgtttagcctattttaaaattttaaaattgtgtttgtgtgaggaaatgtggtttattgtgcttcttggaatttttgagatttttcttcatggcctattataagatcagttgtttttgtttagatcttcattgtggtatttattttattctgcctttctctgtacctctgtctcttctttaaagtggttcgatcactgaggtcaggcattgtctgtattgatctataaggcaactgcctagtagaaatatttaataagtaggctgaataaatgaatattgatccttgtggatttgaggagtgttatatacataaaaaatccaggccaggtgcggtggctcacgcctgtaattccagcactttgggaggctgaggagggtggatcgctttaacccaggagttcaagaccagcttggacatggtgaaaccctatctctataaaaaaaaaaaaatacaaaaattagccgggtgtggtggcatgcacctgtagtcccagctactctggaggctgaggtgggaggatcacttgagcccaggaagcgaaggttgtagtgagctgagattatgccactgcactccagcttaggtgacagagtgagaccctatctcaaaaaaagaaaaaaaccaaaaaggtagaaaaaggtagaatagagaccaggccatttcctttccttcgatccctccaaataccatgattccttgtcatttctacttggattccctccaccacacctctttggacctcaaaagcatagatttcaattgtcataatctttggtttggcacattctcatcattagttcatactttgttataatgtatgcattataagcatttttttttttttgatacagagtcatgctctgtcacccaggctggagtgcagtggcatgatctcggctcactgcaacctctgcctcctggttcaagtgattcttctgcctcagcctcccaagtagctgggattacaggtgtgtgccaccacacctggctaatttttgtatgtttagtagagatggggttttgccatattggccaggctggtctcgaattcctgacctcaagtaatctgcccaccttggcctccccaggtgttgggattacaggcatgagacactgcacctggcccattataagcatttttgaaaacatcatcccaaacaaaaactgaaactttgacaataacatacatctaactatgtggttccccctttcccaccccttttgtttctcaccatctgaggtgagcatttgaaacccatttttatcattcccttgctttcctttttatgcagttttatgcatctgcatgtatttttcaaactaaaaaaggttttgtgttgcatgtaatcttttggagtttattcaattcttgtttcaattttggtggactgttgatttcaggaattttttcaaaggtcctgtgattttcttttattcatccttgcagaggggatttatgcttgcctagggttgacatacaatcaaatgattgatttgggatctgtatgaaattttatagcagttcctggtcagaatcaaaggcagaacagaaggctataggctgccattgtggggacccagcaggctgtgtggactgagtggggcgctgtctccagttaaacattttctctccactgccacatccaacactggccactgggtgtggcagctcccatcagagcaagttgtggtcatgtttctgtgatgtctgtccctggaaggaggcacagaggcagcaagcattcctgtggtgcctcagctggccccgtcactcctttctcagattagaacacccttcagggatctagaaatattctttattcagatggaaacaatcatagtaacaggccattctaccaattggatagagctgtttcttcataagccataaacctaagactaatcctaatctgtttcctaacttgtgttttaacgcatacccggattctaactgccatggtcttttctgcagaatgtgttctagtccctacatcctaatttataccccaacttccattcaaacctttccctttttcaatttcatgaacctttcccctgaacctctaacatctgtgactgctcccagctcctttccttcctcccattcctgccaaatgctagccgtgaattgctgtttagttagcacttaccgtaagctagacgctggggtcattgctcattgtgtatcatctcagctagctgatatcctactctatgagatggtaacattagtttttccattttacagatgagaaaactgaggctcaatgagatgaatttggacaaagtctatatctctggtgaagctaggatttgatctagtggtgtttttttgttttgttttgtttttgagacggagtctcactctgttgcccaagctggagtgcaatgtgcgatctcagctcactgcaagctccacctcctgggttcatgtgattctcctgcctcaacctcctgagtagctgggactacaggtgcccaccaccacgcttggctaatttttgtatttttagtagagacaggatttcactatgttggccaggctggtctcgaactcatgaccttgtgatcctcctgcctcggcctcccaaagtgctgggattaagggtgtgagccaccgtgcctggctgttttgttttttaaagttatgatgcctttggctgtaagtgaaagaaaacttaaagtggccttaataatgaaatttactatttgacataaaaaggctgattaattccatggctctacattaccctcaggaccctggcctttctcctctaccatccatccttgatgtgtccaggacttgtcttcaggttagctttccacaaggcttccacatgcctgccagcattccagcctcacatcccccaaaagtctaggggcaggaatggacatcgtttcgtcttgcgcatctctgtctctctcacttgctctaatttgatgtgaatcttttctttaagagcaaagaaacttttcccaggaccctcccctgccccagcagatttcccctcatattatccagaatgctggaagcccgtgcctaagcggtcatggggaaggagcatgggaccacgcttagactaatccagctcattcctccaggctggctctccaagcctccctgatgcagtttctggctcctcggaagaaaggagatgggggtcaggaataggtataagctgtgatagtgtctgtcacagaatcccaagtctggttgttaagcttgacacactgctgctattctgggcttgcccctcggctcccatcctcactctaacatatttcctcagctgtgaggtaagtccccacaactctaaatgacacattctaaggctgtccttggcagaacagtgaggaacatgaaatgtgtgccttggagcccagtgctcttatgtaattcccctgggatgtcagtgccgtccttggtcagcgcaggcatggtcactggaggtggggagaagagcagagctctgcctcagaaacgtgggccctgagccctcagcctggccctgacccagccccagaactttttgttttgttttgttttttgaggtggggtctggctgtgttgcccagtttggactgaaactcccggacccaagtgatcctcccacctcagcctcctcagtacgttgatgtgagcgtggctgcacccggcccagagttgggttttaaacatgtttccccgtcctctgagatctcatcttcctggtctgtgctttttcttctcttagaatccgaattttttattttattttatttttttaacaaattctaacttgctccctagtgttaccgcccacacctacaacaactttatcctgtttccttccctcaacccccacagcttttctggctcccatggagtgcacactcggccactgtggccggagcctggcagagcctggctcatttgttgaatggatgactctgattatagcaggtattcagtaagccactcttgttaaattattgaaaataaacgatgttactccctagaggtgtctaggttcctttttttcccccatcacctgtcctctttcacctcccctctgggccctggcttccctcaaagatcctttctccaggtcccccatctcctttgatgaagactcatgaggaacacagtgtccacctctcaggcaggcgctcaggaaggaagtcgctgagacagagctcagtggcccgaatggtttctgctccctcacctcccacgtcccacctcccacgtcccacctcagggcttccttcggttcgggccctgccccacgagcaggaccacctttgtcctggacagacagacctgctagcctctgctctacagttctgccggccttcgccctggctgtcctcacacgagtgccccctcccttctctcctcccttagccccgcctccttcctctagccccacagccctggacacggtacacacagaccagagccttggctcaaaggcaaacaaaaggaaatgcccggctccccatggctgtggccagcaccttcataccagggctcaaccctcagaaccctcattatatcccagggtaagactcccacttagcgctccccgcttgctgctgggagtaggggtatagggtggaggaattaagctgcttagagcatggggccaagcggacaggttggtttgggaggctgaggtctctatggtggtggatggaaaaggagaagcaagggactagtgagacaccgggtctgccccaaagctttgtgttgttctctccatgggaacagggtaacagcagaggaaggatcgaaagcccaggcagagaacttagaaatgcctgctccaaatatatacactgctgagtccagaaagatcagggcttcagaggtctccgcttctgcctctggggatggcggggcagggcgattctggtgagtgggagagtctgtgctgcaggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggtttgtacgcaggtatgcacaggtgcccctcccaggagcatgtgttccaaacactaacgagtcttccttgtccctgcctgcccaggttttgtaccccgggcacagttcatctttgccaagaactgcagccaggtctgggccgaggctctgagtgactttactcacttgcatgaaaagcaagggagtgaagagctaccaaaggaggccaagggaagaaaggacacagagaaggaccaggtgccagagccggaggggcagctggaggagccgacactggaggtggtggaacaagtgagaccaagaagctggtggggagtgcagaggtgtgggagtgggggtcttactgtgtgtccgggcagtgggggcagcatgagtagtgtggctgtgggttcaggggatgtgcacttgattgtcagctccacctccttgggagattgtgtgacagcacaggggcttctctcacaggcttctccctactccatggatgacagggaccctcggaagttcttcatgtcaggtgagagctggggggtcaggatcagaggcgtggggaggccccaggatgccttggctcagtgtccccatcctcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccaggtgagaagagcccccggggaggctttggggactggaatgtttgtttgtatgggtatggggtgggttgggtggtttgtgggggttgaaactaatagatatgggagggctcagatcatgtggttcagctttattatcaggcagaaaaggaaaccgaggtagctacccacagtggggaattagggccagattttagagggctgtttggaggtctagccaactggctgagaattaaatggctttgccatgccacttgctacatgtgacagactctcttggccacacagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttattaataggtataataaataaataaataaatacataaacagacgcctgggctcctcctccctcttctgatgaccaggcactggccacagcctatttacagctggggggcttagggatctggccccaatactgttacccatcctcatctccacctggcctagggaaccctgtagatggctttctgggccacccgcctccagggggacttgcttgtcttcacccatggaagggttggcccagacgggccaggggaatcctggcagcccagtgctgtgtcccatccctctcctgggtggaggtctggacaaggtcactgggacagttaagggggcgtaattaatactgagcacagggagcaggtgccagcacagggatacgtggccccagctctcagtctactctgcagccaagccaatggcttgggaagggctctcgggctctgagtctgggggttatgagggtccctgaggccaccagcatgcacagggcctcagttttggctgcttccaggggttggacttggagttggggtcaatgtcacgtaggccaggggcaccaggccagagtcggggccacggctgcagcgcagccagtctcctccagctcgccccagcactcgtaggatgtctcctttgtggaagctcagctgtccagggccggtggccaggtggtggcacagtgcctgcacctcactggggaaacagcacatggaggtcagagaaaccccctcaaaagccccccgcccccctcagcccttccgtttccccaggcttaccacggaggactggagggcagggctggggagtgtggctcctgcaggctctccttgggctctggctcccggcgggaacccactgtctgcgccactagttggaacatggacttgtccaggctcagccagtccgaggggagcctagggacagcagctggactcaggctctgcccaggatgggctctgcccgtgccctggcttacagcaggctccctactccctccatccctaccatgggcaggctctcacctatttgtgggccgggcctcccgctgggcttttcgggagccaaagaggtgtccccacttgatgcctccaggtgaaggctctgaggccccttcctcattttctgctggcgaggcagcgggcccttccctctcccgactgcgcctcagctcggccagcacagagtcaggggggctccccatccagaagggccagcccctttcccggcccagggcctcctcagaggcagggcaggcctcagccccctccactactccctctcggggtggtggagcctggggaggtcccccacctcctgcccctttctttttctcgctgctgctgttgctgctaccacgagggaacctggaaccctcaatggagccatcgatgtagacctgggagctctgcatgagctggtaccaccagccggcctgcccacctcgggcccacctggcacgccctgagcccccggctgcctctgccacctcttctgtctcctcttcttcctcttcctcttctccaccttctgaggcacccacacccttcacccgctccccttgggctgccctgtccacgtctccagggccctcctggccccgggcccgggccagctgcagcgtggagtgggcagacagcagcaggtcctgggacacccgcagcagttccttgtgctgccgctgctgctgcccactttgcagcagccggtgctggaacagcaagtcgaggctgaagggcagcagggccaggggctgtagcagcagcagcagctcttcaaagaggccgggacacacggtatgagctgcactcaggaagccccagggctggtagtgggtctggatgatgtctaggggaaaagagagagggactgatccacacagagaaccagagcctggcccaagtgggactttgaaagacagtctgggcagagctgctgcagacagcggtgcaggctgtgcactagtcaacttgcatgtactaagtataaacgctgctgcccacagctgtgcagtgcctaaactctccaaccccaggcggtggccctgagtttagaggagtgagatgcagggattcctggccaccctaactcccagattgctagagtatcctgctggctccaaggttttttgttttgttttttgagactgagtctcactctgttgcccaagctggagtgcagtggcatgatctcggctcactgcaacctctgcctctcaggttcaagcaattctcgtgcctcagcctcccgagtagctgggactacaggcatgcgccaccacagccggctaatttttgaatttttagtagagacggggtttcaccatgttgcccaggctagtctcaaactcttgacctcaggtgacccacgtgcctcggcctcccaaagtgctgggattacaggcatgagccaccatgcctggcccaaggttttaactcaagcagaggctggggaaggccttgggtggaagcctgaggctctgaggatgaacgcttgtgtggtccccctccccacctccagcaatgaaaagacagctcttccttcctcttttgtgcctctgaattctgacccattgagtttgacctgcagggttctaggcattaccttcgtggttatagaggtgattaaaccagaactccagggaccggatgctgtagggagacaggtgaagagagttgagtcttgtgtgaatacagccagataaggagacagatccagggggtcaggcacaggaagaataggtgaacacgcccttccatggcacgattcatttcacctaattccagaaagtcagtggggatgtgtggagggagatggacatgtgatttacaagccaattgtttcctcctggagtggagtcagcctgcagtagacctaagaaatcaaggcagctactgtgtgaaagtacaggcagctcagggccaaagggaatggcctgggcccatacctgagaaagcatgttactaggatgtgggtcccaaggtggacttagggtcaagcaggatttggaagtagtgctggaatggagaggatcagggtttacaaggtccagagaaattaagaaacccaactaatttccaaataagccagattacagatttgtaaaagcagaccacgttggtgaccagtgacagagtcatgggcacagtggggaggcagtgacctactgagaggccatagcgggctgaggggaccctccagatccaccctttctgtctgtccagggcgttgtttccttggtgcaggcagagcccgggggtggggggcagggcaagttgtttaggggatcttgctgctctgtgcactcacttgagcaggccgaggatgaaggcgttgaagcgcatggtatgactggtgagctctgggaattggctgactttgttgtagaggccatgcaggaccttggtggatgggcctgggaggaagccagggttgcaggtcacatgaccaatttctggagccctaaattcagccctgggtccccgtcttggcacccagcacctacctagctgtgtggaagcctcaaccacactccatggcatgttcttacgctgcccgatgatgacgtccagtacaaaggccttgagcccatcctccagcacggcgcggacggcagggcacaagtacttcagaaccaggtggcccacattggggctcacagaactgtttcccagctttgcctgtaggtgtggtagggaagtgcaggaaaccccctcaggcctgactgtggtcctctcgtagcaggccctcatggttcccctcttgccgtccccattcctaagtacccaaccctgggctctaaatgcaagacagcaagggaaggtggtagcgcgggacaggtgagggcttgcaggcagagctcagctctccacatttccttgcctaccttcaccccgggatcccggcttgtgccaaaatgagccacaatgaggtccacagcgatgttaacagcttttaccagccctgcagggaagaatgtgatgtgacaggtccctgagcaagtccttaaccaactcagctggggctgaaacctcaggtttcctcagggaaagggctcccacacttactccgtctccacatctgcacatgggtcttatcaaaacattcaggcctggcccttttctggttctgcccagttcttaagctcttcctgtctttacttcccagcctggagctacctcagtgatgccactgtcaagcctctcaatgtccttacctctcagcccttattccaatcctgggtcaggccaactatcggttttctccactctgagaaaccgggccactgacctgaagaaaacccaagtccctcaccccagtgccagtgccagacaagggcggttctttgacacatggcttgtcagcactctctgccataccctcaagttgccatgtgaaatcgacacccctcctctcaagcccttggttctgcttcagagaacagagttccctagttataaactcctttaacttccctctacctccaaaatccataacaatctcatatgtacacccctcactcccctgcccacttgcatccccttcgcgtcctggaggaaggtggccgtttcccttcttgcccgggttctttctccctgagctctgattctccccttctgcctttgcaaggaacttcagctctctcttcacaggctcatcttcagcccacaattatgctcagttctctccatctccctaaaaatgttcttagttcagtggtcacttatttgctaaatagtgtgggtcttgtcaatcttcatcttactagatgtcaccaacactcttacccaagctgctgggccctctagtaccttcacccgccccctccaagagcactgaggcattttttgatgacatggaagcctcctcatgagactttgctcactgcaggaagggaccggagcgtgactctgaaagcctctgatgaatgacccttgctcactcacatgcactcatgatacacagcacacagcttcctcctctggccccagagcctgtgtgctccaacaccttcccagcacctggagatttgtttgtggttttcttttgaaaaggagttttcagttttgttgcccaggctggagtgcaatggtgtgatcttggctcactgcaacctccacctcctgggttcaagtaattctcctgcctcagcctcccgagtagctgggattacacgcgcccaccacaacacccagctaatttttttttgtgtttttagtagagatggggtttcaccatgttggccaggctggcctcgaactcctgacctcatgatccacctgccttggcctcccaaagtgctgggattacaggcgtgagccactgggcccagccagcacttagaggtttcagactggctaggtagtagggcaagtgtgaggaggtagtgacagcagagtccctggcctgagctgggggttgtatgcaccttttttctgaagcaggtcaatggaaatggcctctgagctgccatctggggacagacaaaactcagctggaggcttctccgtcaaggaaaaggggtcctggaagtcagggcaggtcagtggtaacggcttcactgcttggcctggaaagaagagaaaaatcaatcctgagcaactctcagtgcaggagttccaggccagttcagtgcctcgtaccgtctgagacacgttcctttgggactgaccccttctctagccctttccagccatggcagagcctgccccgggtgtactggggaccctgctcacacaccattcagccggcagttcagatggctggcagcactgagggagccagggaactcaaagatagggtttcttcgggccagccgagcttcttgtgatcttcggtctaggctccctgacaaaccaggtggccctagtgggttcttcctcctgtattcccgccacttgagggcttgaggggataggtggttggctggaagcagaacagattagcagaaagacaagagttggcaggagacagcgagacagagtttcacatccacccagtgggcccatatgaaacactagattatctgtggatattatctacagatgctgagggagggatgcagacatcctaacctctggccccaggtgagagtgtaagcaaccactcaaaggggaggtggtggaagtgcttgcgtgaggtggcgggttgggtagggagatgctggagctcgtaccattactgggcctggtggccatgctgccctcaccacctccccgggccaggctctctgctcggctgaggccagatcgccaggagcccagaggcggcaagcttcctgttccatggagccggtactcagtcaaggtcagtatcttctgatcctccttctgcggctgctgggaggtggcaggccggacagcagaaggacaggagtggctccatgggggcaggctttctgtggctgtgggctgctctgggggaggggagcacgaagtggaggcagaagagtcagtgctgggcccaaaggggccaacactccggatgggggagtagctgcccaggggcgatggccgagaggtctctggctcagacccagctttcctggcacctctgccagtggctcggggagtggatgcctgcggttcccctgagggagctgggactgagacttgagcagcaggggcagccagtggggcaggctgctgtgtacggctgcagcctgagaggctgtagagctgggaaaggctgtggagggcccgggccttggccagctgcttggggaagtggtgctggaacacgaagggctggatgggcagtgtggttggcctctgttccttgctgtagcgaaggactggtcggctctcggtgccaccccctgtagcaaagggatggagaagaaatcagtagacagacactgaaacccatatgagagaaaacccagaagcagagatgggagaggggagaggggcagggacctggctggcaggaattgaatggggtagaagttcgtggaatgggacactgctcccctcttttgtaaaacgcttcctattgcttttatggtgctggactgtcttgtacctctctgctgttcagtccctcttcattttcttgactccaaaggtgagtgtatcttaaggctcaactcttgcatctcaccttacactttatttcttgagaagttttgagttcagacttctacgggatgactcccaaacccacagctttagcctggaccttcctcttcatctccagatcattctgctttatagttctgctttcacttaaaatgtgctataaccgcttatccatcacctttctccttttttccgatgacttccatttctatcaatggcagaaccattttctttgtttctaagtcttggagtcacagtcacacacattttcagtgatgaaaatgtttcagatgttactgacttcaagcttttgctcattatcccatctccaatcatgccagcacatttcattcctgagcatatcgaaccatagtaagatatttctttacttgcagcctacctgttatctgtatctacccccactcccactcttttcacgatcctggcattggaacctcagagtccacatttgctccccctgaacggaggtatgttccccaaggctgggcctctcctgttctttcaggcagtcttcaggtcaatgtccttcaaaacgtggtgctcagaactaaacacaaaactccaggacactggagtgggacagtggatggactgcacttccaacaaaacactgtagatctccgaataaacgtaagatggcgctataagcacgcacccggcctaaagccctggtgaaagctcaccagcagtggggctcagtagctctgcgaggcgggaattagttctcttacttgacatattaggaaatgtgaaatgtagacagattaaagcacttgctcaaggtcaaacaactaggaagtggcagagctagaattctgcctaacccagagtctgatttcagagccactgttctttttaccacattgtactacatgtgaaattgtatcaggccaggttttcctatccctcatcttatttacatcaaagagtcagaggggatggggaccacaatcccattagggaggtgcttctgaatcactcccaggggacactttcaagctccaccctcctgctatacccagtcactgcttacacagactctgcattctccctggcccactgtgctccagccacacttccccgtccttaaacacaccagatgcatgaacatctccgggccttttgcacctgcttttctttctgtctgaatcttctcaccattcaggcatcagctcaaatatcaccccctcaataagaccttctctgactacgtcagcccctctggcaagttgctctctatcccattaccctgtttcattttcttttcagcattgttgaactttccagcaattaaaagttgtccttttaatgtgtttattgtccattactgctcctaagagctccagaaaagtggggattttatattgttcactgctggatccataatgcctggaacagaggctggcacacagtatggagtgaaaaaccatctgttaaatgagggaatctccacggtcactcttgattcaagccagtctcactacaaccagaagcttcttacatacaccaactagcttctgagatacaaattttatctcccagaataaagtctaatcttctcagtgagctagttgcccacacctgctacgagctaggctgctctcccttcagacttccacacctgcccccactgaccctactcttcccagtccatccctgtcatgaagcccactgcttttcccatcaggaatgtgtccttcctttccgcctatttaagtatcagttttcaaggctgagctgactctggctatcggattaggtcatcccaaccacagcattattataccccctatacaaagtatgtctgaattagactgcttattcctacccttttaaaactcctctctgctaagttcccaggatacagactgaggcagaggaataagatcaggtaagaagggggcccctgtggggaatgggtcttagttctaccctcagggaatacacagaataagttttctcacttttctatgtgacattcattaagaaaaccagagacagagaccgtattcacccgagtcagtttttctctaggttaaatagccccagtcccccagttcctcagttccttcttaagatgtggtacccagaactcaatggaataccactgagcactcactggttcggaggagtgagagactatccactctttctttctggagtctatgaatgaatccagtcatcttaactttttggaagctctaccaactgctgactcaatctgagtttgcaatcaaatatcccaaatcaactcaagtgcaggttacatatcaaacttcacattggtctctgctttattagttttgttctttcaagattcagtaagatccctttaaatcttgattctgctgctcagtatctcaaagagccgtctcagctgccttttttatttttattttttaatttacttttttctgagacagagtctcactttgtcacccatgctggagtgcagtggcgtgatctcagcttactgcaacttccgccttccaggttcaagcgattattgtgcctcagcctcccgggtagatgggactacaggcgtgcgccaccatgcctagctaatttttgtatttttagtagagatggggtttctccatgttggccaggctggtctcgaactcctggcctcaaatgatttccccacctcagcctcccaaagtgctgggattacaggcatgagccaccacacctggcctactttaattttttttagagacaggatctcactttttgcccaggctgggatgcagtggtgcaatcatagctcactgtgcctcaaactcctgggctcaggcgatcctcctgcctcagcctcccgagtagctaggactacaggcatgtgccatcactcccagctgtttttaaatttttttttctgtagacacagggtctcactatattgcccaggctggtctcaaacccctggcttcaagtgatcctcctgcctcagcctcccaaagtgctgggattataggtgtgagccaccatgcccagccgaccttctcagcttcctatactgtcattcctagattggatcaacctgtcccttcttttgtcattcaaagcttgatgaattgtcattcatttttgatttagaaaaaagctgtacagaatcaagagaagactggagacttatggaacagagcagcatgttgatatgtcttaatctgatagagaaaacacatctctgaccaggatatttcttgccctcagaatgccagtcatagtatcccacgagatgcacccagcagacagacactgcagtctaagggagtgggttcaaaggacccagtcaatccttgctgtttctgatcctgccccttccctagagatctccctcccatgcccaccccaaggacagctcttcagtgtatgttaggaacatgaagtcttctgatggactgtgatctccctgacagcacagatattatttatggttttaaaacattttcttttgtgaagccaacagacccaacctaaggctacagcacagctgtgagcctctgctatccctgctttacctccctttccttctaaaccctctgagatctggcttccactctcactactcctgaatgttgccttcaggattcttcattatcttaggtgatttctctttagaactcttttggttcaaactttttttaaactttctcctcctttggttcctgtgacttcactctctcctggtttttctttttttttgagacggactctcactttgtcacccagactggagtgcagtggcataatcttggctcactgcaacctctgcctcccaggttcaagcgattctcctgcctcagcctcccatgtagctggaactacaggcacccgccaccacacctaatttttgtatttttagtagagatggggtttcaccatgttggtcaggctggtgaactcctgacctcaggtgacccgcgcacctcggcctcccgaagtgctaggattacaggcatgagccaccatgcccggcctctcctggtttttcttctattgtcctaattcttctgtctcttttgagggtgctgctcatcccttaagtcacagtatccccttcttccctttataactcaacacattctccctggatcctctctcagccacacacatagcttcagctaccacttttgttttttatttttgagacagagtctcactctgtttcccaagctggagtgcagtggcatgatctaggctcactgcaacctctgtctcctgggttcaagcgattctcctgcctcggccttccatgtcgctgggattacaggcgtgcaccaccacacccggctaatttttgtatttttagtagagatggggtttcaccatgttggccaggctggtcttgaactcccgaactcaggtgatctgcctgcctcagtctcctaaagtgctgggactataggtatgagtcaccacgcccagcaagtgccagctaccacttttattccaatgactttccaatctacacagtgctttctcctgacttcaggaagacaccccttccagtccatcttctacccaaacaaccagtgatccaattactttttttttttttttgaggtggagtttcgctcttgttgcccaggctggagtgcagtggcgtgatctcggctcactgcaatctccatcccagattcaagtgattctcctgcctcagcctccagagtagctgggattacaggcatgcgccaccatgcctagctaatttttgtattattagtagagatggggttttaccatgttggccaggctggtcttgaaaacctgacctgaggtgatccgcccgccttggcctcccaaagtgctgggattacaggtgtaagccactgtgcccagcccaattactttttttttaaacaaggcctgaaggaacaaccaaccagtgatctttctaaatgcaaatcaaaacatataattaagcagacagaaaaaccaaaccaaacaaaaacaaacaaatgccaaaagccatttctctaaaatttttcagtggttccacctgtgttccactatggcttcaccaaattatatgcagttcctagaaagggtcaagctattctgtgcctttgtggttttgtacagacaatcctgtgagcctagaacattcttcttacaagtcgtcacaaagcccaatcctaatcatctttctagattgggcttaaatgtaactgcattagcagttcctccctgacgtttcagtctgatttacatacccctttcactggccagtacggaacactgccatctctgcattttaatgatcaactacgttttctgtttctgtccttagctggaatccttgaaaacagagtcatccctctcatctctctgtcactagcaccaccttaacacactggtataaaatatttatttaaaatgtaacaaaataaatagggaaagagctggcctagggaggccactgcactccagcctgggcgaaagagcaagactccgtctcaaaaagaaaaaaaaaaaaacttcactgacgcccagtgtgtgtgtgttgttgttgttagacatatcccttggttgccccttaggcactgcaaactcctaaaggtctgaacctgaacttttcttccaggaaatctcctgtgattacagcccctatccatggcctcatctttcccatcatccaggttcagaatcagtcttctgaatccttcatttcccaatatgtcagcctctaagtcctgctgattttatctcctcagtgtatttatttattttttttttttgagacagaatctcactctgtctgcccaggctggagtgcagtggtatgatctcagctcagtgcaacctccacctcctgggttcaagcaattctcctgcctcagccccctgagtagctgggattacaggtgggtgctaccactcctggctagtttattttttattttagtagagctggggtttcattatgttggccaggctggtctcaaactcctgacctcaagtgattcgcctggcttggcctcccaaagggctgggatcacaggtgtgagtcactgcacccagtctgctcagtgtatttttgagtcctctgtctttctccagtgagcctattccactgtagctgtgggtcctgccctggcctagaaggataacagatctaggatgtggaacctctagtggtatggatggggtggtctggcagggacctgtcagggaggtggccatgcatatcctgctggtgaatagccacatatttgctaacccttaggctccttaccgtcagctctagctcttgcatccctctgggtatggctgttggctgggctccctgggagagcaggccctggatccatcagctgagccagggggccttgcccagtagctctgaggccagcaggaggcatctcactggagtggggtccctgacagacctgggtggaccagggtggacttgggtctgggccaagtaggtccatgcctggccccaaaggcatgggtggcaggctatggctacagcaagtgccctcatccagtggggccccccgatcttgctgggcttcttggatgggtgagaactcctgggaggagtccccaacactcacacgaagtgggggcgagccagagcctccagttttcttccggcccttggccagctcggcaaaggaggtgaccctcctgggtggggagccaggcccggccatggctgcagggccctcactcaagcgcactgggcaactcaacatacgttccagcgagcccaggcggacaggagggctgcgctgcaggctgcgatcatagctgcgggagcgctgacgtccagtgctgaggttggggggtgaagtattcgtgtatacttgtccctcaagcacagtggggcccacagcagctgctgcttgggtggaggaactcactgcttcttgttcctctggctggacttctggcttctggaataggtaatactcagagggctggctggggcctgggtctgggccagggcctggtgggggacttatcttggtgtgttcctcagagcagctagtgatggaagagccagcagggcttggggatgattgggaagataggtcacaggtgacaagtttatagtaattttgtgtggccacaacaagacgggcctggctttggaagcaggctgtgaggtcagccactgctgggcacggctcacagtgtgggcggtaggagttgcagttggcatcaagctcaggagaagaggcatgagggcaaccatagcccccttcccttcctccactttcagggtgatgggactcataagacatcttagactcaaatggggagggctgcagatccagatagaaggcgccagggtctgagtggctgcagaaggaagagtcgctgcaggactgtggggcagagttgagattggcacggggggtgccatgcatcttgttgtagagggtgctgaaggtgaccagcacaccatctgaactgttgcaggaggagtcgctcacatagcccatggactggtcagctgcctcggactgactggatgtgctactgcagcggcagtgctggtcccctgagccggagcatccagggttccttggggattcatctgaactgagcttccattcctggtcaaaggaaaagccagaggtatcgctggctccacccccactgccactcccaccaggtcccccacactcatccagctccatagtctctgcttccagctctggccggcagcagtggctggtgccgcactgctgagtatccaaggtcatcactggctcctgttcctgcccttccaccactccagcccgactgcgtgttgtcccccatggcctgcccactctggggccagatggtggcagctggaaagaggatagatgaaagttgggctggccagtgccatgcaggtggaaggactgctgggtggcactgtcaccaatgctgtcatcatacaggtcaccaagtcctggctcacccacaccctcctgcagcaagaaggggttgtgtcgtttgggggctccagggcctcttccatcccgactcctactcttggtgctgtctatagaccgtgcagttcctcctggagtagagtgcaggctgctgaatagcagggagtcagcttgtcctaggtcttgatcgggctgggtgatgcccagctcaggtgggcagaagggattaggtcttgtgctcccaccacctccacctgcccctccacagcactgcctgtctgggacttggcagtgcaccagggggatgtgatgaacgatgagggtctctccagtcagctttgggggactatccattctggaaagttcgaataagggcttcaacagcaccagacactgtccctggagcccagtggggcagaacacatttcatcaggagagcttggcacctggagagagagggaaagaaagggaacctaatgtcacctccctggaagtcaggggcatgcccttccctacatcattttcagatggagaagagcccaggaagagaaaaggcttgagtcaagatggagcttgaccacacagcccaataggcaggtggggacgtaaccatgctttctgcattgcacaggtgcagcacctgaggtcccccttaattttaaggtcactatgcatcaaattatgacaaaaggccaagtccttctaatgccacatatgaaggtttgggcagtactttccctttctctttcaaggaccctctccttggcagtaaacaatgaccagtccttagcacaaaaaaactatgaataatgacacaattaagaaaaaaccatctaggatgtttaaggcttagacacagctatagcacacaagtttacagccaagagggaaaatcatgaataatatgaactcatagcaataagctataattttgcaagaagcattttaaaatatacggtatcatctgaccaagtgactgttatctctgatcccctttctcgtcctacaagccccagaatatttgtccctttctgatgaccgtgggctaagtatccttactatcctcactactatactagaacttcttgaatgcagacactgagttgggcattagggtgactgcaagtatgactgatgtcaacctcttcctcctcaatgggggtggggggacctagttttatgtcttttgtatcattctaacacatcacacaagataaacgtgaaaggcataatacattcttaacatgcgtctagctcaggatacagacatcctgaagtgcccaaatgctgcccagttttagcttagaaccttcactactgggatccactagaaagtcttctcttcccagttttacctcttataggctaaagcaaagttctctcttgttcaaggtctcctggtgccaaggacacagaacccatcctgagcttctctggtctcttggctgcaccgtggcagtgtggcctgctcaagttctagtctcctgtgtttccacgttcaggtcgcaacagtcttcattcccttcgactcctcacatgtaatgttccaaaattcattcatttcctttctctttttattcctatcatttccttttcactcaccctgagtctaaatccctcattgcctttctcttattcatcatttaactgaatccttgacacaatcaatttcttaaaatttaactcatgtagaccatagggtcatagctcgtcatgtggaatgtggtaaagtctgaggcaagtcacatatgctcaaggacatgaacaaacaatgcataaaaaatatggctaataagtatacgtataagggacaaggtattaaaatataattgtgttaaatttaagcagcaattatttacaatcttgcttcctcctcccctttctgagaggaaggcaggctcctctgttgaacttccaagcctttgtgtgtttaatgggctaatgggtagagatgtagaagggcagatattaagagagtctgagctacaagattaagggttacagaagaaaacataggagtaaatctttgttatcttggattaggtgatggtttcttagatatgacaccaaaggcacaagtgacaaaagaaaaaacataaattggactccataagaaccaaaaacttttgtgcttcaaaggataccaccaagaaagtgaaaagacaatccataaaatgggagaaaatatttgcaaatcatatacctgataaaagacttctaatcagaatatataaagaactcttacaactcaacaataaaaagacatacgaggctgggcacagtggctcacgcccgtaatcctaacactttgggaggccgaggtgggagaatcatgaggtcaggagacagagaccatcctggccgacatggtgaaatcccatctctactaaaaatataaaaattagctgggcgtggtagtgcatgcctgtaatcccagctacttgggaggctgaggcaggagaatcgcttgaactagagagtcagaggttgcagtgagctgagatcatgccacagcactccagcctggtgacagagtgagactctgtctcaaaaaaaaaaaaaaaaaaagacatatgatccagtttaagacagggcaaacagtatgaataggcatttctctgaagaagacatacaagtgtctaaccagcacatgaaaagatgttcaacatcattagtcattagagtaataaaaatcacaatgagatactacttcactccagctgggagggataaaataagaaatacagacaataacaactagcaaatgttgatgatgatatgaagaaactggaaccctgaaacattgccgggagtattgtaaaatggtgcagctactttggaaaagtctgacagtttatcaaaatgttaaacatagtgtcatcacatgacccagcaactgcactcctgggtatatacccaagaaaaatgaaaacatatgttcacactaaagcttgtacacaaatgttcataacagcattattcacagtagccaaaaaattgggcacaatcgaagccagtcacaaagggcttttgtgatgttgtatgattccatttatatgaaatgtccagaataggcaaatccatagaaatagaatgtcctgaaatcaggccaggcgtggtggctcatgcctgtaatcccagcactttgggaggctgaggcgggcggatcatttgaggtcaagagttcaagaccagcctggccaacatggtgaagccctgtctctactaaaaatacaaaaattagccaggtgtttgtcaccatttttgtaaataaacatgtctgtatgcatagaagaaaatctgtaacatgcaacaaactgttaccagtgcctatcactgttgaatgatttggattatttttaattttattctttttgcttcagctgtattttctaatttgtatgtaataaatacccattttatgcataatttaagcaatttttttcttttttttgagacaggttctcactctatcaccgaggctggagtgcagtggtgcgatcatggctcactgcagcctcagcctcttggactcaagtgatccacctcagcctcctgagtagctaggaccacaggtgtgtgccaccacgcctggctaatttctgtattttttgtagagacatggtttctccatgttgccaaggctggtcttgaactcttgggctcaagttatccacctgccttggccttccaaagtgctaggattacagatgtgagccaccatgccgggcctaaacaattttttttctttgagggggtttctcctttcatacataactacgtttcccctggagtcctggccataatcccgagtctggactaaaaggagcatagagaactttcttacatagatagcagtaattttaggggtacctatgggttgcagccatcactgaccttcaatgagtaccttttcttcctttttaaagcattttcaagaggcattcacaagtatcacataaaagaatgtatgattctgccacaaaaccattaccaggacatacatgcattaatatggaaaaactgatgtacagatacagaatgcagaaagctgactctctaaatcagagatgaagaacacatgagcgtgggagatgacggagcccttggctggagggcactgacaattgtattgtaatgtgatgttgacatatctatctcccagactggagcacagttctgaggttggagactgcaatacagtgaactctgtgcttggaacacagtaggtgcctggttatttgttgactacttttcccattaaaataacctgagttgttagtctttttatgattgaattataggagttttaacatttattctggatacaagtcctctgtcagatatatgcctcatgaatattttctctcagcctgtggcttgtccctgttttcttaactgtgttttttgataaatagtttttaatttattaaatttaaattgatcaattgatcaactgatcatagagtttgtttctctatggttaaatctttctgtatcctaagaaatctttacctgtcctaagaccataaagaaatgtacctatgttttcttctaaaagctgtatagttgtagcttttacatttaggttgtattgaatcctactttaactgtcaagctctttcactgattgatttcattttattttatgcttttgtatctcagagaagatcttattcctttctgatctccacacaaccaagagaaaggccgagcaatggctcctccatagacgattccaattcagccatctaaggggaagttctccaggcatctcatgagattttgtactcatgctttgcccaccccattcacatttacttacaaggcactttttatgtatgcatatcttactgatccttacatcaacttccaaaggaggcagagccatcttcatttttaaaaataaggaattatttttatatttataaaattttaaaaaatgttatatgatataaaaataatttaaaaaaattttatatatataaaaattttaaaataattatacacccagaaaaatgaaatgacttgcccaagaccactcagtgaataaataacagaattaagatgagactcaggaatcctaacttttgatcttttttcttggtcagttaagaatataatgagagtagacctagcatgggggctcacacctgtaatcccagcactttgggaggctgaggcaggtggatcatgaggtcaagagattgagaacatcctggccaacatggtgaaaccctgtctttactgaaaatacaaaaattagctgggtgtggtggcacgctcctgtaatcccagctacttgggaggctgaggcaggagaattacttgaacccaggaggcggaggttgcagtgagccgagatcgtgccactgcactccagcctgggcgacaaagcgagagtctgtcttaaaaaaaaaaaatgagagtaaactgtacatatgacaccacagagaacatttactgagagcgtatctcaggctcctttcctgggagtgactttttctacatcaagacaagtggcccatcccctctaatgaaggtgaagagaaaacagtgagctggaagagctcatttcagactttttctgccctgactaaatggagagacatggaagatgaggatgggggagaaacagaggatccagaataagaagaaagtagaagacagctctttcagaagatgagccctctagctatgcctaccaggtagagtggaatggtgggctcagccagtataaagttatgaggtcatgctctccaaaatcaggaaaagctttctatgagagcccttttcctggcccttgtcccaaatgggtgtctcttgtcctattataatactataagtgatcatttattaaacacttatgtgccattaatttatatatatcatctctaaatgtactgtaacatttttaagtaggcataatccttcccattgtaaagatgagaaaaccaaagcttagagtgtgtaagtagtttgtccacatttacacatctgagatgggattcaatcccaggtctgcccaatttgtaattatttccactacaacggccttccaaagaaaatgattggggccacaccctcttcctaaagtccttgcaattactctgctcccagagcatctgcttcctacctgtcctgggtagacccacatttcagcctccatttacacaggttatgtctaccggcctctctattctatgaacctacagtccctttcatactgtccccaggctatgataacacttgccaatcccacctcctgccccagttcccagccctcatctccctgccccattcatggtctcaaggctcattattccctgctcttgtggttcacattcctagacacttcctgggaacaaatacactcccataactatccagcatattccttaaccatatagttgcacaacatggcactactgtctcctattatcctatgtttttgaaccctctaccaaggtggttattagaaatgggaatttttttacaattattttttacagacagagtctagctttgttgcttaggctacagtgcagtgatgcgatcatagctcactgcaccttgaactcctgggctcaagtgatcctcccacccagcctccttagtagctgggactacaggtgcacaccacaatgcctggctaatttttaaattttttgtagagacagggtttcaccatgttgcccaggctggtctcaactcctaggctcaagtgatcctcccatcccagcctctcaaagtgctgggattacaggtgtggaaatgggaatttagggaactctttctacctgctcagcaatggagcaactctgggcgggaaaaccccagaaagaaggtttcctctagctttggtcatcagtgtctttctgccagtcatagaaccccttccctcttttttggccttctgaataaagatggggaacacaatggtcttcaattgctcttctctagcaatctgaccttgacttgagatcctgataaggtgcctctgtaggactgataacgcttttcctgactggtcctctcctgggtaggatcaaagggaggagggcaggagggtagatttgggagtgttagcttatgcttaggtctcttcttgaaggcttactgtaacagatcaggtgccctaggcattacaatgactgtccctgcccctgccagacactgtggggcaccctggtcaatgttttcttactccacccttacctggagcctggtggctcccatagcaccagaagatatggtatgtgtgtctatgtgcatgtatagctatgtgcatgcatgcatgcatgtatgtatgtatgtgtgtgtgtggagagaaaggtttcccagccctcctcttgaaagctgcgaggatccttgcatgttctccatcataaacttacagtagctgtaggggtgtctcctcctattaagcctttgtttctagatctgactcccccatccctgacccatactagaagcttcattagaaatgcccaaaaaggaaggatgagatctgcttcttgacaaaatagcataaatggcattagcccaagccttggcttttccccatctctgcaccatagcccaaatgtatgcaatgagcttgtctaatgcttgtgcttccgcatgttcccccctttatccccccccgcaccgcccccctctcccttttggaaagacaaagccaaccctcagaagccagggcccaaatgtgctgatcggtatcctagcatctctgccctgcccctcccccagctccctgagccatacctctgtcaggagccttgagctggacccctgatgcgtctgtcccttttgcactccgaccaagctctaccgcgacagttccagctgagacactgttccacgggatcacacaggggaactgggccgatttcctaagatctgatttctgctaatacaatggcatcgttgctaatgcagggaggctgcgcaatcccagccccagtctccgtgctgctgccgcggctgctggtgctgcggtgacgttgctgctaagggaagggggaagggaaaggagcaggcaggcccacagcacagccactcagcctccctcccttccagcccctgtgggccctttagcctagggaagggggagggtagagaaaggagccagccacagagggcagtcagtgctggaagatggagcactcttaagacagcaaaggaaaaatggggagagttgtgtctagctcctcttttgtccttaggcatctcagggaagatgtctgggcagagccttggagcttccttccttccttccttctttaggctcctcctttcatatcttaaccagaaacctctccctcctctttttgcccattgtgaatgactctgttttccagctttttcctctaaccaggattccagactagcctcagggtggggcagtcagcctgggaggggattcctgaagcccagaagggaggctgcagggaccagtcaccattctgccagcagtaactcgaactcagtcctggtggatggcccacgagtcttagcactggccttcctagagagacggggcggtagacaggcttctgtacactgggtggtggtaagtcttaaggaccatggaggctgcaggccctcttcctaacacggtattcaattcagttccctgggtcttcagaggtctactcgctgtggctgaagtagaactggcccctctcacatacatcagttctcggtcagtgctcagctgggtccagctgggtttgtgtgaaggcagaatccctctagccaggctgagaggccaggaagcttatctccccagggaaaggaaggcagggaacagggagtggtctctcctaggccacagaaaaatctcagttctgcctggagacctacagagtcctctgctccttccctgctccagcctcctcaggttctgggccaattctgtgggaataaggaaaaaagggagaaactgcagctagagccagttgtacaggaagtagcggtgaggtctccgtccactttgtgccactgctccctgctgctacgcttgaacacagagatagtcttaagcagggcttggtccccaaacactagccctgcctagggttcctcccaaggtgactactatctggactccacagcctgcccttggatttcaggtccttagaaagaagcctttggagaaaccactggccaagaccataacagctatccctcaggatccagaagagatgtaacttttcttttcctttcttgtttctcctattccctgtgacacccatgtgtccactgacaccatgctgagctgagtcaattgtagagagaagaacaaaaacacacaaagacacaaagacccatctccagccttgacttgtttgagcagccatggccccttgatcctataaagcaagaaacagtgaggaaaggaaggaaggagggaggctgctgttcatagccaaccattagcggtcatctcaaggaggctgaaaggtgaggaaatggtgtcactatgctttcctctcgcctagctgataccacaaagcggggttggataagcatctgtaggttagggcagagtgaatcttcatgaccaagcgtttggagttcgagcctcttaccatgagagctctgggcccagggtctttgactctgaaatttctgcgaggctaagtcatgcattgtgctggacagccagtgcttccagttgcctatggaaggtggcagctctcagacctctagtgcttggcttaattcactacatcacagacaaccttgccacttacttcctaaccactactgccaaagatctagggttttgaggaaagatcaaattattttccagccagaaacaaaacacaaatactgttacattataaacctcggccacctaactagtctccccacttgcaatttactttttagtactaccagattcatctccctaaagcaccacctttcttcaacatgccactcctcctgccccttttaatggtttctcattacccagagaatcaagttgagcctcctcattttggctttagaggtcatccatctcggctgtctattcttttttttttttttttttttttgagtttcactcttgtcatccaggctggagtgcagtggcgcgatcttggctcactgcaacctctgtctcccaggatcaagtgattctcctgtctcagcctcccgagtagctgggattacaggcacctgccaccatgccccggctaagttttttacttttagaagagacggggttttgccatgttggccaggcttgttttgaactcctgacctcaggtgatccacccgcctcagcctcccaaagtgctgggattacaggtgtgagccaccgtgcccagccttggctgtctactctactccactcaaccttgccttcccatcatgcagtccttgaaacatgtttcagaaactcatttccactctgttgtatttgttcattcagactctccttcctgttacacttggccctgttcaaaattatccaaacctaccagacccagagcaactcctccatcaagtcttctctgattaccccagagccagaaataatctgttctccgaaccagtggttgcaggttgttgattttacagacaagaaaacaacttccacaaaaaacggggatcaatattggattgccaacttcttatattgtcaagtaggatcattacaaaaaactttactttgatgatcatcattttataagaaaaagcatactgtactttctcattgcattgcatattgatggcaaacttcatcagcaatagcatcggtccctgagaagttttgattaagtaaatcatgtcacttaacatggttattgttcttttttgcatatctgccttaacatctcttctagactgcaaagtcggagttatagtcatctgtacatctccattatccagtatataagaatatcattttaattttgtatttcccataaaacctagcatactgcttggcatatagaaggtgtcttatgcttggcatatggaagtcttgttgaacaagaataatctaaaaagagatgcttggccgggcacggtggctcatgcctgtaatcccagcactttgagaggccgaggcgggcagatcacgaggtcaggagattgagaccatcctggctaacacagtgaaactccgtctctactaaaaatacaaaaaaaattagccgggcgtggtggtggacgcctggagtcccagctactcagcaagctgaggcaggagaatggcgtgaacccaggaggcagagcttgcagtgagccaagatggcgccactgcactccagcctgggctacagagcaagagactccgtctcaaaaaaaaaaaaaaaaaaaagagaagctccttgtgtgtaaatcagaataagtggtgggtagacttgactcaataggcttgaaagagaagactgttttccatgtgaaaaaaaaaaaaatctatcaaaaagaagcttaggcggccgggagcggtggctaatgcctgtaatcctagcactttggggggccgaagcgggcagatcacctgaggtcaggagttcaagaccagcctggccaacatggtgaaaccttgtctctactaaaaatacaaaaattagcggggtgtggtggtgggcacctgtaaccccagctattcgggaggctgaggcaggagaatcacttgaactcaggaggtggaggtttcagtgagccgagattgcaccattgcactccagactgagcaacaggagtgacactccatatctaaaaaaaagaagcttaggcaacaaagaagtaattcttcataacctagggttaggcaacacattcttagacatgatatcaaaaatacaagtgacaaaagaaaaaaacagaaaaactttgacttcctgctggcaaaatgaaaaaataaaaaaaaaaacataaactgacttcataaaaatttaaaacttttgttcttcaaaggacacaatcaagatagtcaaaagaaaacccacagaatgtgagaaaatttgcagatcatatatctgataagggatttctatccagaatatatttaaaaacacttacaactcagtaataaaaagacaatccaatttttaaatgggcaaagggggccaggcatggtggctcacacctgtaatcccagagctttgggaggccaaggcaggcagatcacttcaggtcaggagttcgagaccagcctggccaacatggcaaaacctgtctctaccaaaaaaatacaaaaattagctgggtgtgatggtgcacacctgtaatcccagctactcgggaggctaaggcacaagaggtgcttgaacctgggaggcagaggttgcagtgagctgagatcgcacccctgcactccagcctgggtgacagagtgagaacctgtctcaaaaaaataaataagtaaataaataaaaacgagcaaaggattgtgtgtgtgtgtgtgtgtgtgtgtgtgtgtgtgtgtgtattatttgtagagatgggggtctcactctgttgcccaggctggtccaaaactcctgagctcaagtgatcctcctgcttcggcttcccaaagtgctgggattacaggcatgagccaccatgcctggctgggcaaaggatttgaataaacatttccccaaagaagacacacaaatggtcaacaagtacttatataaacaaatgcttaacatcattaatcattaggcagtacaaatcaaaactaaagtgagatactacttgaccccactagaatggctaaaataaaaaaaggcaggcaatcacacatgttgacaatgatgtgtagaaattggaaccctcacacattgctgagggcactgtaaaatggtgcaaccactttggaaaagagttctggcagtttctcaaaaagttaaagagttactatttgaccccagcaattctgcttctaggtatatacctacgagaaacaaaaaacatccacacagaagcttgtatatgagtattcctagtagcattattcatgatagtcaaaaactaggagcaaccaaaatgttcatcaacagaagaagggataaataaaaggtggtacacacaatgaattattattgagcaataaaagggaatgaagtcctgataaatgctccaacatggatgaaccttgaaaacatgctaggtgaaagaagaaacacagaaggtcacatattgtttcattccatttacatgatatgtccagacaaggcaaatctatagagacaaaaagtagatcagtggctgccagaggctggagaggcagagagatggggagtgcctgctaatgggtgtggggtttcttttgggaatgatgaaatgttccaaaattagactacagtcatagttgcacaactgtgaatatactaaaacaattgaattgtatactttaaatggcaaaatgtatggtatgtcaattatatttcaataaagctgttaaaaacagtggcagttgctgtaggagcttgagtggtgttgctcagctccacagagactgaagtctttgagaaccccataactgggggtatgggtgagaggtggaatatcagggtaccagaaagcagaggctatcactgcatgtcaatccaaggacgtcagatagtcctctctttcttttttcaacaccaaattcttcttttttttttttttgagacagagtctcgctctgtcacccaggctggagtgcagtggcacgatctcggctcactgcaacctccgcctcctgggttcaagcgattctcgtgcctcagcctctcgagtagctgggattacaggcatgcgccactatgcttggctaatttttgtattttttagtagagatggggtttcgccatgttgcccaggctggtctcgaactcctgagcttaagtgatctgctcgcctaggcctcccaaagtgctaggattacaggcgtgagccaccacacccagcctcgacaccaaaattccttaacaaatggactcttaaaattctctctccactctctccttcattgtttcttaaccaccagaaatcttttttctaataacatttgaagtgtgtgaagcagttatcatttttaacttataatattggaatcatccaacactatcagcagtcatcctttcctattcaactcctcttttccctttggcttttttttttgagacatttaagacagtttcgctctgtcacccaggctggaatgcagtggctgatcttggctcactgtaacctccacctcccaggttaaagtgattctcgttcctcagcctcccaagtagctgggattacaggtgcatgccaccacacccagctatatttttgtggttttggtagagatggggtttcaccatgttggccaggctggtcttgaactcctgagctcaagtgatctgcccacctcggccttgcaaagtgctgagattataggcatgtgccatcaaacccaaccccttttgtcttctataaaccaatcctcctagttctacttcttagataattctttcttcgttgtttaataaaacaatacctggcccatatttaaatgcaaatttacagcaaggttcagatctgaagacttttcaatctgaacagtctttagtacttcccattacctttgccgttgatttccaaatcttacattcttcctgaacttccagaatcaaatctccaatagcctatcagatacttattattacctcaaattcaacatatcgaaaaccaaatcgatttttaaaatttcaaattaggtctctttggactgcctgtaacacaaacttgaaaataagagtcatctggactctctttacattcagacaactaccaagtcatgctgagtcttccttccaatgtttcgggcattgacttaatttctttttgttttgtttttagacagagtcttgctctgttgcccaggctggagtgcagtggcatgatctctgctcactgcaagctctgcctcccgggttcacaccattctcctgcctcagtctcccgagtagctgggactacaggcgcccgccaccacgcctggctaatttttttgtatttttagtagaggaggggtttcactgtgttagccaggatgatctcagtctcctaacctcgtgatccgcctgccttggcctcccaaagtgctgggattacaggcgtgaaccaccacgcccagcccaacaatttcctgtttttactatgtttccgctactatgctaaacacttacttacattatctcatttaatccatataaccactctctaagctaaatgttattatccttacttcatgaatgagaaatctgaggctcagggatattaaataatcttcccaatgtaactcagtcagtaaatgtctaagctgggactcagataaagacctgtctgattccagagtcagtattcttaaccacttcctctattgcctctccagttcctatccctactctatcctccaaattcaggcctgtattacctctcctctgaattatatagtcttctaactagttttcttaccttcgttgtctcttggttcccagctatcacatatacaggcacaagggtaatctcctcaacttccttcagcaagtcactctactactaaaacatcttcagtggctccctgctgcctacaggataaatccaaattcttttttttttgagagagagtcttgctctgtcgcccaggctggactgcagtggtgcgatctcagctcactgcaagctccgcttcccaggttcatgccattctcctgcctcagcctcccgagtagctgggactacaggtacccgacaccaagcccggctaatttttttgtattttttagtggagacggggtttcaccatgttagccaggatggtctccatctcctgacctcgtgatccacccgcctcggcctccaaaagtgctgggattacaggcatgagctactgctcccagccccaaattctttaatgtggcgttcaaagttcctttctaccagccaggcgcagtggctcacacctgtaatcccagcactttgggaggctgaggcaggcagatcacttgaggtcaggatttcgagaccagcctggccaacgtggtgaaaccctgtctctacaaaaatacaaaaattagccaggtgtggtggtgtgtgtgtgtaatcccagctgcttgggaggctgaggcaggataatcacatgaacccaggaggcagaggttgcagtgagcagagatcgcaccactgtactccagcctgggcgacagagtgagacccagtctcataaaaaacagaaacaaaaaacaaccaaaaaacccccaaaattcctttctacctatccaaccccattcccgtcacatgccgaatatactctgagttttggctttactcactgggaagatatctggattgttttccccattccctcccacccttcattttaaggatgtggctcaaattctaccatatctggaagcttttctttatcatggaaatccttctcctatacttcaataccaattatacgtacaactcatttggtatcaagacttggccattttattatctcttgatgacggtacatttctagatggtggagctgtgtcttatacattgataggtaattctgagcacagggccttggcacatagtggaggaccaatgatgtttgataaagctactgaatggctggccaggtagggtggctcacacctgtaatcccagcattttgggaggctgaggtggacggattgcttgagcttatgagttgataccagcctcggcaacatggtgaaaccccgtctctacaaaaaatacaaaaattagctgggtgtgctggtgtgcacctgtagtcctagctacttgggagactgaggtgggaggaaggcttgaggccgggaagcagaggttgcggtgagtggagattgtgccactgccctcaagcctggacaacagaacaaggcccagtctcaaaaacaaacaaaaacaaagctactgaatggatggcaagcacagcaggctaaatggagcccagctggctttgagaaggtcagtctcttctgagaacagcatatttgatgaagaagaagaaggtaaggaagaagaaaaactgaaagctgagccttagtaaagtgcttaataaataaatctttaatgccaagatcttaaacccttcattacacaccatgctcattctgaggatggaaacatgactgagcagatatgtcttcagtcagtacattccctcccatttatatccagtcatgaccctggagcaaaggctgtaaaggttgcaaagtgccagcctgactgtcacatctagtgtgtcaataggtttacgtggcttgcacagtaaaaatgccatcataaacattagcaaaggctgcaaagtgacagactgactgtcacatctagtatgtcaataggttttatgtgctttgcatagtaaaaatgccaccataaacattttggggatttctagaaaaaaatctagatttccagcttgttttgcttgaaaaaaaaccaaaagaactggctacactaggccctcattcctacatgactaacaatcagctggagctgagaagtggttcccttcattagatgagcacgtgaccttcagtttgccgtgttcccagcactcctcatggcagcttcactggttcattttacttatttgcattatttgtctggctcctataaggcatctgagtttgccaactcttgccccagaataacagttatgcattttctttatatctctaccctccttgatttgcctcatatttccccaatgatgttcaatgcaatattacttgcaacagagaaaaattgagaatattctaaatatccaatggaaaaatggctagtgagctacccatgtaacggaatataatagaaccattaatattgggtatacaaggtatattcaatggtatcgaaaaaggcttttaagctaatttatttattttttgttttcttttttaaactttttacaatttttttttaaaaatttttttaaagatgggggtctcattatgttggtcaggtctgtcttgaattcctggcctcaagagagcctcccactttggtctccccaactgctgggattaaaggtgtgagacaccatgcccggcccttttaagctaatttaaaaagtaaaatatcagtgctttgagagactgaggagagaagactgcttgagcctagaagttcaagaccagcctgggcaataaagcgagacactgtcaacacaaaaatttaaaaattagttggatgtggtggcacatgcctatggtcctagctacttgggaggctaaggtaggaggctgacttgaacccaggacttttgggctccagtgagctatgatagcgtcactgcactccagcctgggtgacagagcgaaactccatctcaaaaaaaaaaaaaaggtatcaaatcgcataaagagaattctgcttcccacattatggtaatcaagacattacagggcccctttcactgcaaaatatgaaaaatatgagatcctgtataatatatacttttttttttttaaaggaatagggtctcactctgtcacccaggctggagtgcagtggcccaatcatagcccgctgcaaccttgagttgggctcaagcaattctcctgcctcagcccccacaagtaggtgggactacaagcatgtgccaccatgcctggctaatgtttaaattttttgtagagatggcatcttgctatgttgcccaggctgatcttgaacttccggcctcaaggaatcctcctgcctcagccttccaaagcgctgggattataggcatgagccacagtgcctgggcaatatatacttttaaaagcatttcaggtctctcagtatataggagacatctctgtgactactctacccaattccccaaaaagggaaaaattcatgagctatgcagtaagcaagggggagaaccagggttccttgtcagccaattcccagagcatcactgcagccaagatgaccatacttgagccactgggaaggtgagggagctaaacctgagagttctgcattaagcagaaacagggaagcctgaaggaagttcatcatgatccatggtaggtggtgttccacagcttttggtagaagcagatatgaatcttctctgggggaaaatatttcccaatctaagtcaacaaaattctcaaaattaaagatcaagaaaaattagtttataattaatgatcacaaagatgccatgagcaaataacagagaaaacaataaataatgtatttagattgcaagaacttcagataccaaaaatgtcagttacagaatataaatcagctatgtgtgaaatgttttaaaataaaagataaatctcaaaggtaagcgagtggcaatgaattattagaaataaccaggcagatctgaaaaagaacgaaatatgttcagaagttagaaacataattattaaaataaaaactcagccaggtgcagtgacttacacctgtaatcccagcactttgggaggctgaggcaggaggattgcttgaggccaggaatttggtaagagcctgggcaccatagcaagactctgtcactagatacatacacatgtacatacatatgcaagcaagcaagcaagcaagcagaatgtggtggtgcacacctgtagtcccagctacttagaaggctgaagttagaggactgcttgagcctgggagattgaggctaaagtgagccatgaaagcactactgcactccagcctgggtgacacagtgagaccttgtctcaaaaaagaaaaaaaaaacaacgaaaggacaaatttaacagcagaaaagacaaagttgaagtgagaaattagtgaactggaagatcgatctgaagaaatcacatagaaacagcacaaaaaaacaaaggaacagaaaagtgaatgagaagttaagagataagatagaatgaaaatgtttaatatacttataatcagaatctttggtagagaatcaaggagaggtaatatttgaagagataatgacagataatatttcagaagttattagaaaacaagaatccatggattcaggaagtaaaactatctcaggataaagaatatcagtaacaagtatctaaactgtacatcagcaaaaattttttgtgtggcttttattttgttttgagacagggtctctctcttttgcccaggctgcagtggcaccatcccagctcactgcaaccttgaactcctgggctcaagtgatcttcctgccttagcttcctaaagctctggaattacaggcatgagccactgtaccccacaccaagtaaaatctgaatgcaatacatttaatagttaacaagatgaggtaatatctgtttgagtgttgtgtaatcctaggccagttatcttgcctttccctgcccccatttcctgtagaatggtgatgaaaataccaccaacattaagtgaattaatactatcaagcacttaaattgtgcctgacatacagtaaatacccagtaagtgtgatactattatcaagtgataagatgttggttaatatccaaaacccccacaaaggagattacacaattctgaccaaaataggacggtaaccttggagaaacatgaaaagactggatatggatacctttccccactcctcaatcccagcatcttccagaactcagtagtggtctgggcagctttcataagcaatagagagatccagggtgctcaaaataaagcaggcatgaatataaacattggttactgagtcttcctgtgcctggaccaggctactttatggggagttgaaggcttaggggaaacatatgccccctactatagatctgaacagtggtctattcaaaacagtacatgaaagtgctctgtaaactgaccattttatagaaatataaagcactgttaaaatgctaggaactcactctgcatggccaccacccaagcagttgggactacaggcacgtgccatcacgcccagctaatttttgtatttcttttcttttttttggtagatagggtttcatgttgcccaggctggtctcaaactcctgagctcaagcaattcgcccacctaggcctcacaaaatgctggggttacaggcagaagccaccacacctggcctaaaaaatatgtttaaaggtggctgaggcttgctggagtgcagtggtgcgatctcggctcactgcaacctccacctcctgggttcaagcaattctcctgcctcaacctcccgagtagctgcgactgcaggagtgtgcctccacgccaggctaatttttgtatttttagtagagacggggttttgccgtgtaggccagctgatctcgaactcctggcctcaggtgatccgcctgcctcggcctcccacagtgctgggattacaggcatgagccaccgtgctcgaccaaaaattctttttaaaggaaaaaaaaaaatagggatgttggttaaagtttgtagaagaagtaattagacacccagtccccaccaacaaccctacactgtcaggagaccactggtctcctgctcctcaggattactggagatttatttctggagaactttgagtggaactgcattcgactctggaaaacaaggcatggaagaaagcaggatgagaggccaatctgaaaactgaggggttaggtgaaaatctccaaagaattgctagacttcttccttctatttcaggataataccaacagccagacttatttatcccaccctacccctggtagattatttctctgcagaaactgaactacctcagagaaaagaatgtcaaattctctgggggtttccccacacaaaaaaaggccagcctgttccacctgcccaccagacaagtttgccagttgatatatctttccactctcacagaacctccagtgtttttaaatggctcatttttatatcagtagccaagggattaccagagtttttttttttttttgagatggagtctcgctctgtcccccaggctggagtgcagtggtgcgatcttggcttactgcaagctccacctcccgggttcacgccattctcctgcctcagcctcccgagtagctgggactacaggtgcccgccaccacgcccggctaattttttgtatttttagtagagacggggtttcaccgtgttacccaggatggtctcgatctcctgaccttgtgatccacccgtctcggcctcccaaagtgctgggattacaggcgtgagccactgcacccggcctgggatcaccagacttttgagggcagcctccaacagaaaacaaagagtacaacaaaaacataaaataggagtctgggagaaacacataatgcagaacaaaacaagacaaaacccaacacatgaggtcattttatcactttattgatgatgctaattttgaactagtccttcgttaagatagtgtctgtcaggtttctccattgtaaagttatcattttctcctctaattaataagcaatctatggagagattacttttagattagataaataacctgttcccatcaaactttcatccaatcattttagcatccattgatgagtttcatctgaatcagttatttactatgatggttgaaaaatgacaggtttgttttgttttgtgtttttgaggcagagtcacaccctgttgcccaggctggagtgcagtggccctatcttggctcactgcaacctccgtctcccacagcctcctgaggtgctgggattacaggcatgtgccccatgcctagctaattttttgtatttttagcagagacaggtttcaccatgttggccaagctggtctcaaactcctggcctcaagtgatccacccacctcagcctcccaaagtgctgggattacaggcatgagccactgcgcctggccaaaaaatgacaattttctattattccttctacattgattagttggcattctaacataataaagatttcccttttccttcctttcttaatttattgatttaggataaatatggacccctggattttaaaaagtcagtgggtcataatccattactgattttgatgttcagactgccccagatttggcactatttggcttaaatttttattttttttttttaattttttgagatggagtctccctctgttgcccaggctggaatgcagtggccctatcttggctcactgcaacctccacttcctggactcaagccatccttccacctcagcctcctgagtagctgggactacaggcatgcaccaccatgcctggctaatttttgtattttttgtagagacaaggtttcaccatgttgcccaggctggtctcaaactcctgggctcaaggatccagccacctcagcctcccaaagtgacaggattataggcatgagccaccacgcccagccactatttggctttttttttcattgtgaagacctttattgctgtgtatgaatttttaaaagctaactacttattttggaataatttacagttataaaaagttgcaaagatagttcagagttcctgtacctcttttaaccagtttccctaatgttaccatcttacgtaatcaaggtacatttgttaaaacaaagcaattaacattgagtacattacaattaactgaactggcagactttatttgaatgtggctgcttttttcacttatgtcctgttatttagctttataaaaaacattataattttataaaacatataagctaattaaaaacaaagccaccctcacaaaagatatgcagatgtataatgcaggctgcagataaacagtttagatgttgttaataagtatagcttagcagagaaaagttttgcatttcccacaatcaagacaatgagtagttttgggaactgtccaagaaggtaatttttagcaaaagtaagcagtactaatcaatagacaggactatatgattttagtatacctctatgcctggtcttcccaataatcactctgctgacctttcacctcagtacaccagggacagaggtggattgaaatcatacaaatctttggaaatcaacagaaggtacttttgtttgtgctgacttactgggtatcctctccaacagcgacaacctcagttaaggtaattccttttggctaagttttcacctcagactgcatgattgattccagtagcaaaggtcagaaatgctcaaaccataacaaatcaaaataaattattacatactgtactctattctctgatctagaattatcctgaggctatcaattaatatcatcttgtgagccaattaatcaagcaagcaatcaagccacaagcatctactgtattcttcctgtgtataaggagctatgctggatgttcaggggtaatagcccaatttgaggggctcataattttgttaaaataattgccaatatgcctctggaggccagaacagcaaaaagaaagtttcagggtgtaagggttagagcaatgcttttaatttttcagccccaatacataaaacagctaccctggttgaagcagaggaggcctaatgccccatgcactccaattccctctccttactgtggggggccccagaggcacctccagggaaccctaggcaaaggcagaactgaccatagtttgttgggagttagagatatggggagtgaaataattaactgacagaaacatctctcttttttcatgcctcccaaatcaaatgtttgtaaacagatgttgattaacttcaccaatagcaaacctaacttcccagaacagaaataaactttgtacacgaatttggaaagtcagctaccctccacccttgccatgagattagatggaggctctgagtttcctataggacaagtacttctctgtgaaatgtgtgagagaggctcaaagaatttggagatttcagaactggtggtaacagtgattcctgtgggtgtctaggactgaactgtaaagagagaataaacaagttcttagatgctgagagcacctggctatggcatcaggagtctgattccataaatggaatagcagccaatgcccaggaggtcatctgtctttcctccaagtagagtgtagctgctgctagctgaggaggccactgtttctaactcgtatcatgttattttggactccaagtgaggccagacggcatgctgggagtgtgttgaaagggcctagcctgaagggctgtcccagacacaccagttgctgccttattaggcttccttaatatagagtcctctttcgaagcacagaacttggtttgcttttggcttctcacatatgttgtagaaaagttcagctaaacgtccacccccaaaagtcaaagacaaacattccagaagaggcttggctctgaagtagaatgggcttagcagcctaaaaggtaaaagaccccaggcgcccaaggctccaattcagtaaatggagactgcagcattgggaaagtatacccaggaaaagaataagctagagccattgaacctcactgagctgaaagagttgcttttctttattccattaaaatctgatgataataaacctagctttgcccctagggtctctatgctcaaaagggattcaatctagaaaacaaaaaattattttcttctgctgatccagccagcaaaagtatacacctttctccattaggccaaccatttgattccctccttagctcaacttgtagcacctgtttggaagcagcgggctcaatcagatgacctcttaaggtccttttcaggtctaattataacctaagccaaattaaaacctggagcccaagggaaggttcctatgcagtgtgttaaaaaaaatgacctcctgcattccaacatgaatacaaatacacataaacacacctatactcccaggtgcctggcttctaactgctagctgtaagtctctagagactgggaatttgttgtaaaccctatttcttttgaggatgtattagggggagagaggaagactatagggaataaggaaagatttggttcctaccttgacagaccgagttcttcagatgaggtgatggagagagcagcagtgagtaaggcccacaggctaaagtctctcaatgctaggtgtaggtgagcagcaagggagcaggaagccaccaagaccagagacagtgtacgaggggtggatgctgaaagccccagcacagactgctttgcttggaggatggccctcaagtgtgtatttgcaggagaaagttagctggaacaaaaaaggcccctatgctgctctttgactgctcagtgtggtcagtcctttggctgtgtgggcagccctctggctattccttttagctcctgggcttcaggaagcaaaaatcaaagtgtactctgctcccccaccccacaggcagtggactgaagcacacagactaggaagctgctatccaatcagaatgcccaaagctgtaaataaaaggccacatacgcacagtaaagtaggctatgagaagaatctagattgaattacagaagccagttgtggggccagggtggaggaggttggaaaaagagaggggtgggggaagcctagttgtccttcaaggaatctttttattcaagtacacccctccctcagcatgactgccagaaccatcaaagccttgttcccctggggaaccaggttccaatctggccatgttctctacagaggagtcatggtctgagactcctcaggcagagtcaaagcctttctctgggaggcatctcatcttccaggaggcttgccctgctagtctctggagtccagctcaccatggacagtaagagcactgggactggctcactcgcaggtggcagcaaaaaccatttctgtgtaccagtaactattgctttagttgtaagactaaagtgagagtaacttatatatttttgtttacttaagcccccacatttaaaaagcaggtagctgaagcctggcctgggtcctgagtattcagcagcctaggttctataatgattcacaacatggattttggtgttaagacaagtctgggtccaactctgacacattacttgccagctgtggaattctgggtggtcactcaacctcactaaaacttcagcttcctcatttgtaaaactgtcatattttccctgaaaagcttgaagtaaaaataagtaagatattgtacataaagtacccaacacatggtaggtgcttagtaataagtcattattattattatatctttggcagatgaccagtggagctctttcctctctcctgtcccaatttcccagaaaatctaaagtcttcaggtcagggaagtggcaggcaaaatctctttaaaagagccaaaggaaatggaagggtcacattcctttttttcctcccccacactaggactgaatcagtcatcctgtctgtggccatcatactctaggctggtaggctggccctgggagcctcaaggctctccaaaaccaaagatactaatccaccgccagtgttacctgttgtagggcatgctcctagactgatggtgcttctcctggggccccagatcatattccagtaggtgaaggggagagagtgtgatcccaagttggcaggataggttttgtccaggctgttgtctgaccatcacagctgcctgtgaggcctatgggttaataatagcaactctgatgccaatggattaagacagaactgtaggaggtgtttatttttacgctctggcgtcagtatcaagttctactggttactgcccaaatctagggcagcttcctgctccaggagtggcctcaggcttctccaggttactaagttggattctacgggaagcaagtcttgttgaaaacagttcagcattaaacaggacagggaagacgaaggggaacaaacagagctttcatatgtccagctgtctagtgccaaacctctgggaccagatggacctcaagttgaaagctgttgcttatagtactctcttgagtcaggtaggccctgttgttctggacagggtacacacatacacacacacaaattggctgcattgaaatcatctgaataaaaacaaagaaagactgccactcaactacccagaagctcagccttatcagtcataagtcccagactagggcactgagtgctgacattgtaaagaaaaagaaaaagcctgtttgggagggttttataggaatttgagacagaggatgggttaggccagtcctcaaccgatctgtatagtttttagcacgtacatcaaattccttgaaaatctgccaccagagattttttcctagacatgacacactaggatagaaatcttgttgggccaggagctgtgcctagataatctcctgaaagcttcttcatccctgcaagacctagagactggggtcctagggactttatactttgactacagtatctggaactctgtggatatcctgctaacctccctgaaaggcagctcctgccagagtgtctacttgccccatcaggcagacaggagcatgaggaggctgacagctggaaagctgatgtaaatagatgtagactagcttactctggagccaggagcacagcagactgctgtggaatgacaaaaatgtaccacacaccaggtaggaatgctgaagtgcaaacaaaacagccgagcagccaagcacacaggaacagtgactctgtcatcttcctgcaatcctaggtcatcatcagtgacacgacatgttaataccttaagaagtcagggtgctggcaagaagacaggctggtgagggactcatttaatacattttttccctgtcattcaaggatgatccacttggtcatcagaacaacagtgcagccttagaaacaaccagatttgatcactagtgataaaggagtttgatcttagctccatctggaaactacccatgcctaggatagtggcaggatgcccaaagacaggaacactgctttcattcttgggttttcctccaacttgctgggtcatctggggcagagtacctgttctctcaaagctccatatttaccatctagtaaaaggactaactgtatccatcttctggtgtgtggtaggaaaaaatatttgaaaaataaaaagaataagggaaatgtaaatgctgtagtctttagactaaagtatttcagaaatatcatggtcatccacgcatgcaggcagagcgccctggccttctcctgtgtcctccctcttctagggtcacagtggccacattaggaaataggcccagtctgtgcccagagatgcagtgcccttctttcaggcctataatccccacctctggtttgaggaacagacgaaataggaatatgcttacctagacataaggtattaatttccactaacttataataaggaatttagaaatacataagcaaaagaaacaatttcacttactcccttgtctatctagcagccacaaagctaattctcccctgtttgtgggcccaggacactgatctggggcctgtatcccactgatgtggcattcagcagcaggactcactggaacatagcctaaaaggcctgagagagcaacattaatgagggatgtattctactgctcagtcagaacaaaggcgatactgtattctaaacctaacacaagccttcagtctttctagcccagcgatccctgagtattgggttagtttgccaggtctctggaactcccgaagagaactagaaatctattctttgttgatggtgacacctactttttctgtaagtctctaccctgggattcaaaacagatgttcaaacctcctgcagcctctggtgagacccacttcctttcagagaagaggcctcaaaatcagggatcagcaaactctttctgtaaatatttcagctttgtgggccatatagtactgccacatctttttaaaatttttttcttgtaaatttacaatttataattgtatgtatctatggatcacgaagtgatactatgatttatgaatatcatgtggaataattaaattaagctaattaacatatccattgcctcaaatacttaccttcttttggtgagaatatttgaaatttactttcttagcaattcccttttaaaaaaacaaacaacaactctttaaaaatgtaaaagccattctcagcttatgaatgaaaacaccctggcagggaccataatttgctgattgactcctactctagaccttaaaggcctctctatgcaaggtctgtatcttagaattctgaccctggtgggcctgcctagagatcctctttccacagggctgacacggttctcagaggcaactcccctctgaggagtcactgaggaatgtgaaggaagaatcctgaggttatttgtattggagctgacagactggctaatttccctcacataaaacacttcaaaaccatctatagaatttagcttattgcattatcattctggagtgtagaatgaaccataaaccatctttatctttctgtttctgcttaatactatcccatacccctacaaggcctttttttttctttcccccaagttccaaatccacacttgaattggctcaggcctgaactcactccccattctatatgtggtatggctgtggatagcaaggaaactatcaatagacagatggatttggacacagtaaatatggatgagaggcatgggggtaggggtgagcaaaaatttagggctgactttaatctgggcaccatcacaaatagttacaggttctgtaaacaggtggcaaactgctatagaagcatcctaagaatgatatagaaatggttaggaatctttgtagttatacctccccacacaccagaagctagaggaaacaaatgacttattgctaaagagtaattcttctaatattattagcaattatttattatctactatgttactcaccatgctagatgtttgtcataagcgcatttctcttttttttttttttttttttttttgagacaagaatctcgctgtgtcgctcaggctggaatgtggtggcgcaatctcggctcactacaacctctgcctcccaggttcaagtgattcttgtgcctcagctacccaagtagctgagattagaggtgcgcgccaccatgcccagctaatttttgaatttttagtagagatggagtttccccatgttggccaggctgttcccaacttcctggcctcaagtgatcctcccacctcagcctcccaaagtgtcggaattataggtgtgaaccactgtgtctggcccataagtgcatttctaatcctcatgataaccgtgcaaagtagatattattatctctattttacagttgaggaaactgaggatcttgcagagataaactttatctaagatcacagacccagaaagtagagaagttgggcttgcaatttttgtctgactcaatctaaagcccttgctctttctactataatatacagctaatatccttgatagagaaaaacaataagcaaatcccttaatttgggtcttgtttgactttgtttcaaatagcagcaatcgatgatgttagctgtgggcttgaaaaaaaaaatagcagcaatctgttggtctgcctttttctatactctgaatattaatgaatgacaaggtactaaaaatcacaagtatgacacttttacatggtagtgattcaggtcaaatgcatacagctgtattcctaccaaagctggagacatacatgagctaacacttgtttactctttacaagaaaacgggatttttaatgttaaatctttgcctcgtagccaaataagtctcttttcaacagtggtatatgtgtatctttgtgtgagctgttattttgtaaacaatttagctgaattaaattagttccccacttttccaggtcccagattattagttgccaatcaaatatttattctccctttatctttcaaattaacagaaccctgatattcggctaggtacaatgctacccaagtaaaattccacatttctccctcccctgcaagtaggggtggccatttgaccgagttatggtggaattgttgtgtgcaacttctgggtagtctctttatgatgaacagggtgcaaccttcttcatctcttcctccatcctgctgctaggaaggtagctgtgatgactagaactatagtaggtcatcttgtgccataaggatggcctagagatagccgagcaaaaaactggaaagggtgtgggtctctaatgactgtggagctgccatactagcccaggaccatctatctctgtacttccgttgctgatgagagaaaaaaacctccatcttatttaagtcaccagtgttgggtttctgttactcatatctattgctactttatacatcctaccacattctccatccctactgctactaaagagcaacctatatttatcacttatctaagttcctacatcaacctctaacctggtttcccttcctagaatcatcttaatagacatcaaatgaagtctatttatatcactttcatgcttaaaaacccttcgaaggctttccataaaatccaaattccctaaaggtatatgctagccttgataaatcacctcttcactctcatcttttgccctgtagtcatactatcaactcggatcagctcggtactgattggaacactgcccctccatttgtctaactcctaatcatcctttaggtttttagctaaaatattccaaatccaatggcccttcccaggctactggttgtattttctcaaagcaccttgcacttctctatattgtgttttatacttgtttatttggcttctaacactagacagcaagtttcatggggcaggaaccctgtctaccattatttgttggtgtatactcagaacctagcagtgtctgggatgcatagattaatattttcaaatgaattaatgaaattttcaagagagcagccaagcagtatgtagcaaaatttgaaataagcatactctctagtctatttctataaaaacgtatttaaaagaaataacattataaagacacataaagtaatatatatatatatatatatatatatatatatatatgtttgttgaagcactatttacaaaagcaaaaaaatactatttaaaacaattttttatagagacagggtcttgctatgttgcccacactggtctcaaactcctgggctcaagtgatcctcctgccttggcctctcaaattgctgggattacaggcatgagccactgcacctggccaaaatttaaaaatatttttaaaatcccctcagtaatgaattggttaaataaatcatgatgcaatccatgcaatgaagtattctacaaaacacaaaaagatgtgtcagaattgttgtcaagatgaaactatgctcatgatacagtttttttttcttttaaataagcaatttacaaagtacaactctcaggttgggtgcagtggctcatgcctgtaatcctagcacttggagaggctgaggcaggtggatcacttgaggtcaggagttcaagaccagtctggccaacatggcgaaaccccatctctactaaaaatatgaaaattagcttggcatggtggcacgtgtctgtaatcccagctgctcgggaggctgaggcatgagaatcacttgaacccaggaggcggaggttgcagtgagccgagatcgtaccattgtactccagcctggaaaatctcttcaggtataactcttcttttacaagtgagactctgtctcaagcaacaacaacaacaacaacaacaacaacaacaacaacaacaaaacaaagtataattctcaagtccaaaatccatggttgaaaacctaagaatggctgctctttcagttccctttgatttgtgcttctgcttcttagcagtcatcatcatcgtcatcctagtagtagtagcaattaatatttatagtcattagtgagtacctcactgccagacattataactgcatgtgcatcatctcatttaatgctgacaaaactatacaaggagggaactgttagggtgatgtgaaatggtcaatatgcattttttttaacctgcaaaaatgcccatttcataaggttaaacttaatgttattatttcccaggggcccagaggttttacaaaaattgtccatgtttttataattggggagtggctgagctgagtttcatacccaggtgtgtttggtaccacagtaactgtgctcttttgcttgatgtataaaagagggacgggaggaggaaggaaaaacaaaacaaaacagaaaacaaagtataactcatggtatgatcccatttttatttaaaaaaaatgcatacacatcttctttttgatcatctgtattttctggcaataagtgggatgatgggactcttttgggccatctgggatcctcacaggcctgaaagcctggacctcatgaaacatcagcacaggagacatgagggactacccacttacagcctcaaagagaacagctacctgtactgggagaacaggtatctaatgagtgcccactaaatgcctaataccttaattcagagaagaaataaaagctacaggcatgcatagggcaaattataattcattgagaaagctaaatgttgttttaaaagattcaaattatattcaaagttctaaaatgccttatattagcttgagaaaattatgaaaataaaaacaaaaaattagatgaaaatattcttgaaacttgtgcttgcccctttcatgagaaacttgtaaaagaagagttatacctgaagagattttcctattttttttttctttttttgagatggaagtctcgttctgtcgcccaggctggagtgcagtggcgcgatcttggctcactgcaacctccgcctcccgggttcatgccattctcctgcctcatcctcccgagtagctgggactacaggcgccagccaccacgcccagctaatcttttgtattttttagtagagacggggtttcaccttgttagccaggatggtctcaatctcctgacctcatgatccgcctgcctcggcctcccaaagtgctaagattacaggcgtgagccaccgcgcccggccgagattttcctatatttttatcttgaattagcacattagtttacaggtagataacataaacctgatatatatcttttaggagagttaaaaatagaagaattacaaaaagcactaaggattataaagcaagaaagtatattataaccatttatatacactttctatttccttcttgattgcatgctaaggacagaggctatcttcatctttgtagtcactgaacctagcctaaagtctggcatggggtagatgattaaaatgtttactgagttgaactaagttcgaggaactgaaatcttcaccaaataaactggaaacatttcttcagagcagaatttggctcattacagatgtggacatatttacacatacttagttctagtcctcctttttgggatgtggggtactgaaatggatctagggaatccagtgatgggcttctggaatatgcagggggagtatccttgcgacagctcctctcttcataccatactcatactcaagtatgagtttccttcatatctggcaatgcgctccctctactgccagtgggagccacagcaggggaccaagaacagcaggttccagacagaatgacagacatcctgccctccttttctccccctttaacctcacagtcttcaactctgtcctattagctgcttccaatagggactgctgagtagctaggaaagaatgcaggatatgtttcaaaagtccagcactagctgagggcagtgctataaagttacactaaaaagggcagtctataaagttacataagacccagctctgctcgctgggagcttttccaactccatctgaagagactcctcaagctgtttggagtttcaggaaaagtgtttggaatttcctgcttggccaacctatactggagctatctctgggtagatgttgggaggttccagcagaaaaagtagtaactctgtgctcccattgtcggctgcttccccactgggttcagtggggacagcaaatagcatagtccatttatagtcaaaatctcagaataagaacaagccctttgccaaaaacacagcccatctggcatcaagccctaggggcccacccaaaggaggcaggacctgggaaatctaacagcccaacccagtaatacacaacagtgctctagaagagtttccttctctgctttgggcaaacgtttgaaggaatctgcggccctgagaaccttaaatgccaaagtctcacccaaggactaaaggaattactcaataaatcttaactgagtacctccaaagtgccagacactgtagtgtgtgaaagaaaaaaacctgatgcctgccttcatggagtttatagttcacccagggagactaaacaaataaataactatgactgtatactcgattaagtaggcctttggaatgtgctgcattcaaaggaaagatagttaaatcatgaaagccagctccatccagggaggccaattagcatatttattaatcagggtccagtttacactgtattggcaattaaaattatctgttttctctttaaaaatttttattgtagagacggggtctcactatgttggcaaagctggtcttgaactcccgggctcaagcaatcctcccacctcggcctcccaaagttctggaattacaggtgtgagccaccatatgcccagccaattacttatgcctgaattgaaaactcttgaaaagtcaccggaatctatcaataacatactcttggttaagctccacttttattcccattcattttgtgggaattcagtacctatttttatattacatatttttatttaaggcataggaactcacttcaattaacaaactactgtccattacactggagaaatagaaccctgatttgctcttttcagcatcaggccattcatttttgtttctttctggtcaatgtaaagagctaagaaaaggtaggtatagaactctgctcttcaggactaattctgtagcagctggcaagttatttgattcccctcagcctctgtttcattttaaaatggggataataccttcctacagggtggtggtaggagttacagagaagatatataagacatctaggacagggactggtatttaggcagggctcaataaatgacaactataataaatgtgaatcaggaatctcctcttttctttaacctgaatccctcctattgcctttttgagactgtactaccgttcaatttaccagtttacaacagggaaccatgtcatggtcatagccagtgttttcttttcaataggaatactacctcaaattctttaacttttcttcacggctttgttctttgtccccctgtaagttgtaaagtaaagcagctctaacctaggcaacatctcgggaaaatatatagaaaggaggttagagtgaatttatgttaactgtaaatcaagaatttcctgcccaatgaacacgggtaggtacaggtctacttgaattgctcactgtcaccagaacacagtagaagcaagtcttccatgtaaactcatgggctgacaagattctccttaaaagatctaattatttccagacatgtacaccatgtgaccctccctaagttccacagcttctgctttagaaaagtttctctggacaaggtggtgtgcctccggggctcaagtgatcctcctgcctcagcatcctgagtagctgggactacaggtatgcaccatcacacttggctaatttttaatttttttttgaagagacgagggtcttgaactcttagcttcaagtgatccggccttagcctcccaaagtgctgagattataggtgagagccactgtgcccagcctcattctgattctgattcctgatatttttctaacttttttttttaaagactaatttaggaatttctctatatccttggttttccaaattttcaagatgaaggaccctgggataagttatgttggtgctatttgttatgctgggtgctgagtggactctttcaatttgtagactcatattcttcagttctgggaaatgtacttgtattctttctgtcttttccttttgtttttgtccccactgatgtgaaagattaagaaaagaggttaaatgatggaataacatacctgagaagctgtagtggctccagaatttcgctataggttgattttaggagcagcaaacagattaaaagggataggtgggaatggagtagcatcagggaattgtcataaagttccatttgtatagcaatgacagtgtttgtacttggaatataggtttatttgggatagcttaaagagtataccattttggtatgatattctctgcatatggatgacgacaatctcagagtggcttaaacaacagaggaaattcattgtcacacatatcaagaagaccagaggcacagtgactgccaggttagtgaattcagaggttcaacatgtcatttaaatctgccatccttaggtcagagcatggctccagtagtcatctcaaacattacactgagatatgttcacattcacaggcatgtgtggaggaaggtggatatctaaacaaactgttacgcttcaaaggaggaatagagaagtcattgctgagtaagcaaccaattgtgatcaagtaggagggtatgcaatccagagcgccagggagggattacttagcttttgttaggaggtggaatatttcctccaactagagaggagaggatggctgtagacacgtttgcagattggtggtaggaagtaagagagctcacatatgatggcttcctttttccttctgaggtatgagtcaagactaccaacagcatagggaaggaaacagggagggtgagaggtagaagagagtaatgaagggatgaaacatttgttgcaaagagtagagtaggatacttgttagagaaatatagtaagactgctgccaatattaacttcggtaatgatgaatttatttttaaattttttggaacataaactcaagattttattgtcttcataacaaaacaaaagatgacacttaaaactggatcacttggccttttcacttatctcctcccagttcaaagtgcttgcatctcttaatagccacattttctcagatctgaaattgagctcaacacactcaagccttagcacaatcttctctgtagttttagcttttttctggaaaatcggcttactctgcccaccatagccactgtgcttcctgtcataatgctgctttccctagacacacagagaatccttgcccttcttggactatgtcactttgtggagttggtgcttgtgatacttcttacagaaagtctggtgggtttggggaacattcaccatgttcgctggagtgctgtcagctggtaatgatgaatttagagtgatgctaaatatgctggcctgtacaactttctccagcaaagctgagctatttgagtacagacatggagaaggtaaggggttatattcattcagggttggggttttatcaggcaagtatacttttaaaagaatgtagtatcagtgaagttttattgaagttaaaggactactagtgaggatgcttcaacaagtgaatggaattcactaagctataaatcataaaatctatgtggcaacatggataaatgcttaggaactaaattaaagcagaatataaaataatcttaatgctacaattacatccatgcaaaatttatatatgcatgtaaacagaaagcataggaaagtgggattataggtgatttaaatttattttgtgattattcttatttttatttttttcttgagatagggtctccctctgttgcccaggccagagtgcagtggtataatcacagctcactgcagcctcaccctcctaggctcaaatgatcctcccacctcgcctcccaagtagctgggactacaggtgtgcaccaccacacccagataatttttaaattttttttgtagagacgaggtttcactatgttgctcaggctagtctcgaaaccctaagcttaaatgatcctcctgccttgggctcccaaagttctagcattgattacaggtgtgagccaccatgcctggcccatttttatatatttattttgatttttaaaattcctacttagatgctttagatcatgttcagcttggatcacagatttttttgtatgagctttatctagtcaaccagtcagcactgaccactctgtcttctgtacttctttaaaacttgttcatagggctaaaatcatactcatcctgggtgccaggctataatctctgtgaatgttactaaattaatcagatcttttgtgaaagcaaagcaacctaagaaatgtaacagatttgctgagctaggcttaatgtcagttcaaaccctgtaattcattcattcattctctattcattctaccaatatttactgagcttataccatttgtcaggcgttgtgttaggcaccagaaatgcatagtggaaaataaagcctatcacgaattgtggggaagggggacaggaagatcttaggctcaagcctgatacttacaaaggacttcaaatttagctcttcatccttacattcaaagttataagtatatttttaaattaacagctttattaacatgtaattcagatagtataaaattcacctttttaatgtatacaattcagtggtttttagtgtgttcacagttatgcaactctgaccacaatctaactttgaaatattttcatcactcctaaaagcaagcccgtccccattgattttgtatcccacaatcttactgaactagtttattagttatgatagtttttatggattccttaagatttctatatacaagaccatatcatctgcatatagcaatagttatatttcttcctttccaatctggataccttttatttttcttgcctaattgttatgactagaatttccagaacaatattgaatagaagtgttgagaatgaacatcctccttttattcctgatcttagagagaaagttttcaatctttcaccttaagaatgatgttagctgtgggttttttgtagatgccctttgtcaggttgaggaagttagatgctattcctagttgagtgtttttatcataaacttgtcaaatgtgttttctgcatccactgagatgattatgttgtttctgtcctaagtacaatcattacagtattaaaattaatttgttaaggcaaatatttaaaatatactaaaattattataatagtggtttggatttcaatcattttcaatatatgaagaatttcatatattaaatgaaagaggtcaatttctctctagatctctgagagaccctggattcaaagactctattcttgtcctcatggagtttatggttatataaaataatttgttaattgttataatggagctccagacaaggtcaaatgaaggcatagtggaaatcatacccaagtttgcatgaggtaatcaagaaaagtttcaggagggtcaaatgactgaactgttagaggaggagtagaaatatgtggtggggtcggggactaaggaagggatctcagttagagaaaaccatgtgcatacaaagagttcctcagaaagatctgagctccacagtcccagactcaagacatagactcccagtgcatttgctgaaaggagtaatgaaattacaaaagaaaactaaagacttaaccatatagatattatgaaattctgtatgtcaaaaatcacaaacaaaattaaaaggcaagcaaatatttgttataacaaaaggcatataggcatatatctttaatgtgtaaagaacttgtgtgaataactaaagactaagatttaaaaaaaattgtggtgaaaacacataagatctaacttcataacaactgtttaagtgtacagcacatattgttaactaactataagcatagcattgtacagcagatctctagaacttattcagcttgtataactgaaactttatacccatgaaggagcaaatccccattcgcccccaaaccccaccccaggccttggccaccaccattccttctatttttgcttctatgattttaactatttttgataactaatacaagtggaatcatgccatatttgtcctgtgactttcttatttcacttaaaactaagatcttggctgggtatggtggctcatgcctataattccagcacttcaggagaatgaggcaggtggatcacttgaggtcagggatttaaaaccagtctggccaacgtggtgaaaccctgtctctactaaaaatacaaaattagctgggcgtggtggcgcacacctgtaataccagctacttgggaggctgaggcaggagaatcgcttgaacctgggaggcagagattgcggtgagccgagattgtgccattgcactccagcctgggcaacaagagcgaaactccgtctcaaaaaaaaaaaaagaaaaaaaacccaaaaaactaagatcttaatagaaaattgccaggatatgaacaaacatttcagagaagaggaaacaaaatatacttaatgaacatacaaaaagtttgaactttaaaacaataaattaccaccttttggctaccaattatcagacaaaataataatagttaattctggtgaaggcaagtacaacaggcattttcattcattgccagtgtatgtatattttggtacaatcttaataatgagctcggaaaaatatatatctcaagtcttaaaactattcaaatcatttaactcagtaactccacctctagaattctatgctaaggaaattatcagagatgtggacaaagatttttgcataaagttaataattaaaaagtattaaaatggccaggagcggtggctcacgcctgtaaacctaacactttggcaggccgaggcgggcagatcacttgaggccaggagtttgagaccaccctgggcgacatggtaaaaccctgtctctactaaaaacacaaaaattagctgggcatagtggcatgcacctataatcccagctactcaggtggctgagtcaggagaattgcttgaacctgggaggtggaggttgcagtgagccaacatcatgccactacactccagcctggatgacagagtgaaactctgtctcaaaaaagaaaaaaaaaataataatagatgttgttgctgtggatgtggtgaaaagggaacacttatacactgctattgggaatgtaaactggtacaaccactatggaaaacagtatggcgattccttaaagaactgaaagtacaactaccatttgacccagcaatcccactactgggtatctacccaaaggaaaagaagtcactatatgaaaaagacacatgtacacacgtttatagcagcacgattggcaattgcaaaaatatggaaccaacctacatgcccatcaaccaagtggataaagaaaatgtggtatatatacaccacgcaatactactcagccataaaatggaataaaataacggcttttttagcaacttggatggagctggaggccactattctaagtgaagtaactcgggaatggaaaaccaaatatcttatgttctcactcatagtaggagctaaactatgaagattcaaaggcgtaagaatgatataatagactttggggactagaggagtaacggcgggggtggtggtgagggataaaagacaatatttgggcatagtgtacactgctcaggtgatgggtgcaccaaaatctcagaagtcaccactaaagaacttatctggctgggtgcggtggctcacgcctgtaatccctgcactttgggaagctaaggcgggtgtattacctgaggacaggagttcgagaccagcctggccaacatgatgaaaccctatctctactaaaaatacaaaacattagttggccatggtgttgcatgcctgtaatcccagctactcaggaggctaaggcaggagaatcgcttgaacctgggaggcagaggttgcagtgaaatgagagtgcaccactgcacttcagactgggcagcaagagcaaaactccgtctcaaaaaaacaaaaacaaaaaacaaaaacaaaaaaacttatctaagttaccaaaaaaaccacctgtgtcccaaaaactattgaaaaatttttaaaagtactataaaaccacaaatgtccatttggggtaagcaagttatggctcattcaaacatagatttcttatacaactgctaaaattttggcctctaagaactgttcaatgatatcttttcattttatacttgtcttttgtagattctctacagtgagcatatatttcatctatattcagaaaaagaatttttttcagaaaatgtttttaaacaaaaaaaattttttaactttcaagggaaaatgtacacttttaatctttctccataaaaaggaacttcagtttaaggattttcgaggttaaagtctggacagctaaaagtatttccttagaactcttcttcacaatcccttaatcttgagggagtgagagatttataaacctaatctctagaggaagaaaacccatggtgatatatcccacactcttagacagtggcactatttgactttcaatttttgggtctggtgcaccagggctttttcttagggggtggggtttggggaaagcctttacattttgagaaccactaagtaagaggctgagaacagagtttagatctaagagtcatgctactcaaagtgtggtctgcagatcagcagaatcagcttcatgtgtgaacttattaagcacagataaatacttgggccccatgccagatgtactgaatcagaatttcaggggtgatccgggtgatttttttttccatcaagtttgagaagcacatgtgtagaagtattggacaaagagaccaacagtactcaaagggaaagaggtgcagagccctcaatgttcagtgtatattttttagaagtataaacattattaaatattctaaaaacaactattgttttcatattataaactagaaagcatggctagaaaaaatatcttgactcaggactagagtggattaaaaaaactagcataggtcctaaactaaaggaggaaaaaaggatctataattcatttctggttccatgaaactcattaaattaattaaggctaaggatttcacataggaatttggagactgtatgtatgcagcacatattttggttacatgtctctcgaaccatggttggctgctactggtgcatggtcagttgaagactatatatatcccaaacccaaccatttatctttatctctttctaccttggagtcataactcagtagaagaaatatctgtatcagtgacatttcttttgagatggagcctcactctgtcacccaggcaggagttcagtggcacgatcttggctcactgcaacctctgcctcccaggctcaagcaattcttgtgcctcagcctcgggagcagctggaactataggtgccccccaccatgcctggctaatttttttatttttggtagagacagggttttcccatgttgccaaggctggtttcaaactcctgagctcaggcaattcaccttacttggcctcccaaagtgctgggattccaggtgtgagccactgcacccggcctgtatcagtgacttctgaactattctttacagagctccttcaggggactttgaaaaggaagtgaaggggatgtagatgaaaagagggaaacctgaacaggttagactacttctcccaactccatgcattcaaccaaaacagcccaacttttatctttctgagtccctttcctgtagaatatatttgaacaaaagtctgttttaaaaaaagtttgaaattctttattctctactatagattctcacaggccaataaaaagccacagctgtctttttttcctcataagataaatgctccttgttagctattcatcaccaccacttggttgttagaaaggactcacaaatgtataatgaggcaggtgatcctgcttccagccctcctttctccagccactatcattaaggatgaataaactaatacagttgcaggttgctgtgttggatatcaggcaaagaacattatataaactgaaagagacactatgctatctaagaagttaactatagctataaatataaaactaaagagagcaatattttaaagaatagctcttgtatgaccaaataagatatgtccttcaaagtggtcacattggttatgagggaataattggcaagaggaaagaatttttaaaactctaaaaaacaaagtagccaccttgagaaatttaactcattccagtagtgctcctagtaaaagcattcttagaactcttttcagaagtacaaaaaaccaccagcccatccacaaaattgtgaaataaaatcaattgttgttttaagtcactaagttttggggtgttttgttatacagtaatagataagtaagtgatatggtctggctatgttcccacccaaatctcatcttgaattcccatgtgttgtgagagggacctggtgggaggtaattgaatcatgggggcaggtctttcctgtgctgttcttgtggttgcaaataagtctcacaagatctgatggttttataagggggtttccctgcacaagctctctctctctctttgcctgtcatctatgtaagatgtgacttgctcctccttgcctttaagtcctttaaacctctttcttttgtaaattgcccagtcttgggtatgtctttatcagcagcataaaaacagactaatacagtaaggcagaaacgtctgaatcactaggctttgggagatgtttaaaaggaaatcattagtcttatagaaaaactctagctatccggaactctagaaaaataagctgttctgtttggctataactttaaataaatagaatacagccaactttaacaaagtttgactgtatctttaaacagaaataaacaactttcaaaaaacaagtaaagaacattttggaagagaaacaacttgaggatgaacgggactagtagtaggttcccaactttctcccctgcagtttttgctttttaccttgggttcatctaaatcctatctatgctgcctttaggagaactttgctctttttcttttgcctgggcgtggataaaaataaatgtccattttccctaagtacactaaatacaagggtgcattttctttttttaaaaagaattatacaggaaaagaaaggaagcacaaagtataaaaacagataaattaaatacagatttttttggatcctaagataaacaagttaagtatagacttttgatcctaagataattaaactttagccagaagttggctggccctatttttctttccacccagttatcagtctattgtccttgtctgcaggaactcacacaagaagccaaaaatacaacacatacctcagagtttaccatctcattttcttgaagataaaagacttttattaaaccaacaattccaaggaacagagggtttcttcctaaagtatcaaaattaattttttaaaaactttaagtgttttggcagaactttttaaaatgtattatgtaggctataatttaacttttcttgatgactcactactattttgttttttgtttttgtttttgagagtttcactctgtcgcccaggctggagcacagtgacacaatctcaactcactacagcctctgcctcctgggttcaagcaattcctgtgcctcagcctcccaagtagctgggattacatgtgcatgccaccacgcttggctaatttttgtatttttagtagagctgggcttttaccatgttgcccaggctggtcttgaactcctggcctcaagtgatctgcctgcctcagcctcccaaagtgctgggattacaggcataagccgccacgcctggcctcactactgttaacattaataatataccaggctaaaataatgttgttttcagtgtctattaaggacttgcataccaaatcaacaatcccataaggattgtgtgttaagagaaatggttcacttttgccatttcttttttctttttttgtttttttttttttgagatgtagtctcactctgtcgccaggcgatctcggctcactgcaacctctgcctcctgggttcaagtgattcccctgccttagcctcctgagtagctgggactacaggcacgcaccaccacacccggctaattttttttttgaattttagtagacatggggtttcaccatgttggccaggatggtcttgatctcctgacctcgtgatccacccacctcggcctcctaaagagctgggatcacaggcgtgagccaccgcgcctggcctctttttctttctttttttgagacagagtcttgctctgtctcccaggcttgagtgcagtggcatgatctcagctcagtggcatgatcttggctcactgcaacctctgcctcccggggtcaagcaattctcctgcctcagctacccaagtagctgggattacaggcaggcgccaagatgcctgactaatttttgtatttttaatagagacagggtttcgccattttggccgggctggtctcaaactcctgatctcacgtgatctgcctgcctcagcctcccaaagtgctgagattacaggcatgagccaccaaacctggcattcttttgccatttctatttaacagtcctggaattcctacctgagtaattaggtaagaaaaagaaataaaaggcatacaaattgggaaaaaaaaaaaaccaaaactaaaattatctctgttccaaggttacacgatcttgtatggagaacaccctaaagatgccacaaaaacattagaactaataatgattagttgcaaataccctaagcattttttagtgtcagcaatgatgcagggtacaaaatcaacacataaaaaccagcttttttatttaattagctgagaatataggcaaagttgttctactgtcctgtagtacatgtataattttcctatggcagttacaacaaaagataggagaaacaaagttccgtctaagtgtgacagatgtagatacatatctttcacaatgttccacagggacagagaagtgataaatcctgcaccaaaggagtgaaaggaggagactgaatctgcatgcccaatgatctcatgtttaatagcctctacatctactaatgggcccactgccaatgcaagagggtcagttaagtggacatgagtgtgcatatcattaataatatcaatgtctttaatgtctgcagttaatgttttaatcaccctaggtctggagatcttcttggggtataatgaagatcttgttgtcctaagatagcttcccacagatgtgtttattaggatatacaatctgctgccgacttcaggagaagtagcatatagtattcggatatatggctggtaatacataattgtgatgttcttatacatggccaggggatacagagttgttgacccatggaacaaattctacccaaatgggtttgcaacaccaaaacaaaacagttctccagtttactaacccaattaagttcttttcatccacaacagctcaacaaatggggtcatatcagtaaggggttgtacagtaaagatctgcaagaaaagactgaatgttgcttctcagtgatggctgcactatcaattaatgggttcaacatatccacaatgtactgctgtgtcgtatctctcttccctcaatgagaaatcatgacaacttggccagatgcatctgaacagtctacaccgaacctgtcatctagaaacttgtactcactctctaaggggaaggacaggagaggtgcagatcgtcaaactttacatgggttggatgctcaagtacttgcccattaaagatgcttgactgtgtagtcactattcgttttgtgaggattaaatgccagattcaagtatacatactcatagtttaatctcagctatgccaggtgtgctcagtatcagtggggaagatgagcaataaagacaattttaaccttagcgtcctctaggcaaaaacataactgtcttttgtacagctgtcaagtgagtggccatgtgtcagggccatttccacaataacaccatgtagtgcatggatctgttacatattgttttactatagtatatccagcttaatcaggtgcagggcgacagttgaaggagtactcctggaaaatgcctaagatatgtagatctctaggatcttgcaccttctggtggttgcatgaaattcttcagaggaatcatcagtgatagtaaatttacatgttacattcataacaactcttatgggaaatttaggatattcaaataggacaacaccaggaattgacgtatcacagaacttggtttacaacagtccgagcatggatcccatgcatcaccttcagcaggaggggcagatgggctggccaagtgcaagcttgatagagcgggataagtgactgcaggtgcaagagacatagcatctctaaggttagccaacccttggggagcctttgtagaaacaaaagaagatttaatgcaccgagctttgtttctacgaagatgaacctgttatttatggctcaactggtgatactgcctgacttaattttaagtcgagtttctctagagacttctgtttcctgttgattctctgtgatcctctctgagagcttcctgagaacccgctcgattgaagtttggctctctcatgcctcaacctctgcagcctcgaggtaggtctccacttgttgcatgcttctcgttcggactctgtctagatctaagccctcctcctccactgcttactcaaccactgactcgagagtttctctggttactagctcgctcatcactctctgatgcttcttttgctttggtgtaattttcttcatctgttttggagcaactttatccaatcagctgtatgcctaaacactaacaatgaacaatctgaaatggaaattaaaacaattccatttacagtaacatcaaaaagaataaaatacttaggaatgaacttaaccacggaagtgaaagacttgtacactgagaaatacaaaacattgctggaagaaattagacataaataaatgaaaaaacatctggtgatcatgaattggaaaacttgctatcattagaggtgtcagtattacccaaagtcagctagagattcaatacaatccctatcaaaatcccaacaatgttttttgcataaatagtaaaatccatcctaaaattcatatggaatcttaagggatcctgaacaaccaaaacaatcttgaaaaagaaaaccaaagttggaggacttacattcttgattttccaaacttactacaaagctacagtaatcaaaacagtgttttatcagcataaagataaacataaagaccaatggaagagactagagagcccagaaataaaccctcacatatctggtcagatgagttttgacaagggtgtgaataccattcagtggggaaaggtcagtcttttcaacaaatggtgttggaaaaactggatatccacaagcaaatgaaataagttagacccttatcttacattacatacaaaaattaactcaaaatggatcaaagacctaaagataagagctaaaactatatgtataatatatataatatataaaaaatatattttatatattatatatatcatatataatataaatatatactttatatataataaattatattataataaaatatattatatatatttaataaaatatatatatatagtatatataatgtataatatatactatagtgtatataatgtataatatatactatagtatatataatatatactatatataatatatactatagtatatattatatatactatagtatatataatatataaaatatatactgtagtatatataatatataaaatatatattatataatatatataaattttatatatgtataatatatattatatataaattttatataatatgtataatatatattatatataaaaaacaagaaaacagagggaaagcttcatgtcacttaatttggcaatgattcttgggtaagacaaaatgcacaggtaacaaaagaaaaattagataaattagatttcaaatttaaaaactttcgtgcatcaaaggacacttttaacagagtgaaaggcaatccatggaataggagaaaatatttgcaaatcatacatctgagatggattaatgtccaaaatgtattaaaaaactcttacaactcaacgacaaacaacccaatccaagaatgggcaaaggacttgaataggcatttctccaaagatatacaaatggccgataggtatgaaatacatgaaaaaatgctcgatatcttttcattagagaaatatgaatcaaaatcatgagatatcacttcacactgcttaggatggttatattactattattattttgagatggagttttgctctgtcactcaagctggagtgcaggggcatgagctcagctcactgcaacctcagcctccccggttcaagccattctcctgcctcagcctcctgcctcagggattataggtgtgcgccaccatgcctggctaatttttgtattttcagtagagatggagttttaccatgttggccaggctggtcttgaactcctgaccttaggtgatccgcccgcctcggcctcccaaagtgctgggattacaggcgtgagccaccatgcccagcctaggatggttgttatttaaaaaaaaaaaaagaaaacaagtgttgccaaggatgtggaaaaattggagcccttatgcattgctgatgagaatgtaaaatgctatagccactgtggaaaacagtggttcctcaaataaataaataaataaataaacataaacataaaattaccatacaatccagcaacaccacttctgggtatatacccacaagaactaaaagcagggactcaaacatatctgtacactcatgttcacatcagcatttttcataatagccaaaagatagatgcaaccaaagtatccatcaaaagatgaataaacagaatatagtgtatacatacaatggaatattattcagcctttaaaaggagtgaaattctggccaggtgcagtggctcacacctgtaatcccagcactttgggaggctgaggctagtggatcacttgaggtcagaagttcgagaccagcctggccaacgtggtgaaaccccctctctactaacaatacaaaaattagccgggcgtggtggcgtgcacctgtaattccagctactcaggaggctgaggcatgtgaatcacctgaactgggaggcaaaagttgcagtgagccaagatcgtgccactgcactctagcctggttgatggagggagactctgtttcaaaaaataaataaataaaaataaaaggagggaagttctgatacaggctataaagtggatgaactttagacattatgctaaccaactgcagcactatttacaatagcaaagccacggaatcaacctaaatacccatcaatgacagaccagataaagaaaatgtggtatatatacaccatggaatactatgcagccataaaaaagaatgagatcatgtcttttgcagaaacatagatggagctggaggctattatccttagcaaactaacagaaacagaaaaccaaatactgcatgttctcacttataagtgagagctaaatgatgggaatgtataaacacaaagaaacaaacagcagacaccagggtcttcttgagggtagaaggagggagaggagcagaaaagataactattgggtaccaggtttaatacctgggtgatgaaataatctgtacaacaaacccctgtgaaatgagtttatctatataacaaaccctcatatgtacccctgaacctaaaataaaagttaaaaaaaaacccaaaaaacaaaaaaaggcattatgctaaccgaaataaaccagtcacaaagagacaaatagtgcatgattccacttatatgaggtacccccagtagtcaaattcaaagatagaaagtagaatggtggttgcctggggcggagtagggagaaatggggagttagcatcttactggtacagagtttcagtctgggaagatgaaaaaaagttctggagattgttatcagtaatggttgtacaataatgtgaatatatttaatgccacttaagaattattacaatggtaaattctatgttatatatatatatattaccaccataaagagtaaatatggtacagcacaggttctgctgagttattttgttgttgttaggattcccttctaccccatcacctagctctatcagagcaatgttgacatctggctactcaaaatgatgctctcgtttcgtatgacggactcatttgacaaaaattatattaaatgccaatgtctgaatgggtgttttttttttttcctgggtaacttcaacactgatcaatcaagaccatttctagatagcctgcccttaccctaacatgaagtgaaccatctcttcagtcaagtgacttttagcagggtgcatagtcattgtgtatgagtaacaggaagaaaagggtgagttattatcctaaatttgcagataagcccagagagaaaaatagaacacataagccctcccatgaacttgccagatttagcaagtaaaaatacaggactccctgttgtttatttgaaattcaaatttaactgggcactctgcgttttatctggcaacactgaagtattggaggtgaggagaaaaataacccagggtgttctggggtaactgaggtcttaacaggaagcctagacaggaaaaagtagaaaaggccattaaaaagatactgttaaaaaaaaattgtattgcttaatccatccagatcaggagcccctccccacactgggtttctatgatccaaggctttattttgagacagagcattgctctgtcacccaggctggagtgcagtggcatgatctcagctcactgcaacatctgcctcccaggttcaaggggttctcctgcctcagcctcctgagttgctgggacttcagcctcctgagttgctgggactacatgtgcacaccaccatgcccggtaatttttgtatttttagtagagatggggtttcaccatgttggccaggctgatcttgaacttctgacctctagtgatccgcccacctgggcctcccaaagtgccgggattacaggctgagccactgtgcctggcctgatccaagactttataaagacatgtaagagggtgggagacagaaagcggaaaaggatacatcaaaactagcaatggatgaatgagaacatgtccagcctccagttaaggcaactgtggcttcaaaaaggaatcttaaataccagcacagaaatcagagggatcctaacctggctcaaaacagaagagaaacagtggctggccatacagcaggacgggcataactaacagaataccaggtatactgtttggatctgctcttccttccattaagccatccaccactgcttaatatctaaggagccggctaagaaaatccagtcactacttttatttgctaatactttgagccccagttacaataatgccactactaattaggtaactactttctaccttatcaactcctacagctttccagccattgtttcatccctcagcgataccacctgcttccgcgtggaacccaaacccccaggaaactaaatctgctcaggtcacccacctaggaataaataaaaacaggtttcaggccctttgtcctttgtaaattccgccttttttttttttttaaggcctgtgttctttatcacggacactgttcacatagtggtaatccttgcctgactcagatctacttgttcctgcgtttcattcctccgctgctcaattacttgttcaaaacgcaaaggacaactggtagtgaagaccctccaccagcaacactaccatgtgccaggcaccgtgctggggaccggggatacaaagatgagtagtgtaccgtccttgcccccaggacagttccccgtgtccgcagggccggcctggagggccacagccaactgtgggcaacaggatcaccgtgcccttcgcggcaagtgagtgcagtagtaggggacggttactgccaagccaaaggttttctccaggtaaaactggatgacagagagacagagactgaagcaacgccggcgccgggcggataataaagggaggcaggggctaaaagggtggagggagcagaggacccggccgggaactggcagtagggaggcccccgctgcagtcgccggcctgggtgccgggcggccacgcttccccaaagccgtcacagggacttggggtaccaaggtgactactgggcgcgagtcgttttgtggggggagggtgtccccaagggggcagtttgaggagacggttggggatgcatctggggtggcgcccaaagggacggtgggtgctgggtgtttgaaggtccggtggacgcagagctgaagggtcaggagaaggccaagggtcagaagggctggggacgaggtctgcccagggggtcggggcggacgcagagggcgggtgcagccgagggggaagggctgaagggaagggcaggcgctgaaggcacataggtgggaagacaggccctcccctaagggagaccttggaacgcggggcagtgggtctgtgggaccctgcccgcctccggagaggcgttcctacctcgtttctcgcctcagcctcgtccttccgcgccggcggcggcggcggcggcggcgtgtctcgccctccaggggtcgcgttgcaggctagaggcgccggcggcccctccctccgggcgggttggaaaggccggcccctgtcggcgtggcgcgatggtccgatctgggttgccctcaggccgcccctccgggcggcgcgttggttcggtccgcccggcctaaggtgctcgccccctccccggctcccgcagcgatgggcgcagccgagtcacgcgcagagctttcccgctaagggagcggagaggcttccgccgtggcccaatcttctgcggcccgcgcccgcccccgcggggtggtgcctggcgacgcgcggctcccgggtgctggaacccagggaaaccttccgcgggcctccagggccggtgggtgtgagtcccagcttcgcctgaggcggcggttctcaacgctggcttcccagtagaacctagtgtggaaactaaccaaacaacagaaggagggctgacctcacactggaccgactcagaaccactggggtggagtggggtggggtgaggtggggttggcctccagtgcatagccagggttcggaacccctgatgaaacgtagaacccatgcgccccctgcccttcagggccggatgtgtgggggacatggaagatgcctgtgtgtgactcctgctgtttacagccagagggggatggggcaggcagtcctgcaaatgttatgggaaacccactgtattagtccgttctgacactgctatgaagaaatactatgaaggaaagaggtctgactcacagttccgcattgttggcgaggcctcaggaagcttataatcatggcaaaaggcaaagaagtagccatccttttcgcagggtggcaggacagagtgagtgcaggcaagggaaatgccagacgcttataaaatcatcagatcttgtgggactcactcactgtcacgagaagggcgcaggggaaaccagccccatcatccaattacctccacctgttcccgcccttgacacagggggattatgggaattacaattcaagatgagattttgggtggggacacagccaaactgttacaggtagttaggcatgagcggggcaggagagggttctcccctgctacccactagggatgttgggtgatggttctgaggcaggagaatagggactggaggcagggaacctaagactggttcatgccaacttcctggaactaaattgaaaggaaaaccctaactttccacacctaagtaacaaaccccccacccaacttttctgcccagcagatgggaaattggctatctgcaaccaattagactgactgcagccgagtctaactttgcatagaagtataactttgtaacttcaccctagcctctgattggttgcttcttgcaaccaatcagatgtttgcacaggtgtgcgacctttgtaacttcacttcagcctctgcttggctgctttctgcaaccaatcagactgattgcaggctacgaattcatttacatgaggtgagcatgaagtggcgggtaacttctagggggtatttggacccaagaagattctgtttcctggcccttgagccgctgctccggctgctcccacactgtggagtgtgctttcgttttcaatacatccctgctttccttcttttgttccttcattctttctttgctttgctgggcgttttgtccaattctttgttcaaaacgccaagaacctggacaacttgcagtcagaccctctaccagtgacagttccataattacctcattgcttctttaaaaaggataattcggctgggccagggagaggccatttcctgatggtccacacatgttaacatcaaaatgctaattgaatgcaggcctcagggagaagcaactttctgggcatgcgtgttaagagacaaaaatggtgacgtatgatctcctgggggcaccctccaccggaaaacgggaaggaaagcactgcgcattcgggaagcccactctaagggaagaatcatgggaaagaggccagcctgtaaaagtcctaggatcttggttaggcacttgaccttctctctttaaccttcacgtgcccgcttgggtttcttccaagcgcaccttcctttctttcctgttctaaggcctttttaaataaacttccattcctactctggaacttgccttggtctctttttctgctttctgccccacagtcgaattctttcttctgatgaagcaaggactaaagttgctacagacccataaggataggctgcaggtaacttggggtaactcagacctcttccaccactaacaaaaccatatcacccattgagaagactcttaggctagacgcggtggctcacgcctgtaatcccagcactttgggaggctgaggcgggcggatcacctgaggtcaggagtttgagaccactagcatggtaaaaccccgtctctactcaaaatacaaaaatcagccgggtgtggtggcgcatgcctgtaatcccagctactcgggaggctgaggaaggagaatcacttgaacctgggaggcggaggttgcagtgagctgagattgcgccattgcactccagcctgggcaacagagcaagactctgtctcaaaaaaaaaaatagaagactctgttctaggttccatactcactgaaagagttagagactggggtcacagtcaaggaagcagataaatgtcaggatatgtagcttgtcttcaggcttcacagaagtggtgtgagctgaattttgaagaatgagtgggaggtaaagagagaattggcatgtgcaaaagaactgaggggcaaaatgaccaatgtgattgagaagtgtgggaggcaacggagacagctgaggagagctggtcagggtttggtgatgaaacgcctatgactactaaggagttgggagagatactgaagggctttattgcagaggcaggaatgacaagatcaaatatgaatgttagaaataaagttctaagggcttaaataagggtgacatggagagagctagcattgccagtggggaaccaatgaggaattgcatgtttgcacagtgtgatcccccagttaaatagtctgggttggggaattaagccaaaccaggccaattagaattacttctctaagaatttggaattgggagacaaagagctacatctctgctcagacttaaattggacttaagggtaatttgggagctatgcagtagtcatcttctacttgcccatttggcctgagcagcattgaaaaccagtttgctgagaaagaagatcaatcagttgcacacagagaagcaagtctagacacaaaaagactgctccctaggttcttgggaccttccagcagctggttccacttctttctgaggcccagcaggattccttccccaggatcatgatgcatccttctatccattcataggaatctcatttttggcttcagcgagtgtgggttacttcctgttgtttgtgttaaagaataactttcaaaaaggtaaaataatgagccttatgcaagtatttttattttttattttttgagacaggttctctgttacccaggctggagtgcagtggtgcgatcatggctcactgcagcctcgacttccgggcttcagcgatcctcccacctcagcctccagagtagctgggactaaagatattttttgcatttttggtagagacagggttttgccatgttacccaggctggtcttgaactcctgagctcaagcaatccacccgcctccacctcttaaagtgctgggattacagacatgagccactgagcctggcagagccttatacaaatatacaatgaacatatttcaaattttttatttaactaatgagggaaccagtaagatactaaaaccagttcaaatgaagatttgacttagaaatgtcttttctctaatggacaaaatttatttgcatcacccagaacaggaatcgtttgcactgttatgggcagaaaatcttttgtattatttattgtcagtattctgaagttaacttctaactccaacgagttagaaaatagcttacttgtaaaataggaacctagtcaaaggaaatcaaaggctctcaccgctaatataatcaaataattcccaaagattcttaacagcacccaacattccattaaaaagacacccatttcaaagtatttcttaagttttccagacacttgcaaatcaaagaatatacgaaaacacagagacataagaaagcatgatgctggccgggtgcggtgtctcacacctgtaatcccagcactttgggaggccaaggcaggcacatcacctcagatcaggagttcaagatcagcctggccaacatggtgaaaccccgtctctactaaaaatacaaaaattagttgggcatgctggcaggtgcctgtaatcccagctactcaggaggttgaggcaggagaatcgcttgaacccgggaggtggaggttgcagtgagctcagattgcaccattgcactccagcctgggtaacaagagcgtaactccatctcaaaaacaaacaaacaaagaggctgggcacggtgggtcatgcctgtaatcccagaactttgggaggcaaaggtgggtggatcacctgaggtcaggagttcgaaaccagcctgaccaacatggtgaaaagcccacctctactaaaaatacaaaattagccaggcatggtggcacatgcctgtaatcccagctacttgcctctctgaggcaggagaactgcttgaacctgggaggtggaggttgcagtgagccgagatcacaccattgcactccagcctgggcaacaagagtgaaactctgtctcaaaaaaaaaaaaaaaaacaaagaaagcatgatgccttagggaaactcaagtagtatgggcattagttaagcatgggcaaagtgtaggagggaggcaacagcaagattaggaagggccttgtatgtgtgtttgggagtttggattttattttcttgagatggagtcttgctctgtcaccccaggtggaatgcagtggtgtgatctcggctcactgcaacctctgcctcctgggttcaagtgattctcctgcctcagcctcccgagtagctgggattacaggagcccgccaccacgcccagtttcaccatgttggccaggctggttttgtacttctgacctcaggtgatctacccgcctcagcctcccaaagtgctgggattacaggcatgagccaccatgcccagctaagtttggattttattctgaaggctgttggcactattatttcatgcaggggagtgatgtgaacatatctgagctttagaaatctcacttcagtaggagtgtggatattgaattacaggaaggtaatcaatcaaccagttaggagattgataattatgatgagaactgaaagagtctgaattagggcagtggctgaaggcttagataagaggagatagattcaaggatgatttagggtatagaaatctgtagaatttagtgattaattgaatgtgtcatgggggtgggtggggtaacatacagcaaatagtcttgaatgactcccaggatcctccaaatgatgtgtcttttccaaaacgcttttcatgaatcttagaagatttggtagataatttggagctggaatcacagggatatgttggggctaggacagtgttccttgttcatttctttggggcaccacgaactgcgcctatagaagatgccaaacttaataaatgcctgttctgactgctccaccaacccgtcattcccatctttacctctcctcaggcctccctattccctgagacacaacaatattgaaatcaggccaattaataaccctaaatggcctctaagtgttcaagtgaaaggaagagtcacatatctgtcacttgaaataaaaagctagaaacgattaagattattgaggaaggcatgtcgaaagccaagacaggctgaaagctaggcctcttataccagttagccaagttgtgaatgcaaaggaaaagttattgaaggaaattaaaagtgctattccagtgaacacacaaataagaaagcaaaacagccttattgcagatacagagaaagtttgagtggtctgtatagaagctgaaaccagccacagtattcccttaagccaaaacctaatccagagcaaggccctaactctcttcaattctatgaaggctggggaagaagttacagaagaaaagttggatgccaacagaggtgggttcatgaggtttacagaaagaagtcgtctctataacataaaagtacaaggtgaaggaacaagtgctgatgcaaaatgtacttagtgaatggtcctttttagtagcaaccagtacttgtcactttaagtttcgctttagtagttaaagtgatttaatgaaataatttttaaaaacttcaacctttacaattaatgcttttccttatctttcagctgggctgctgcatgtggccaggttcagtgggctttgtagatgtctgtttttctacttacccctcctccctccttcagcttgctaattcttttttctccggggcttaagcaggacaggagagggaagagatgaagaaagcctttacttgactaatacagtcataaactaattttaaggcttggcagataagttaggcatggtggctcatgcctgtaatcccagcactttgggaggctgaggcgggtagatcagttgagaccaggagtttgagaccagcctggctaacatggcaaaaacccgtctctactaaagatacaaaaattagccgggtgtggtggtgtgcacctgtaatcccagctactcgggaggctgaggcagaattgttggaacctgggaggcagaggttgcagtgaaccgaaatagcgctactgcactccagcctgggcgacagagtgagactccatctcaaaaaaaaaaaaaaaaaaaaaaaaaggcctggcaggtatctaaagttgactcgttttcaagaggtccttttataggttcttcagaaattctctccccattggtggagatatctcttctatagtgagttacttcagtgtgggtgaatctggctcctgtggttggtcacttacaactccattaaaaatttctagacattaaaaaactcaactttattgagatatagtttacataaaataaaatgtataaatcttaagtatacaggtcaatgaattttgacaaatacatacccatgtaaccacctccaaaatcgagataaagaaaattttccttatgccccttctttctttcttagtataaatccacaggcatttgacagcatatcccctgcttctttctgctgaagtctcctcaaaatttcagataatttatctaacgagatcaagaaacgctaaagacatggcccatatccggtctatgggtagcactcatgcatcccttgcttataaatgggaagtaattgtcactaaattatacctttttaaatggttgattttattttatgtgatgcctcgatgggaatatgtttgtgtagggccctgggaaggtttatgcttgctctgagtataggagatagggcccaaagtaaaattcttaggttccatcttcttttcccttccccatactgtctcttgtcaccccctacctctacatatgcttgtctggattaaaacttgcaagagatggtgggaggcaggcctgaggttgctttttttttctttttcttgaaatgctgcaactctggcagatatctgggggctctttccttacccctccttgcctttctgggaatagccttctggacaattaagaggcttagtccctagtgagaatgaaggagcaggtttatgctggtttcccagggactctaattcttcctaagttgcatgagtacgagggaggaagagcactgactgcctcctttggaatttccctagggcctctatctttttcaaaaaaagggtgtttctcttggacatcctgggcttcactatcttgccagaagtgatgagggccccaaagccttgtttatgggagaatgcataggcagaacgtcgagtgcttgagtgtttcagtttggtccagactggggactgctgtggaagtctcctgcactcttgaattctgtcaaaaacctatagccagagcatgggggatagggttttcatccacagaggcaaaagcaaaagaaggtcatgaattatatctgcgtagattttctgttgcacttactttgtccatgctgataggccagaatagtggtttaagaaattggtgcccaatcacaggcaacatacagaggaccacactgaggataatgctcagcagcatttgcggctggttcagagaattcctgaccacacctgtaaacagtgagccaggaggggaaaggctgaaacagagcctggaggaccggggtaggaccaggggtaggagttaccagccagaacgtagacacctctctagtccaaagaaggaagttactgacttgtagttagtttaggctcctgagaaataatataaatacaaaagaattgtagttgggtcctttgtgcagccaaagtcactgtgaatccatgtgcctctctctccctctaaaggcagggcagggtagggcaggataggagagcaggggtaagttatgagggaatcctagagcactggcttgcatccaaaaatgggaaagaaagctttggaggaggaaaaaacaaaaaaataaaaataaaaaaggtaaaaaaaaaaaattaaaaaaagaaaaaaaaagatttgaaggagaaaaataagttagtggcctgacaaaaggtgagagacagccaggtgcggtggctcacgcttgtaatcccagcactttgggagccccaggccggcagattgcttgaggccgggagtttgaggccaccctggccaacatggcaaaaacacgtctctaccaaaaatacaaaaaaatgagcagtgcatggtggtgcacaactgtagtcccagctagtggggaggctgaggcacgagaatcgcttaaacccaggaggcagaggttgcagtgagccaagattgcaccactgcactccagccaaggcgacagaggtagagcaacagagtctcaaaaaattaaaaataaaaacaaaaagatgggagccaactacatctacatatctactctctatattttgtcttcagcaaagtggagatgagagagagggaaaaattatgggagacaacaaggcgatatgccacagcataaaggacattgaactggaaccaggaaacctagatttaagtcctttaattaaaaaaaaaccctccggtgtctaaaatggctctaaaaattgttgcactgcctacctcttaggatgctgataaatagcaaatctcgtaagacatttgaaaataccttggaaactcaaataaggtaacttatttccctagctacattttgagcccttttagggcagagaccatgtcttatttatatctctagcctagcacatagtaatggcttctcggtaaacatttattaaataaatatacctggttccccaccctccgcccactgggcagggccttacctaggaattggaagacgtcagggaatactagacacaagccatcgctgtacaggaggaatgacacccaaaagtagaaacccaggctaccccagatgacaacatggtttatcattgtccagtaggttgtcctcagggcgatctgaaaagtaccctcttatgggacctgtaacctgggacctgtcagctacctcccccctccaattatgtaatgaaggttgctcccttcccacactctcaccctctattcctcccactctttcagagaggcccccacccaatccccttacccccaccaccactggccacacctgcattgcgaccacccagatcaaggaggtctgcaccaccagggagaaggactggtagtcggagatgtccttcccatcatttcgttctgcattgtaaagagcccccatggggacaaagaacaacacgaaggaactgtagatcccatgcattaaacacttcacaaattctttcttgttgaaatagaggttgtgctggcctggctcatacagctctgggaaatggaggctccatgtctcattcacatcctggaagcacccgagggtaaggagggaggctcagggtctctccatagaaggtcccatctccatcagagtagaggcttctcccctcaccaggtctgctgccaggctgcctaggagcttccttatgggttactggagaagtggaaccagagaacacagcagtgaccacagacccttcctgaagtcctactctctaggcaaggatctgggtagtggaaggaagctgggagaagttcgggatgctgggaaggacttggagggagttagaattggggagttatgaaagggagcaactaggcttgtgggtagctgggagggaggactggagcttgagatgggggaggcagctgggacataagtccccaggtgtaagagttctttcagttgagatggagtcttgctctatcacccagtctggagtgcagtggcaccatctcggcttattgcaacctctacttctcaggttcaagcaattctcttgtctcagcctcctgagtagctgggattacaggtgtgtgccaccacacctggctaatttttatatttttagtagagatggggtttcgccatgttggccaagctggtctcaaactcctgacctcaaatgatccacctgcctcggcctcccaaagtgctggggttacaggtgtgagccaccgtacccggccatagttgaatattctttatgccaaaagtcaatatgggagaaagcaacatcaatggggaccagttagtcttttagaggtattcatgttctgtgaggtttctcccactcccatagctactggtgaactgaaggtgaaaaaattactcaaagtggatgtcattggatcatcttcatctcctaactctgaaactttggatacaaagcttggggctggcttcagagatggatccctagaattaggccactgaagctggatggactgttgagtaatacaacccacccctcttgttgttctgaggttagcagttacttcctggagaatttcctttagagctatttcccatggagaccaagagccatgatcccatgatgtcctatttcagctactttattcctttttggagactcattttctactccatgtgcccaggactagaggttggggtagaagacaagggagaggtagggtcccaggaccctcaatttctgacagggacagacggtatcccttagtctggctccttatgatataaactatcacacccatactcccatgcctggccttcaggactccctcccaggccctcctgctttggcttatctcatcctcattatcgctgaaggagtctctcctttttgaagtcccatacgttacccagtcctaccccaataactctattttcttttctttatttttttccattcatattctgcttatgttatttaatttttccttatttttccatatatattttaattacttttatatatactcaatttactgtacagcacaatttccatgtttctctctacaaagataaaattgatacaggaaaacttggctaaaactgaggattattctctgttgaggaggattttttactttatctcatgatacctatctaggtgatgagctcttttccccgctctggaaattattccctttacactggattttgtagagcccagctcttgctgtattcttcattcttagggatattcctcaagggcccaggggcttcaacgctgaccaggggcttgctgctggatcttacctgatcaaacagactcatgcacaggacagggagggaagtgtagaccagactgtagcatgtgataaaccaggtctcataaactgtctggaagaataccaaggagattttgtaggctcctctcttctctacagtcccagctccaccttccaggtccaagatagccaccttcatccctcgacccctgcccccccgccccacccccacacacattaacctacagcaggagaaacctgactgagaatgttgaccccagtctctacttgatcctactttattagaaccctaggtcctaggatagagtaaggccacaccaagctttcaaggtggatctggaccaatcccaccataacctatacagccccgcacagaaaggacacagagtgattgctagggaatgctagctgtacccctgcattcctaggcaggtaaacctttgtacttttttttttttttttttttgagatggagtcttgctctgtcacccaggctggagtgcagtggtgtgatctcagctcactgtaacctctgcctcctgggttcaagcaattctcctgcctcagcctccagagtagctgggactacaggcacccaccaccacacccagttaatttttgtattttttgtagagacggggttttgccatgttggacaggctggtcttgaacttctgacctcagttgatccacctgcctcggcctcccaaagtgttggaattacaggtgtgagccactttgcccagtctttggactctttacttgcttagtggcattcagtggcttctgtagcactgcataccgcctaatattggcaagcagaatagacccaatgacccttccctggctggacgctccatcctgggacctagagagggctttttctttattagccacaagaggtcagcagcaacacatgcatacacatatgcctcccacaaagccgactggctttgctagggcttgggagaatacaaatctgctactatttgctgactggcctgttattcctggactctatggcaacaaaagtaggactcccaagataattgtttctgaggttgtttctcttgggaatccttgagatgcttctgaaaaacttctcataggaaaagggactcctcttagagcatcaaaatccaggtgttgcttctccccactaaggtgggggaggtttcacattcaaatgtggaatgaattcatcaaagtaacaattgtgtgtgtgttggggtcaggagtacaggctgtctgagtggggaaggagaagcaaagggaagctgtatttccgagtatggctataggtgaacgccatatctggcctatctggcatgacccagaggctccttgaggcttagcctgttccaaaaagatgactttggatgctaagaaaactccaagatccaggaatttgttcccactacatatgtttggaaattctaagtctcaacatcagtgaaaacagcttaagggaaagtttaacccaggtgtggtggccacgcctgtaatcctagctacttaggaggctgaggcatgacaatcacctgagcctaggaggcggaggctgcagtgagctgagatcgtgccgccgcactccagcctgggggatgcagccagactccgcggggaaaaaaaaaaaagacgagctgaggggaaagaatcatataaggggatagtcagatattaagaaagagagaatacaggattgactgaggttcctgaagaagtaggaagggatggaaactacaatatatagattagtactgaaggaaaaagttatacttcttttgagactgaaggaaaggaggtaaaggcgggttaaaatatatgtacagaggaggatatttagctgatagtttggatttttctcagtaaaatagaaggcagtatcatttgctacgtactggggagccaggagagtgtggtagaaggtctgagaatggtgattgtttagaaaagctgatacggagaataaaatatgaagccaattacaaaatggtgaaaaatttgccaagtggcactgggacagaggacagtggagtctctgaatttgtaatggttttatgatctccaaaatagtgcttaacactctcaaattagaaacagagcagggtcgatggtttggttaattcaaggttgagatttgttcagtgattaaagagaagaaaaggagaactagtaaggtactgaggatgcttatgatcccagggtacagacaggcaagctaggaaaggaagtaaagtcataaggaattgatagactggagaaaaaagaaagccaagggtttataaatctccatgagataaaaaagcaggaatacttttaaaaatctcaagtacgagccatgtactgagaatatggaggaataaggtttgtgatcaaagattgtgaaaagaaagtttataattccacattagtacaactctggacaattacatggtaacatggaaatgggtgatacagatttttttttttttttgtccaagagatcatctgaaggattctttcagagacctgaaagagtctacagtgataggtcgtccataaggatgacaataccacccaaaacaatagcagtggttgggaggggagggagaagtttcaaagccctcaatgaatggggtgtagaagccagaagcttcctagatatcaacaacaagaagagttacagatgagtatagccagaagtcataagcatcacaggaagaaagattgtgtaggagagaaaaactaatggttaaacatggcacaggataatgagggcaacacctttgggcttatggtatccagagtttatggtatgcagagtatgagagagatggaagaaaaaggaatgttctcagggaaaatcatgtttcaattaatgaagggattgaggctataggtaagtttgtttataagagaacaaaaattccagtgatttagtgaaaaatgtgttacggtcaatcagtagtggacagaaggagaggaaagaaactccaggagggatttactccctagaagctataattttgcctatattgccaaggtcattagccaagcccctggaagatgatttaaggcaaatcactgaatttccttccccttcccaatctctttggatggacaggggtaaggcaacagttgagaactggagtcagatgtttggtacataagtcaagtggctcagtttggaattgggtctagcaagacagagataaggtgaggaataccctgaaggcagcagaagaacccctgtgaagggacacttaaaaacaaatccataaacaaaagctgggtccaatactagagaaaacagtaaaaaccaactagagataagaagaatgaataggaagatatttttataattttataaagcctgttgaatatgtcacaaatccttaagttacaaaggaaaatgactgatagatttgattacatgaattaaacacttctacacaaaatattatttaacaaattaaaaaccaaaagacaaaatgggaaaaataattataacatatgcaccagaaaaaggaagagctagtatttttactgtataaagagcattttcaaataagaaaaaaaggccaaagaatatgaatagacagttcacaaagtaagtgtaaatgggcaataaagagatgataaggggaagaaaaataagcacataaaaatgattcaacctaattagtcatcaaaaaaggtaaattaaataattagataccatttttcatcaattaaatttcaacagattaaaaattgttaataccagttctgacaagcatatgggggaaaacaaaatgtcatatatttttggtgggattataaagttatgcgaatctacctggagggcaatgtggcactatttaatgtattaaaacgtggctaccttttgaccaatgaattttacttctaggactttattctaaagaaataattatcagaaaagtagacaaaatgtatgttccataatgattaccaaaatgtcatttgtaatcgcaaaggaaaatggaataaaaataagaaattaaataaattaaggtacagtgatacaactgaatagtggacacccattcaaaatgatgatgtagacctagacctaccgacatggaaagatgacgacaataatagtgtcaagtgaacaaaaggaaactggaaatagcatgcatactatgattttatctcccccatcttctagatctagatgtacatatgtgtgtgtgtatacacatatgaaaagcataggatatactccccaactttacactggctatctaaatgggatggaataattttaactttcttcacacatttctgtattatttaatttttttttttacagtgagcatggattattttttaaagagaaaaagccaataaagctatttttgtttaaaaagaacaaacgaagatcttcagaattaaacataggtcatttatataatgctttctgatattacaggaccagtaaaagctttaatatttcagtggctaagggagtctcgatttgtattaaggatgcttctctgaagcacagcctcactcagctcccacatgcatttcccatggagctgtaatcactcacctcagagaccgtcaccctctgtccatccttgtcataagtatcacctgttggtaagtgaacacagcagagacttggcaagggttttaaaggagggtttgaatttctttaaattgttgttaaaaaaatatacatatatatcacataaaacttgccattttaactattttaaatgtaaaatgcaatgacattaattatattcacaatgttgtgcaacaatcaccactatatatttccaacattttttcagcaccccaaacagaaacttcccattttttcccatcaccagcccctagtaacctctagtctattttttgtctctatgaatttgcctattctagatagttcacataagtagaatcataaaatttttgtctttttgtgtttagcttacatcacttagcataatgctttcaaggttcatccatgttgtagcatgtatcaaatttcattactttttatggatgattcacattccattgtatgtatatgctataccacagtttctttatccattcatctgtggatggacatgtgggttatttctatctctggacttatgcgaataatgtcacaatgaacgttggtatacatgtatccgagttcttgttttcaagttttgggggtatatacctaggaatcaaattgctgggtcatatggtgatttaaaggaggggccttaaaagcttatttattctgattccttcatcctagacttgcagtcaagatgcctgccccccagtctcctcaggccacctagctcccagttcccagtaagctcctttccctaagccaatggtaagaagaggtttgcttgggcctcaactcttctcccctaagtgagaataagatgaagctagaagttagtcactggatctgtgatagacttcacacctcaggaagccctccaatcataagagttacccagaagagatgtggacacagttttagaatgtttgggattcttgaccagtggatgacagactgaataggggtagaagacatgtctgatgccaagcatggaaacactcatggtccttttcaactttacccagtatatggtcaggtcagagaattaagaggctcacccaaatcagctcatccaaaaataagccttcagagtttatataagtgaaaatttgtttgacatggttaccaaacaaataataggaaatataggaaataataggaaatattagagtgctctagtcttttttttttttttttttagacaggagtttcactcttgtcacccaggctggagtgcagtggcatgatcttggctcactgcaacttccacctcccgggtttaagaaattctcccacctcagcctcccaagtagctgggattacaggcatgtgccaccatgcctggctaatatttttgtattttttgttgagatggggtttcaccatgttggccaggctcgtctcgagcttctgacctcaggtgatccgcctgcctcagactcccaaagtattgaaattacaggcgtgagccaacgcacccggcctagctttttttaattaaaaaatttcaattacttattgatatgaaatttacttagttaacatataattatccattttaatgtgtacaatttagaggcatttagtgcatttacaatgtgcaactaccacctctctcaagtttctaaactttttcgtcaccccagaaagattattccatgtgttctagttttttagatgtgattaccttcctctgttagctaggacactgggtatgactgttcacacacatgaggacttaactctatcacaaaaacaagcttatgcttaaggcataagataaataagggattgggcctgggagacactgatcaaactctgactaccctttgatggtttctctcaataatatttattgctgtaaaggggaatcaagaaattagcagcttcagtaatacattgactgctccatttaatttatttttaattttattattaattgacaaatactaattgtatatatttatggatacaatgtgatgttttcatatatgtatacaccatggaatgattatatcaagctaactaacatatttatcaccttgcatacttatttttttgtagtgagaacatttaaaactcttttagtaattttgaaatatgcaatacattattattaactaggatcaacatgctgtgcaatggatcttgaagacttattcctcctgcctaactgaaactttgtaccctttgaccaacatccatctgatttaaagtgggagtgaactgagtacatagacattggggactccttgaggacagagactaagtcttgcacatctcggtattctcaatgcccaacacaatagattgtacctataagatgctaaataaatgctttttggttagaactgtttgggctgggtggtctttgcttagagaatagagacagttgtgagaataggagataaatgtgaattccagaggcttacagatttagagctagattagtcttgaaaacaatttgcaaagtaaaaatttcccaggacttggggaaagcaggaagacatgcatatcatagagcttcccattaatagaacatttgttgaaaatcataatgttctgagtcagagtccctgttttgtcagagaacacatatttgacttggccgagctcctcagtaagggtggtagtacgagcctgtgctggtgtgttccttggtgcataaaacatcttccgatcccagttgatatataaactgttgcccaatcttattatttcaacactaaggagaaagcagaaaaagaatggttctgcgtcagaacaggacaagcaaatatatcatcctggtttctttcttagcagggctaagcatctgaaaatcagagtgtcttccttgggattctacccttctgaaggacccttcccaccagccaacccattgtaatgctgactttggccattatcacccaaggctttaccacctggacccagatatacttgattaacttttttgagtcatacctggcttttattctttttttttttttccataatgtatccaggaaaagttacaattttggaatttctgcagtaatgcaaggtgtgatagagtaacagttaacttataaaaggctgtgttggcccaattggaggattattgctcctgtcacatggggaagacagagaaccttgacacactcagagtttatttcagaagaaggaaagaagctatgaaaatcaggaatagtttatgggctgaccctctgataaatttccaggcagagccagcctgcctgtggtgtgtctcctcccacaacaacctcttctcattttatataagttttccctattgcctctgtcatactcctcttctgctccaaatagcgtccattatagattctttatggctaacaagcatgttcattttaaaacagtgaagacttttaaggggtctccttcttatcatcattcatacttaatgtgtgttagtctgctttattataagagtgattattagtaatccctgtctgagacagctgcactgacagatggggattttttcctttgaggtgaggaaggaggtgctcaggtcctcatcattgactcattactgataatctctatgcctggagttgggacccctcccatcctttaccatatcagccaccatagcaatctctctaaaccttagcacatagtagatactcaataaatattactaaataaggtaatctagttacatagggtccttttttttttattgccaaaaagccccggtacagggtttagaaagcctggaaaggaggaaactaaaatgtgtttgggtgtgtgtatgtgtaaggaaatgcagaacccagaaaaggatgatcagagtagggtaaatacttttttcagctatttcaaattttcattcaaggtgcttatgaaaaagaggaagggaaacccttcctcttctcttccacaacttttaggagttgaacttaggtcacaattacacctatctaccatctgtcacactgtttgtgtgggaaaatggattctgaattctgattaattgacttacaagtgaatgtttggacctatctcattggtaaactatgggctgcctggcctatcttcctggggaaactacccatgctttaagcatcaccaaatttgtgtgtatgttttctagttatttcatgtgtttttatgtcttatttagccacttactttataagttatttgagggcagggataactgtctttttgtataaaccacatagtgtcttcctagcacagtattctggacatggaaggcatttatgcaacctctagatatatctcagagcattttgtacaccacctactgtggagagtgaggggttaaagagcacaagtgtatgctttttaaaagttcacactctggttggggaattaagtagacagtatgaagtcagctcctcccccacaccccaaagtgatcaaagaagcctacctgacatagagggaaatgggcaccatggtattgagaataatgaagtaggaccagaatatgaggatggcagagacagctgatgaagagacatattttacccatggcagaaaaatctggaagtggtagcatttcttgttctgccaaatgccatgcccaactgctaggacaaaacacacgatgcctaaaaccaggaaaatcgatacatgaaaaaaaaaagaattaaattaacattttatccaacatatgtgctgcttcagttctacagtctagagccttatctctcagcaaagcgtccctctcctaggagggcagggaggccctatagttcacagtctctaggcagcagtacataggacagaaaagaaagtccagcagaagccctccttgggattttcaagggagataatagtaataaaacatagtaataactaaccaagtgctaggtactatgctaagtatttatacatattatttaatatttacaataatcctcttttaataatagatgaggaacttaagagtgagaaagaattttgtctaaagtcacttagctactgagtagaagaaacaggttttgaaccagttccagaacccaagcacgtaatcattccattattgaagctgctttaacagaagtctaaaacgtgtggggcttagcagttagggggtgggtgataaggaaactgatataaaaggctgaaaatatggtagtcatgttaacatgaaagaatttgataaaactgaaaggtagaccatatgcctactgaacctgcagctctaagagaagtggttaaaaagaatcaaaatatcattgtgtattgactgcctttgacaggtattaaaagaaagagttggttgggtgcagtcactcatgcctgccatcccaggattttggaaagaccagacaggaggattgcttggggccaggaatttgagaccagcctgggcaacatactgagacctcatctgtactaaaaaattttttttaaagttaaactagggaaagaattagccaatttgtaggcagaaataaggaggtacagaaatttggggcatcaaagaactacgacttctagacactaaacaggaagagataagattgagaccttaagcaaaaaaggcccaataattgttttcaactgaataaagtgactcagccttcgggcaaagttcaggttaaaggtgataccttcttacccatgactattattccgcatagcctcaactttcttgccagtaagttgagagagaagggcatggaggggcaaggaagcaaagaaacaggataaactcaaaaactacgtctaggaaagaattttggggggcagggggttactgatacatgaaactaattggaagcaaacagatgagaagccttatgggttttgaaggaatggtattactagataactatgagcctggtctaaaaaagcctgtgactgtttggaaatccttaaaaccacactgggcaggaagcaggttataaaaactgcagtccctaagaagagcatactccccaacatccacttcagggttggtcagcaaggataaagaatgagggaaaacttctcaggagtggagccagaaatcactgagagcaatgaataaaggagatcctctcacatctccagaccaagaggaacttcatttagatctgatggagaggactgtgcatcagtgagagatcttggactctgagttggatgcagagactgggtaggatttgggggagatgatgagggtgttccatatgtgggaggaaaagtgaaatggtatgatgatcagaagggtagattgtggcagcgataatgatatgtattcattaaattctattttcttttccttctgagcacatatctagagcacatttcccaagctctcttgcagttatatgggtcatgtaactctgttctagccaatgcaatgctggtggaagtgattatgctacttacacgcttggccctaaaaatctattatgtgtggccgggtgcagcagctcacgcctgtaatcccaacactttgggaggccgaggtgggcagatcatgaggtcaagagattgagaccatcctggccaacacggtgaaaccccatctctactaaaaatacaaaaattagcggggtgtggtggcacacaccagtagtcccagctactcagtcctcaaggctgaggcaggagaatcgcttgaacccaggaggcagaagttgcagtgattcaagatcgctccactgcactccagcctgggcaacagagcgagactccgtctcaaaaaaaaaaaaaaagaaaagaaaaaaaatcatgtgtgagtcttcctattctctctttttccccatctgctggttgaatgcagggaatccagtagaagatcctgaaatccaagaggttggtggggccattagctagaaagagtgttcctgagttattggtggagcaagctgcccctccccacaacaaccttcattgtattgtcacatgtcactgagattttaaggctgtttttttattttggttatcttattttgactaatacaactatactactcatagttccagattaatctgatgccctctatttttgattatttaacatttaattattaacacacataaagacatatgcagaaatcacagatatatgttgatgaattttcccaaagtaatcacactaatggaacaaatacccagaacaaataaattgaatattctcagcacccataaaccaccctatgtcccctttcagtcactatccccctaaaatcacacatatttaaagtatacaactatatactagacatacacacacacgcatacacacacatatctgtgaaaccatcaccatactcaagttagtgaaatattcattattcctaggtttctcgtgcccctttgaattcctcctccccaccttcccacttctcccttcccctggtcctcaggcaaccactaatctgctttctgacactttagaatatttgaaatttttagattttatacaaatggaatcatatagtatgtactctttttttctggcttcttctacttagcataatgactttgggattcatccatgtttttgcatctatcaattgttcatttttttaatactgagtagtgttctattgtattgatattgcacaatttgtgtactaatttttcttttattgaacatttgggttgtttccagtttttgactattgtaaacaaggctgtatggaacatctgtgtacaagtctttgcatggacataagctttcatttcctttgtacatatctaggagtacaatcactggatcctataaaaaatttatctttaactttttaagaaactgccaaatgttttccaaagttattatgccattttacattcctaccagcactatatgtccacctgcctctagagacaacatgatgttattgaaccacctcgaagtctacccaacagtctttacatctacccaagagtcttcacatctgtgaccttggtcacaaagtatggctggctcaaagcaaaccatccccattgctagataatgggaggtttcatctttgtgctactgatgggaaggtctttgaagacaagactagaaaagtaggaggaacaggtctaactgggaccattcccagaaactgatattttaaattattttttattatggaaaatttaaaacaccaattaaagtatataaataggacaacaaacccccatgcacccgtgtacccatcacccagcttcaacaattgtcaattcatagccagtctaatttcatccaaacctcctcttcccctgccttctcagaataaatctgtcacattatgcaatttcatctgtttaatatatagttctaaatggttaagatcttattttaaaacacaatcaaaaccagtatcacttaaaaattagcactaaacgcttaatatcattcagtatcaaaaactggtatttgagagttgagtgaggggccggggaacaacaaaacaaaggagaattgggataaaacacataaaatctgcttttattcctagcccagtccagattcacactgagtagctcagctctttgtgatgagggtttctctggggccatgcaatctttccttctcaatcttattcccacttcttatctttctcttcaattaatcatgtgaaaacaaagctattctcatggttcagataaagcctcagtgaattattgatctgagtttgagttctactgctcaaactaagccaccagaaaggaagaccacttcttatcagcccaagccccagaaagcagggctaccctgacagcctgaatcctgaaggtgtagggcacagtgttttctttcttcattgctagagcttttcctgccatcatgaggccttcaaagcccttgcagatgttctacatttctttttattgtgatagggttttttggtacttagtctttaaagcttcactttacttcctttccataaggagaaagaaacaataaatcatcagtttgtttggttattgctacagaccctagagattacttaataccagagctagtcagaccaaagaagcacagacagcctcccatttagcaaaaagtggcttcaataaagagtgaaataaataattttgtcactcttgacaaaactgaccaaaatcaaggccactggtctcataaaggtgctccctggcctcaggcagcctgtcaaaagaaagcactccttgggcttttggcccttcacatctgtgttttacattgtgccttaccccagaaggagatcctggatctctggcaccatttcaatttcatgcactttgctcatttgtctcacaaatacactcctagttaacagatcatgatttagaaggcattgtcactgggagttctggtcactggggagagagaagggatctaacccccagctcagcggtgggctcatcaggaaggagctttgctaaacgtgcttcctgtgtctgccagattttcttctaagaggcatttccaaaaaatgggggaaaatgaagtgtttaaatcaggaaggatttctggttcagtttacttcaagaaatggaagtgttttacatatgactaattgacaatgtcctggcacaaataccacagaaacaaaactgctgagctgataagaacctagctaattcaagaacatttcttcatttaataattcaatagagatttactaagcactactttgtgcaaggcacttccaaaaatatgaagatgaatatggtgtaatttctactgtagaggctcataatctgttggctaagacgttcattcatttttttcactcactcaacaaataataatgaagctcccattatatgtcaaggatcgttccagggacttagggacacagtggtgaaaaaagacaacatccttgtggagagaggtagacaacaaacaagaaatgaaaaaaataccatttagtgataaatgctgtgaggaaaataaaacaggttaatagaatagagggtcttgatgggggtgttagagaccttttatctgaaaaggtagcattaaatgatgaaaaagaagcaagccatgcaaagacttgggggcagacattgccagcaagggtaaaggtcctagggtaggaacaagtttgctctcttacttgacttgcagttttcctgggtacagatttctaggtcaaaatatttttcactaagaactttgaaggtatgaccctactggtttctaggacccaatggtgcttttgagaaatccgataccaatctgcttcccatttttgttaatatcttatttttatctctataagaattttaaagggatttctcttctctgtaactaaacctttctagtttgatcctctgtttaaaaacaaattatttctctaatattttctgtctctgtgtctttttgttttatggtccaggagagattttaatcctttaatgggttttaaaaaaatattagcaatcccatttttgatttcccaaattctattttgttgttgttcttagatatttttcttctttcccccttttaaagcaacctattcttattttatatatgtaattgtttcttttctctgagactagtcataaaaatgttttaaagttcttttcttttctcttccctgaaatataatttgtttattctaggttcaggtatttttttttaagatgggatattgctaagttgcccagggtagagtgcagtggctgttctcaggtgcagtaatggtgcactatagccttgaactcatgggctcaagtgatcctcttgccttagcctcctaagtagctgggaaccacacccagcttccagggtcagttattctatttgttcatcctcatccacctttttatgctacttgtttccctctagtccacttaaaaatataagtaaaataatagtttgattattataggttgctggagtagatttcatttcttttggttaattttgttttcctaacaggccactcccttgaatgggaaaccatgagttctctgttggtagaaagaatacgttttttaacaaatttcaccctaggatgtacaagaaacttgcaggcaaactcaagccccccaaatttaaaattaagtgggttttactctaagtgctgacactcagatttacaagccttagttctctgcaggtaggttgttaaatttctttcaaaagcagttcttttgtttgggactggttattaatcctttgtcagatggacagtttgcagatattttctcccattctgtgggttgtctcttcactttgctaattgtttcttttgctgtgcagaagattttaaacttaatgtgatcccattttgtcaatttttgctttggttgcctgtgtgctgggattataatgagctcaaataactctacaggaaaaaacctaatagtccaatttaacaacggacaaaagatctgaatagatacttctcaaaagaagacatacagatggcaaacaggtatatgacaaggtgctcaacatcactgatcatcagagaaatgcaaatcaaaactacaatgaagccaggtatggtggctgatttcttattgctcaacgtccttttctttctagtttaaggactctcttcagcatttttttgtaggacaagtgtgatgttaatgaaactgctcaacttttgtttgtctggaaaaatctttctttttccttcatgtttgaaagatatttttactagatatactagtctaggtaaagttttttccccttcagcattttaaatatgtcatgccactctctcctgttagatatgagttctaaatttcttttcagagaattaatatgtcagtatattcagttatttgccttctacttttaaacttaacttcctcataaagcaacctttttcgattacctactccaccctgactcattctgatcacctgctccacccgaaatcattccaattacctgctacctgctcttctgccctgactcctgccaaagcactcaccccatcattctctttaaattagccaatcggaattagtttaacctgtgtggtctaaccctagccaataggggaatgacacagcagcagggaccacgtacaccagggataagaaccccttcccctcccttgtccaagtgtgcattcaccattgttccatctgtaagggcacacccttctatatagaagtaacttgccttgctgagaattaaaaagaaaattttatatttgaatgctatttcttttgtggcaccaaaactttatatataacaatttggggggctcgtccaggattacattcccctccaggactgtctctggttctctctcgtgaggaggtgcacccggccctattgtggcggcctcaggggtgagaaatcaagacccacccagtgtgaggaataacctgagctcttaacaacacgaggggtcagggagagggggtactggccagcaacctagcttaaatgatcctcacatactgcagtgatgactctgcacagaccaaggaaggagatgccatgggagcccgtaaagtacttccttggtggtcaaattctggagggctaaatgtgtgtgtgtgtgaatgatcaccaacaaccctgcttgtggtgttattcatgtggatggtgacaagtcctactgctcgacggagtgagtgggtcctctctgcagttccacagctacctcatatggcttagggcggatcctgccataggatttatactggcatgccaacactaagaagggcctgattctaccttgggggagcagccagagagggcagcatgagtaggaagtgtgcaaaggaccttcagagggggaaaaggggagaaacagatcaaccttccaggacaggcaagacacccctggtttgaggggttgagccttccaggacaggcaagacaccccctagtttgaggggttgagccttccagggcaaacaaggcaagatgccccctggtttgaggggttgagccttccaggacaggcaagacaccccctggcttgaggggttgagccttccaggacgggcaaggtgagacatccctggtgttgaggggttgagccttctgctaatttcaagggttgaacctgacacaacccccccgctgccctttcctttcttcttgggggaagagagagtagttccactcccgtaggtccctaccctaggggaagagagagagagacagagagagacagacagagaggagagcgagatagagacagagaggagagagggaaagagaggcagagacagagagagagggaaagacgcggtgggggggaagagaggcagagagagacagagaggggatagaggcagagagagacagagaggggaaagaggcagagagagaggggaaagagaggtgtgtgggggggaagaggcagagagagacagagaggggaaagagggagagagagaggggaaagagaggtgtgtgggggggggaagaggcagagagagagaggggaaagagaggcagagagagaggggaaagaggcagagagacaaagagggagtcaaagagagaaagagagaaagtcaaagagaaagaaagagaaaaatagaagtagtaaagaaaaaaacagtgtaccctattcctttaaaagccagggtaaatttaaaacctatagttgataattgaaggtcttctctgtgaccctataacactccaataccacctctttgtcagtgtaaacaagggtgtagcccgaaagcactgaggccactgacaatctgtagccttcctatcaaaaatccttaacccagtaaccagcagatggcccaaatgcactcaatctatagcggcaactgctttactaacagaagaaagtagaaaaataacttttagaggaaacctcattgtgagcacacctcaccagttcagaactatcctaagtcaaaaagcaaaaaggtagcttactaaaaaatcttaaagtatagggctattctgttagaaaaagatgatttatcattaaccactgaaaattcccttaacccagcaggtttcctaactggggatttaaatcttaattaccatacaaaggtccgaccagacctaggaggaaccctcttcaggacaggacgatagatggttcctcccggttgattgaggggaaaaaaaaaaaaacaaacgacagtgggtattcagtaattgatagggaaactcttgtagaagcagagttaggaaaatttcctaataactggtctgctcaaacctgcaagctgtttgcactcagccaagccttgacgtactcacagaccaggaaggaaccatctataccaattctaagttaatttagactaaacaaggtcttattaacagcaaaggataattgaaatcccaaacttagaaggttttcgacaaaagtaaagtttgctaaaagttatcaatataacacgtattatcctaacttctaatcttatggccttaggcagtctagtccacagacatgaagcaagttcgctttagaaaagaatggttatcatctttaggaaaatttaaaaaggaaaaagaaaaaaagaggtggggggagagtttatgtaaaaagaatgctatacggtaaattcttgtcctaaaataaattaactaattgttttttaaaaaaaagggatgtttgcaacaagtcacaaagttgagccgggtgcggtggctcacgcctgtaatcccagcactttgggaggctgaggcgggcggatcacaaagtcaggagatcgagaccaccctggctaacacggtgaaaccccgtctctactaaaaatacaaaaaattagccgggcgtggtggcgggcacctgtagtcccagctacttgggaggctgaggcaggagaatggcgtgaacccgggaggtggagcttgcagtgagcagagatcgcgccactgcactccagcctgggcgacggagcgagattccatctcaaaaaaaaaaaaaaaaaagaaagaaagttgaggcatgtcgaagaattatctgtgaaagttgtgtgaaaaaaaggttataaaaggaaatttatgcaagaaatgttgtataatttaaaagtaattagacctcctaaatgtaaaactattgaagaaacagtttatgtgcaaggtgtgtaaggaaagtaaaatatacttttggtaacaagattataaggaggcataagaatgtgaatttttacctacattaaaaggtgaaaaatatatatattttgttttaaaggtctaagcaagttttaaaacgttaattgtaaaggaaattctgtatgtaaacatattagctaaagttaaagaggtaaccagtttttctgtgaactagacattaaaataaaagcacaacaggtttttctaaagcactaacctgctccttaacaaaaattataaaaaaggttaaaaagagtctataaaatcttaccttatggtcagacattaaaaactggataaatatgtctacaaggttttattaaaattaagtttaacattaataacacactaatataaaggtgaaatttagcttatctggtataaaaatcatacaggaagcattgttaaatataaaatggtgtttggcattctttggtctaaaaactaataaaaataggtgctaaaggaaatttctcagtaagaaggcaccaaagactataaagtccactgctgatgtccccacgtttaaaacaaaaggtcaatttcttagaaattatatacttggtttatcttccctcaaaactaaaagtcttttagcacaggtaccacccctagaatttccagtaaaccagcaccagcctgaagatcacgttctcatcaaaaagtggaaagaaggaaaactcgagccagcatgggaaggaccctaccttgtgctgctaaccaccgagactgctgttcatacagtgaaaaagggatggactcatcacacacgagtcaaagcgccactccctccagagtcctgggccacaatcccaggggaaaaccctaccaaactaaagctaagaaaaatttaactctttcatctattccattactttttcttctttcctcgctctattgctgaccatccagttattaacataaccaagtcaatttcacctcaaactactgcatttaatgcttgccttgttataccttgtggggacttgccaagtcaaagacagctctctacttcagaaaagtacctctgtccctcctgactctcctcagaatgggcattagtaaattgggaccatttaatccagggagattttgataaagaccccagtgtcaaccatgagtcttgccccccgatgtagagcttttatgccgtagttggtccaacgttctgtggaccactaaagagcaaggatagactgccccaaccagtttttataatttcctaaaacgatacattcattttactaaagggacagcccccctaactgtcagctaaaccagtgcaaccctatacaggctattatttcaagcccccaaagttctccccttttctaagccggttcccttgtttaagccagttttatggtatgggggctgaggtttcagggacagaccctattggattctttaaaatgcatttccttgatcccctgccgcctacatctgcctctaagcctttttccaaaacctctcacaatggaaccattgatcctcctccatctagtgacaaggccaagatagtgatggtagaagttaaagacttaaaacaaactttggcaattgagacaggatactaaggatgtaaatgcctggttgaaatggatcaactattctgtccgcacgttaaacaaaaacaattgttaggcttgtgtgcacggcaggccagaggcccagactgtcccctttccactagggtggtcctccagtcaaccaggcatgggctgcatggtagctcttttccaagattctacagcctggggtaacaagtcatgccaagctctcactctgctatatcccgaactctggcaccctgcgggtcagcccccaagggccatccagtttccatctcctaacactaagttcccttcgtgtctctcatgacagggaggaaacttagtgttccttggagacctgaagggaagcagtgagcttaagaattttcaagagcttatcaatcagtcagcccttgttcatccccaagtggatgtgtggtggacctttactggacactctgccaaataactggagtggcacttgtgctttagtccagttggctatccctttcaccctggcatttcatcaaccagaaaaattagacattgtaaagcgagagaagcccattataggtctttcaactctcacgtctatttagacacaattaaagtcccacggggaataccagatcaatttaaagcccaaaatcaaatagctgcaggatttgagtcaatattttggtgggtgacaattaataaaatgtagattggataaactacatctattacaatcaacagcgatttattaactacattagagatgctgttaaaggaatagctgagcaattaggggctaatagccaggtggcttgggaaaataggatagccttagacatgatattagcagaaagaagaggagtttgcgtcatgattaaaactcagcgttacaccttcatcccaaacaccaccacccgtaataaaagtataacaaaagcattgcaaggtctgactgctctatccaatgagttagccagcaactcaggggtaaatgacccctttacaggatggctaaaaaaaagttcggtagatggaatgatagcctcaagtcttacttctctcacagctgtaataggtgtatttattcttgtcaggtgctgtgtcataccatgcatccttaagtagatgcagaggctcataaaaatggcacttactaaaacctcccttaactatcttccaccttatccagagaagctgcttcttttagaaaatcaagcaaaacaactaagccaagacatgttaaaaaaaaagtttgaaaagaaagctgtaaggaaatacaagggaagggattattagaaatgagttttaaatttcttttcaaagaattaatatgtccatatgttcaattcttctacttttaaacttcctctttaagcaacctttttcgattatatactccaccctgactcattctgatcacctgctccaccctacattccaatcacctgctccaccctaactcattccaattacctgctacctgctaccttctctgccgtgactcccaccaaagcactcaccccatcattctctttagccaattggaattagtttagcctgtgcggtctaaccctagccaataggggaacaacacagcagcaggggccacgtgagccagggataagaaccccttcccctcccttgtccaagtgtgcgctcaccattgttccatctgtaagggcgcacccttctatatagaagtaacttgccttgctgagaattaaaaagaaaattttatatttgagtgctatttctttgtggtaccaaaactttatatataacactcctgacctgtaatgtttccactcaaaagtcagctgcctgaagtactggagctccattgtatgttatctgtttcttttctcttgctgcttttagaatcctttgtttatccttgacctttgggagtttgattattaaatgcctgaggtagtcttttttgggttaaatttgtttggtgttctaaaccttcttatactcagatattaataccttcttctacatttgggaagttccctgttatccctttgaataaactttctacccatatctctttctgtatctcctgtttaaggccaataactctcagatgtgcctttttttttttttttttttttttttttgaaacggagtctcgctccgtcacccaggctggagtgccgtggtgcgatctcagctcaccgcaaactccacctcccgggttcacgccattctcctgcctcagcctcccaaatagctggtactacaggcacccgccaccaagcccagctaattttttgtatttttagtagagacggggtttcaccatgttagccaggatgggctcgagctcttgacctcgtgatctgcccacttcggcctcccaaagtgctgggattacaagcgtgagccactgcacctggccagatttgcccttttaaggttattttctagaccttgtatgaatgcttcatttttttttcttttgtcttctctgggtatcttcaaatagcctgtcttcaagctcactaattctttcttctgcttgatcaattctgctattaaaatactctgatgcattcttcaatatgtcaattatatttttcaactctagaatttctgtttaattctttttaactatttcagcctctttgttaaatttatgtgatataattctgaattccttcctgttatcttgaatttctttgcgtttcttcaaaacagctattttgaattatctgtctgaaaggtgacatatctcagtttctccatgattggtccctggtgccttatttagtttgtttggtgaggtcatgttttcctgaatggtcttgatgcttatggatgtttgttggtgtctgggcattgaagagttagttattaattgtttgtatagtctttgcagcctgggcttctttttacctatctttcttgggaaggctttacaggtatgtgaaaggacttgggtgttgtgatctaagccatatctgcattagagggcacccagagcccaataatgctgcagttcttgcagactcatagaagtatcaccttggtggtcttgaataaatctggaagaattctctggattaccaggcagaaactcttgttctctttcctttctccctaacagatttagtctatctctgtgccaagccacctagagctgtgtgtggggtgacacaagcaactctgaggctaccaccactgggactgtgctgagtcacacctgaagtcagcacagcactgggtctcatccaaggcccgctgtgaccactacctggcaactgcctatgttcacttcaagccccagggttccacaatcagcagatggtgaagccagccaggcttatgtcctttcctttagtgcagcaaatttcctcagcccctggggtgtccggagatgcagcctgggagccagggactgaagtcaaaaaccttagaagtctacctggtactgtattctactatggctgagctgacccttaaaccataagacaaagtccttcccactcttccctcccatttccacaggcaaaggagccagtgcccatggccaccatcaaagacctatagagggtactgccaggctaccaccaatgttcacttaaggcccaagggcttaatcagcttgtgttgaatactgtcagtcatgggactcacccttcagggaagtgggctcccatctggctcaaggcaggtccagaaatgccatccaagagccaaggctggaatcaggggcaccaaggacccacgtgatgttctaccccactgtggctgagttggtacctaagctgtaagacaaagtcctttttacctttccctctgtttttctcaaacagaagtctctcaccatagccaccacggctgggaatgtgctgggtctcacctgaagccagcacgtctagatgctgccactctacagtctcacctaaggctcacaatgtactacctgggtatcgttgctggttctttagggcccaagggctctttagtcagcaggtgatgaacctgccaggactgggtccttcctttgaaggcagcaggtttccttctggtccagggtgtatctagatatgctgtctgggagctagggcctagaatgggggcctcgtgactctgtccactgccctatggtactgtggctgacctggtctccaatttgcaagacaaaggcctctttactcttccatctcctcatgcagaagaaaggagtcacttttgttactgcaagctgtgctgcctggggttgtgggaggggtagcattagcactcccttctctgctctggctggtgtttcactaggttgtgtgcacccaccccgaccccctatgtccactggctctgagctcagtacagcactagggcttgcctaggaatggcagtctttgtggcctagactgctttcaagcttgtttaggaccccagagcactttagcccaaggtggtgaggcttgacgaaactgaagttctgactgctgggatgggcgattcccttctggctagggttggtctaaatgctccctctatgggtgggtgtcagcagagttcagcttggttttgctttccactatgacagaacagcactgagttcaatgcagggttccacaattgctgtgctctccctccccaaagcttacaagttctctgcaccatgcatggccaccaggagatgggggaatggtggcatcagcaattcaagattgtcttcaatgcttcttttggtgatatgatgttaaaaccaggtattgtgattgttcgactcatttttgtttcttatgaaggtacttttatatgtggatagttgttaaatttggtgtttttgtgggagtgtgtgtggggggggtgattaataaagacttctattcagccatcttgttccacctgtgtttttgtgtttcgttgttgttttttatagagatggggtctcactgtttcccaggctgctctcaaacttccaggcttgaacaatcctcctgcctcggcctcccaacctgctgggattacaggtgtgtgccatcacacccatttgaagacatcctgttttgaagacaagcctaggctaaatgacctagcttactgtctaatgatgtatgttgctaatgttgtcaaaagcatatttgcccatgttaccttccttaattcttgaccatgattgtcttcttcattaagaaactaggaaatggaactttgatcaactgctgaaaactacttactccataatagaaagagaagtataatgaacgaatactagattctgagctgaatgaaccttcctaattttctaaaaccccttttgctagatccaaaggattttgaaaaggatctgggatgtttcccataataaagaaaaaaggcagtttataattcagatattaatgataagagtgtacaaagaaaaggtttttttttgagttttcagagtctaaataatagagtaaaaataaacatgaaaagttatgagatcaagtgtaggcattacaggaactgctcagctatgcaaagaagctgtttaagagaggaaattaatctgtctataactaataagaataaaggcagcttatatcagacagcatagaaataatttattaactagtcttcaatttaaacatctattatcaaagctgattattatatattgcagtgcttttcaaatttcacttcttaatagaacccccttctatttttacaactgaaatttcataaaatagataaacatgaagctgttctttttaaagcaagaacttcaaaatgaggaggatagaataaaatccacttgatcttccctattcccactgcaccagaccttaagactcctctaagaaaagagtttgaaaatcatcagttcaaacaaggtgttctattagtctaagtaaggttttattaaagtggtcatgagtaaaactgattatgagaaaataaaaatatgtcttaatttctaaactgggtccttgatccattcttgtaccactaatcaaagcatgatatctttttaaacactttgtgactattcttcctaacaggcgtaagctagactctcttgtaatttgtctgttcttttctgcctcagatcttaatctctgggatcctaagactgcttgagactttttttttctggttttcctttttatttaatcaaagactggtgaataaacataaatacagcacaattacttcagatcattcttcatatcgtatacacacaaacccatgaacataatctgaaagaaacctgtagacagcaatgaaatgcatacagctttttcttccctcgctcaaaaaaaagtttaaacacacaaacttagaatctcatcagcacacactctcgtgacaaatgattcagacataaatagtgggtgcaaagaaactatatgctaacatatgaataacctttgttaatgaaaaaacagaagcagccataatgattaagatacattcagttaccgataactagttgtgccccaaagggcattatcaaaagagaaatcgtgctgcaaagaaaagcaatatatatgtacacaatgagaaaataaactgcaagattaatgcatgcatatttaatactggaaaaatcacagtccaccaaaatttctgcacgtttgttataaaagccctctgcactcaactaaaattaaaatgatcttataaggataatacttgtaaagtttaagtcttctcagccacagaaattgcaatggaaataaatgttcagagtcattttcaaaacaaaatcaaaacaaaaatctattcatccgatgacatgcaagatacactgctctactttcccaatgactagggaaaaaaaaacctcaagtcaatttttagtttgcagatgatcaagaattttgtattccagcaggagttcaaatcttttggatcttctcgccaacaactactggattttcttttctgattttctcagcggcatcagctttgtaattttaagagcaattgtgtagatctgagtaacagtgtacaccacagtaaacatttctacaccgcattcaaacctagtaagtcccactttcttcctgcacatgaaacagagattctttttttgttttggtttttcaagagacttgctttgctcttcagatggctgctgtgccatgtctgatactgaagcctgcagatcttctgtttcaggtactgcttgtccacagatgtactgtccaattgagaagatgctacagattctgataaaagtgactgatttgatacagggcttggctgcatagatgaagatgtagagtctaatgttgactgggcttctgggacactgccatctgtgcattgaactggtaaagattcagaggttgcaggttggcttattctaccattactactattcagtctttgaagatgttctttatagcatactgaacacgtgccatttgtacgagggtttccataaaatccgcagccagtggaacaaagcataggtacttggctgtgattagtttcttgagccatgttcctccattgcacaccaacaaaacctccacaattttctgtttgcttcacctcagattaacttcacttgaagctgtgcttgagactttcaaacagctaaattctgaactggaaataccatttctcctgtgaaaggaagggaagtatgtctatttgtaaagaaacaaagaaaaaaaagtatttaacttacccagagtacaaggacattcatgagatggtctatctgtgttcgtttaaaagtggactttccactattctgcattaatttggtatctggccctaaataaaacaggaagatatcagatattagaatcactgaatatactcagaggcttggaattggctgaactgtacctttatgataatctaatctaaccactttccaatgctagaggataaagccctagagaaaggctcacggttttcaataactcaaaaaacggaaaattttttctaaggatagttccaatgacttctgtaaagtacattcatgcagatccctctctttgtagcacctcagacagtctcaactttcatagatgcgttaaattagaagaggagttgcaagcttctctcttatcaccatctggtttatttagcttagagaaggaattttctgataaagagatccccatcatcttttgagaaagctcactgctggctcaggctatactgaaagtttctaactcggaatggaagaaacgaaaaggcaatggcagtgatttcttctgaggtggaagcaggggagctgagactcctctggagctgagagacagagattccatgtttcttcatgacaggacagatggtaggcagaagtaaggagcttttaatggccaatgggactagagctggaaattactaattcgagctatggctccagagaaaatgtaagaggtttagaagaaactgtaagcaataatttctctggcctttcaccatctgaccattattctaacatgtgttctgataaaggacagaaaaaggaatttcatcaatgtttacacatggggagctgggacatctctgatatgtgggcaaacagtgggagtgcagagcataagctatgacattctttcctcttaagcattccttgaagggcttcaagatatgagaagtttggctcatagcctggaagctacagggaccatatcttctaagggtccttagactgaccttaccccaggcttcaggaagaaggtagaaatcatcacagaacttggacatcatgtagcaggaacagcaactcaattccatgcaaacacctcaaaatgcttttaggtggcattagttctctgctcagagcttcccaaagatactcactaccatgtaaccaaccttgggaaaacttaactacatttgtgctggttggcagccccactgttattgctttcaggaaaaaaacctttcgctgaaaaatgagcttttatgagtggcaattgtgtgtgagtagctgctgaagtacatacagtgaagaaagtaagtctaatttaagtcttttgagtttgggaattaggtagcctagtcattgccactctagatcaagaaccaatgaaggaagttccaccagggcctccctagacgcttaagcttctccctagggatttggtctcattacttttcacagaagcaaggagtctaaaagcctcatgtctaggagtagatgctctagaaggggagctctgggaatctgagttgaataatattcactgtggtaaatctttcttgatatttcctactatggttgttgtcactgagagaatggggcagcacagaggcttcctccattttcctgaaccacatcataacccaagaaaatctcttactaaatataatgaattgtggttctaaataacatctcaagaggggccactattaatgatccatatgtgacttttctgtggcatgaactttttacattatatttttctctataataagcattgtgtccatcctctcttcatgggaatagttcatatgtatactctcccccttcacatggtaattctatcatacttcctctgtatgtataccctctcctgtgtccagatcttgttaaagagactcatggatgccctgtggttttggaacacaatgccttcctctaacaaaggtagaaccgatatgttggaagttcattgcttggaaacagaaggcactttttttccctaagaaacaaggttttttcccacaaatctcccatccatccatccatccatccttctacctgcctatctatctcaaaaccatagtgttctgaaatatatctgagtgtcatatccacatcctgaaaactaagtacccatagctcagccatgaatggaatttagcaggctgggggccaagggaaacgtaccagtgtagatcaccaagccatagcaccaatctgtattcctgatgttgcagcctcagagtagcagcttgtcatggtccaggaagtagtttttccccttataggtcagtattcctgagaatttgtccaatttgttattgggagcctcacatctcacttctcctgcagaaaaatgaaggtgtaagagttctggatctctaatcttaggcttttcctaaggatgaaaggagacttaatagaaaggaggaaataaaattcttctttcaaaatacatacacatctttttcctatcctctctcagttactgcccatttctcaccagctccttcaagaaaggcagacaaaggtttctgggaactaaagaagaataattctgtatgtgacatggatcatccagagagagagaaaaccccacatgatggtgacatcagtactgccagatcataagagctctgaatctgaagaaactcaaaaacgactcaaagcgaacctagtattttttttcaaaatggaaacaacttgacattttcctgattagtaaagtaaatatgccctttgtaaatgtttaagtaatactaaaatggtaaagaaggaagtaaaattcattcactgtcttgagaaaagtgctatttaccttttgaagtacatccttctatgttttttctatgtaagtactcataaacatacctatatttccaaaaacaggtttatgttatatacactatgcagtcttttgtaaattgtatttttcttttaattacatgttgtattttttatatttcaataaatatcaacttgcatattgttgtaataagttgtatagaaatcactatggatgtaccatactttatttaaccagtactctactgatgaaaatttaggtaggaaaacccatttcctaactcaccattaaaggtagacagaagctccaggcgatcttccatgtcactggtaactgagatggcctgcttcactttcaggttggtttcactagagtaaaagacaagtgaccactgtacaggacacaaacagaactgttgtacgggtgcagtatctcctactttttcatggggttttagaaaatagatgttaccagtagagactgggctatgagtctgagctgtaaaagtcactcccactgcttctctctcagtattgaggtgagatggctcttcaaggaagctgagtgttagctcactcactcccgtctctttcctctcactctctgcaacacactgccactacttaatcaactcatgagatctagctggtcaggtgctctagagaggctgaagaaacatcataaacaacctggagatagtacctgctcccttcaagaataaggagtatgcctgtaatcccagcactttgggaggccgaggtgggcggatcacgaggtcaggagatcgagaccatcctggctaacacagtgaaaccctgtctctactaaaaatacaaaaaattagctgggcgtggtggtgggcgcctgtagtctcagctactagggaggctgaggcaggagaatggcatgaacctgggaggcggagcttgcagtgagccgagactgcaccactgtactccagcctggggaacagagctagactccatctcaaaaaaaaaaaaaaaaaaaaaaaaaaaaaagaataaggagtatggccagacatggttgctcacgcctgtgatcctagcagtttggaaggccaaggcgggaggatcacttgagctcaggagttcaaggccagcctggacaacacagcgagaccctgtctctattttttttaattaaatttaattttttaaaaaaagaataaggagcagatcctggtaaaaacttgcacatacctccgaggaaacatactccacacctcataaatatttatggggcccatgacaggctcttaagtaactgcttgctggaatgcatagacaaaaagaaaaatggaatccatgtttcaaaaaattgtgtgcatcaagaagtacagttgtaggaatgaagatcaatacaaaactctccaggataagctttctgcagatggctctatcctcctaagaccttagcttttggatgttaataaatgtctaccttaaatcctttatagaacatggtattttatcagtgaatagatatgtttatattcacattttttcccttggaaactttgaaactgtactctgaaatgttacagttctgttatcctctttcctgctactcagccttatagaatatggccagagtgtctccaatttagagatggagaatgtggggtttatttgccctattctgtgcccagtgaatgctcaattgttcctgtcaagagctcagtcttagacttgagggtcccaacgatgtggtgtccatcttctcttatctggatatttctaggctctctggctcacctattcaatattccatctgagaataaaattaattccctgcctaatgctgtccctcagtgagagaccactctaagctggctaaatcatcttaatggagcatcaggagggaacacttacccatccaggtctgctgtctctatgtatgtcagactatatggctcactgctagagagtaatagtatatctgcctgtagtcagaaaagtcaaaaaaagtcaggaaagcaggaaggtgggctgttaacattacagtgtgacaaaagcagtcaccttaggaacagatgttcaacctaagcattttacagacactgatttactttctttcactgctatcatacaccctctcccaaagctactcacactttccctgtaactacagtgagaaataggcaagaacaagcttcttactgcaagagctgttgatttctgatgcaaaatgggcaacaaaggtcaccaaaaggagtggtagcagaagtgctccaagagtccctggtacccactcaatccaaaaaagaacaagtcacagccaaaagaggtactcaccatgacaggctgattattttctagttttattatatctcccacttgaacattcatccatttgtcctcctttatcctgtaagaaaatgacccttgaatatctgctctgagaatttccccaaggctctgctttgacaatcaagatgattccccaccctccaaaaaaggctgaaaggaataaagacaaggctcaaactgttctgtgatgcatccttgctgcaatcaagagtggggcccatttctcttgacttcaggctataagggttctaaagccctacaaaagtacctgtagacatataagcacataaatttttttttttttttttttttttttttagccaggtctcgtggctcattcctgtaatcctagcactttgggaggctgagtgggaggattgcttgaggccagcagttcgagaccagcctgagcaatacagcaaggccctgcctcaaaaacattaaaaaaaaaaaggtttttaaagtaaaatagttccaatggtaaagtgtgtaaaaggaaaaattaaagtcttttctatttccagcctttagttttgctccccaaagatagctgctgttaataatatttttgtatttatttctagaaaataccaatccatgtaatcacatataatacacatctaaatcacatttaaaagccacgtactagatacataattttctgcactttgcatttttcatttaacaatccatcttggagagcacttatagaagatgtagctcattctttttgatagcttaaatgtgttctgtcataaggtcacatcaattttatctacttacgttttgttttttttgagacacagtctcgctctgtctcccaggctggagtacagtggcatgatctcagctcactacaacctctgcctcctgggttcaagtgattcttctgcctcagcctcccgaatagctgggactacaggcttgtaccaccacacccagctaatttttgtatttttagtagagatgaggtttcaccatgttagccaggctggtctcgaactcctgacctcgtgatccgcctgcctcagcctcccaaagtgctaggattacaggtgtgagccactgcgcctggcctttatctacttaggttaaaattagattatctttgatcctcaaatccctactttccataaaaggcagcctggcaatatgagcagattctacaataatggtggttctctgccctcctcttttttttttttttttaacctcaatttccccaaatacacagggtccataaatccttcctctctgagaaaggactaagaagaatgtacatattgccacaagcattttggaaacatgagctatatccttgcaacagttatattatgccaagcacccaaagagcgggaaaaagtctacagtccactgtctgttttgtctctgaatgcaggattgctatctgcagggcatgacatacatcaccactttgccagctacacataggcatgggtattcctagaacacctttcctaagaagacagctgctttgaggagggccaaattttccaaaaaagtccttttatataaatccactgtttcttttaaagaattttctgatagtactgtagaatagtagctataagccttggagacagacatctgggtctttgttttattttgccttgacttgacattcactgttactctggcattctatcttccacggttgtcaccagtaaaacataaagaagaacaagtgctgtcacattctagcttctcctggagatataaaaattaataatttcttacataaggagctgccaaactattaccaatttgttcctggacattataacaatcatgtgtcccagatttgggagaggtgaagacattccttactgatttaaaatactcaatcctgtagtccaaaacagtaagcatgttctgaagctgttcttgccttgggttggggagggattgccagtcttaataatctaataatttgaatttcaatttctcccaccagagggacaagagataaagccttatgattttgagagtcagtgagttgaaactaagaatttctcataaagtcaggacccttgaggggcaacaccattagtgaaagagtggtctaaaaaaaatcggctcactggcaagaaagtttgtctatcttagtctggagggttgtgggggtcagtgaatggaggactcttccctgaaaatctgtaacctcatattggatggggctcaaatttatacttctttcaaattaggtatcagcaggtaatacccttgagtcaactcacagaaacaaacacaaacccttatagagggacacaacctctcctccagccacttagaattcccttaaagttctactaatgatgtgtttgtaaacaaaattattgagaaatgaaaaatgacaaaaattacagcttataaaatagacaaacttttaaaatagcagctctgtttatacccatgtgttctacaaaaagaaagctgttttctggaacacagactgtttcaacaaccaacctcacctctgcatattaatctaatcagatactcggtagcttacaaagtctaaccagggccttgcctgttaactcccaccttaaaatccctctgtgacaaattcttcaataatcttataaaacccaagtgctcaagctacttgggtgagttcatttgactaaatccttttggtcagcaattcctaatatactcagttttgtcttttctttttatttctatttctctactttcctttttttttttttttttttttttttgagacggagtctctctctgtcgcccaggctggagtgcagtggcgggatctcggctcactgcaagctccgcctcccgggttcacgccattctcctgcctcagcctcctaagtagctgggactacaggcgcccgccactacgcccggctaattttttgtatttttagtagagatggggtttcaccgttttagccgggatggtctcgatctcctgaccttgtgatctgcccgcctcggcctcccaaagtgctgggattacaggcgtgagccaccgcgcccggcctctacttttctttttaactacaactgacttttttggcggtatcttatgggacatttcaacaggtcaaaactcttgaggaaacaatccatcgtgtgtaagaatcagcagacaaaatacacaacaggattagctgcccaagctcttgagatgatagaattatatgataaatactatagctattgggtgttcagtaaggccaccatgataaaggctggacctcaatcctgaactccttcaggtttgcactttcttgcaatcatgcttctgcccacactggtcacttttcctttaacacaatctctacttgttgaattcttccccttcccttaaggcctagtacaaacactacacctcttccagaaagtcttccttgattcctttaaccagttataattgcatatttttattaattcccatagtaattttttgtacctcttaggatagtcttcatattttgccttacataggaatatgcctgccttcttccattcctgcaacactttagatagctatgaccaaacactacagcagtggggccaacatcaatactctgtttagatttttaacagaaaagatgacctgaccaaaggctatagtagaatggacaaaaaccatgtcagaatccattaatgttctaaagacagatgtttccatgctaactaccacactaataatatcacttgcatagtaatatcatgttataaaatattaattgctttaatatatattatttcctttctattttcacaagcatcctctaaggtagagaatattatttctatcttataaaaaagaaaaatgaggcccacatagatatctgaggtgacatgacaaattcagggcatgctagatctagaaacaaattatttctatgtctgaggttcttttcattgtcctgagctaaacccaaccctttttcaggactggtcctacctaaaccagcttctctagaagaacttacttgccattcaccagtagcagaacaggctggttgttgactcgatcgtcactttgatgccttttctaaaatcacacaagaaaatgttcaggaaatagacctataacaaactgcatatagaagattaacattttgaaatattacacaatgtagttcccttctttgtaattctccttttcccctgtcccaagcccttctttccttcaaactaggccaagaggttgattatctctgggaagctgggaagagagggcaggaaaagaatccagggagaagaaagagacaaaattttagttttaaatatcaaaagcaaaaaacctggaggaatgagaataacatatcaaaagctgcagaggacacaatccaaatgatgggcagggctacagaattctgtctgcctgggtaggtgctgggaaagctgagtattctcaagcagactcctaccctacctccaaccatggttgacatacagaagcttctatagtggctgaggaaagaggccaatatttaaagatcaaatagaagggaaacaaatagaggctatgtcctgatgccaggattcacataaatatcttccttccagttgagattactccctgagtaaagggtaggactgggagtggggcagagagaatcctgaatttgtcagaattcaaaattgtccaaatatttatcataaagagactgaattctaagccagaagtaattgggttaccatgaattggtaaattaatttttggttctcactggagagagttaagatggggtatgcatgtggttataagctaaactgagttcagttatagagaaataaagttatattttcgtacatctaagttgtgactgaaaggtaaaccacaacatgctaatcctgggtttatagagataaagtgctgaggaaacaaggtgctctcaaactaggctaaaaatctattctggcaaaatcagaaagaccctcttagggaaactgcaagcaggtctataggactggctttccaaatcctactagtaggcatggtactgggtccttactctcacccctctatgctgggcctgctgtaagaggcaaagaggaagccatgcagcactcactgtgagccagtttctctttcaaagccaggacagagggttcctagctgtgcacacttaacagaattgaaagttggaaaggaaaatagagttcgagaggagacaggaaatgtggagagaagaaagagaaagaataggagagatggagcaggggcagatagaggaaggcaaagggaatatagagtaggagaaggaggagcagaggaaaaaggatgagaacaaagctagaaaaagctaagagaggagtaaagaaagagtgggttattaaagatggaaggaggctcaggagaggggctaaaagtggtggcagtaggaagatagagaaaggccttgttttgcccctttctggccatacacagaccaccaatcttgggcctaaaggtactgcatattactctgggatgaataaggaaagaagaaaggaaatatctctttccattcagggtttcttgttagcactaggtagttctgggaagtccttcatgcccacagtctgactaggtgcagtgaggaagtagaggcccaggaagctacttcaccaggtcatcgatggcatctttcacagctgttaatggacagcaccaccatcaggggtgttatagttgtataccatgtcaaggaggagatctggggaatcaactaagagagggaaagggagaggatcttgggtcagaaaactgaaaggataatacattcccccccaccacatccctcaccctcaacatcattttcacctccatttgttcatactaaatccaactatcctagttgctttccactgttgtatctttcatataaccccccaaatataagtaaacatttcccaagggaggataaaagaataaaaggctataagttgctacctatctatcctgaaccccactacctttgtgttgatggcaaagacccatttctcctttgacagtgaaaagtaatgggtatggagagtgggtaaaagtagatacagaaaaactacatgctctcccacacccttcagtacaaggaggagtgagatgacctgtccctgtctcccaatttgggcctaccctgccctgcttcctgttcttatgctggcactcatattctaaaccattctaaaccttctttagcactcccatatgttaattttatgtcaaggaggctgggacaagaaggaggaatagagttggagttgtggttggggtgaagaattctgtagccccctatggtcaaactgaactgtggcaatacagccatgatgaggagctccccttccttgggatgtggtgaccttgtccctttccttgtgtagaggcttgctatacactagctaatcctgaccacagctattctaagggactggtctgagactccagccatccacgttcctgttgtctaaagagagaagacatttcccaatttagggaggagaaaaactgattacacagcctgaccccagagaggtttataaaatactctgtgaaaaaggcccccaaaagcaatacctgtaaaaatagcaaaatgaggaaatatgcatttgcaagtctctggaactgttcaaataggttcaggggcaggaaattaaagacactatattttgaggtcttgatggcattgttctgtgagtaaacaaacaaataaacaagaaatacacaattagacaaaagacagctcaaaactgggttgataagcagctgcgcctacttcccagtctacccctagagaggcctagaaggtagaaagatggcaagactgttgggtacttgggggaatgtatctctgccctgatagagttcttgcttattgatgttattgatagtaataatgataatcaaatcaacagcaataaaaacttacatttattgagtacttacttcgtgaaaggcactgttctagcattttatatgtagcaactcatttactcctcacaacaatcctatgaagggggtacttttgaggatgaggaaattgaggtactgcatccagagctctctaacaaagcttttcttagctgagcaaactcagtttggtgtgcctttctgtgttttttgcaatgttgaaggacgtcagatgctaaaagcaaaaaactgtctttcaatcctagcccactgaaggtttctataggggtcactatcagcattggagaatcatttggcccttaattgtcctaagaggatttaaagagttttggcttatatctaagctactattttgctcagtgaaaatgggaacttgtctacttcctcaattctgatctcaagatgttcacaggaccatcttactttctaccttggagtcttaaatcatttgtcctaagatgtcagagctcaaatctaagagctctaaaagcaggagaataagaccaaataattccctaagttcagggctcatctcctacctcttccatttaaaaggacagaacaaaagaataaaaataactaatggatactaggcttaatacctgggtgattaaataatctgtacaaaaaatccccatgacacaggcttacctatgtaacaaacctgcacatcctgcacatgtgcccctgaacttaaatacaagtttgtttgttttgttttttttaaaagaagaacctacctatttccttagggatgagaagctggtcaaatagcttagcacttaggagtttagagatccaagccaaaactaagatttccttggtgttctctccatgattttccaaataataatcaatcagacagtatagcatttctcaaggcttgctcttttcacagccttatgctggactatactagtggaggctgaaaaataattagacaggatcccttctggagaagctcatggtctgtcttgaacgaagttctagtaaaatgatctctacaggcccttctcatcatgagagtatgtaattctaacatggaaatagctttctttgatcataagatactttgaatttctcagtgtttaagtccagatggctgtgatacttggacccaaagatcttctgagaggtggccttactgatgtagctagccttcactgttgattttccatttgattttatagccatttaatatatttcaggtttctactcacgtaggtagcattctgcctcaagatagaagtacaggtatttatttattaacttggcaactagagcgtttcattttgctcttaaatgtaaaaccagaagcaatatcctaataacatctccttaactatgaagttcctcagagtttagtccttttggcagaggtgataaaatttaaacatgataagaggtggttaattttggtttggttatttttttctttgggcagtgatatgggactgaaggttaattgggaaaatagaagagaataaaaggccaaggatataatgagaatcagtagttaggagttaggaagatgacaaggagtcacagtggaagaagttagagaaataggaaaatgagcaatgctcagggccagggaaatgaaatggtgttaaatatatcagaatcagtcagatctgttcattcactcattcaatattcaatatatatttattgaatgttggctgtgtgcacaacattgtgatagaaactgtatcacaaatatactgtgtatacagagataaatgagataccctttttccaagggctaatagttttttggagaaacagaactaacattttcagaaccatacttaactcctacgaccaccatgcaaggtgaacattattatgcccattttacagatgaaagaactgaagatcagagaagttaacaaacttgcctaagacattaaggttagtaaaggctgagctatattcaaactcagatctgtctgatgcccaaacctagatttactgtccccactgcttgttacgtaggtctagaagatagagaagagaaaaacctgctttcatggtcatatcttggatactattattatccagaactatttgatatggtttggctctgtgtcccccacccaaataccatgttgaattgtaactcccagtgttggggagggacctggtaggaggtgactgaatcatggaggcggctttccctcatgctattcttgtgttctcacaagatctgatgatttaaaagtataggatcctcctcactctctctctctttcctgccaccacgtgaaaaaggtgcttgcttcccctttgccttctgccaggattgtaagtttcctgcggcgtcccagtcatgcttccagttatgcctgaggaactgtgagtcaattaaacctcttttcttcataaattacccagtctcaggtagttatttatagcagtgtgagattggactaatataccactctcactcagaaatcataaactaatatcccacagagaccgcagacatatatttttatataattatagctatgtatatgtatacatagctacacatgcatggaattatattatgctacacatgcatggaattatattatgtataaaaccattgcttgtgatcatagaagattgaaaacaacccaaatgtccatttaaaaggaactggttaaataaaatatgttaaatctgcagaggaaatactatatattatagctgaaaaaggaaaaaaaagaaaaaaactattatgaaattatgatgatgaaaacatctccaggatatactgttaaggttcagaatagtgtaaaaataggaaaataagactatatatttgtatttgctttatttgcacaaagaaacactaatctgattaatacacacaagaaaactaacagtggttccctcaggggagcagatatggacaaggatggagtattggagcatgccttttcaatatatatcttttcatgaattacttagttatagacacataaataagtgaaaaatgaacaattcaataggaagtgggcaaagatcattaataggtattttccagaaaaagaaatacaaaaggctaattaacatgtatgtcattttcatctaagagctggcaaagatgacaaagattgataataatgagtttgacaggaatgtggagaaacgggcagtctctaagtagaaacataaatggatataattcttttggggggcaatctggcctctgataatttttaatttttagtgtgtttttcttttgaaacagacaatttacttttaggaaactttcataagatacagtcacacaaatgtgccaaaatatatgtatagtggtgttcattcagcaccatttagcatagcaaaacactggagacatttaaatgttcatcaatagaagactgactaaataaattcaggtttatcaatataatggaaaacaatgtcgctattaaataaatgagggatatctgtatgtgttgtcagatacatgtctaagtgaaaaaagtagaactatgctttcatttgtgcaagaaaaactacagtatttattttctgggagttatatataaacctgaaatctaagacattctctccctagcttatgtcactagattaattttggcttctgagccttcattgcattgtataggagcttgaaagaaagtgtaatagaatctgtgttataggatccacaactacaaagaatttcacgctcccccaacaaagaagaatattataggagaatactgacccccttctgaaacagccagagggatgacactcaccggatatccaaaaatactgttgaattctttgttgttggcttgcagatatctctcatgttctgaaaaaagataggataaacgatgagatggatgcccctgtgtatatcagactgggatgttggctgctagtgaagacttcactagatccccacactttcttgctgaagatgtctatttaagcatgggattttgtctctttaatcaaaagaatcaagaaatataataaaaataaaaatgctcaagtattcaagctttctggaggcaacaggacaagtaactcctgaggagttctccaccatcaatgcttctagtacttcctagatcatgtctccacagacaacaagatggtctgcaccaattttactgacaaacacagaaacccagccttccctcataagtcaattttagcactttgtcttaatatatctgagactcttttctaagccaacttgtcctaaacttgcttaactaaatttaaattaataaacaatgactgagcatctattgcacagaggccagtgtactggatgccgtggagggataaaacgatgagtaagacagtctctgacttcaaggactttagtatagtaggagtaagcctgataactacttgacaaaatcatcacatcaaaacagaggtgtttgttacaaactactacaaatagtgagcctgttaccatgttatgaacaaacaaattatatatatatataatcaatagatctttctcccctgaatgaaacattcctatagtctctttggttcttccttggttcagcaagcatttgctgggttcttggcaggttcaggccctgtgctaggtcctagggttacgagatgaggaaaacatcatcctgaccatcttggtactattcctagtaggacagacaaatataaaataaaatttcaatctaatgtaagggcagagctacaggttggaggtgcacagaagaggggatggaagtcaaggaaagtaggacatagatgtattcctggaggagatgccttagttatttggatgatatggattaagtgcttcccagttctcttaagcctgtgtattataccaagcaatatagaatttagcctgaaggctgacagtgctcctaagctttctgcccttaatgcttctagtaattcttaggtaatgtctccatagaatttgccccctcagagagtgggtcgtagcaacccctctgcctctgagttgtattgaatatctactttaaagctcttctggccctctaaggtcctccttggcccatggctcccaagattaaaaagaaacttctttccttggccctcaaaaattctatcctaggctaccgactcctactctgatcttgaactacttgattcactcctccaagaggagtctctggctccaggtcctagaaacccaactctgcaattgttcaagttttttttttttttttgagctatgattcatataatataaaattcaccccctggaagtgtacaattgaatggcttttagtatattcatggttatgcaaccatcgtcattaattccagaacatattcatcaccccccaaagacacctcatacctgtactctcaattctgacctctcctctcagtccctggtggacactaatctattctctgtggatttgtctattctggacattttacataaacagaagcataaaatatgtggtcttttaaaactggtttctttcacttagaataatgtttccaaggttcattcacgttgtagtacgtatcagtatttcattcctttttacatctgaacaatatgtcaatgtttggatgtaccacattttacttatctattcatccatgattgggcatttggtttgtttccaccttttggctactgtgaagaatatggctatgaacatccctgtacaagtttttgtgtaaacatgttttcattcctcttgagtatacacctaggagtagaatcaataggtcaaatggtaactttatgtttaattttttgagcaactgctaaacagttttccacagtatctgtactattctacattccctcctcacaatgtatgagtgtcccaatttctccacattgtctccagcacttgttattgctcatgctttttactttagcaattttaaaggctgtgaaatagtatctcactgtggtttcgattagcatttccctaatgactaatgatgatgttgagtatcttttcatgtgcttactagttatttgcattttttttttgaagaaatgtctactcagattatttgaccattttaaaaaaatttcaacttctgttttacagacaggggtgcatgtgcagttttgtggcataggtatattgcacccacaacccctccccctctagtagtccacagtgtctactgttcccctgttaatgtctttgaccatttttaaattgcgttgtctctttatcactgaactgtaagagttctttatatattctggatagaaggcccttatcaaatatatgacttgcaaatattttgtaccattctgagttgtcttttcattttcttgatggttggctttgaagcaacaaagttttttattttgatgaagtcctatatgcattttctttggtcacttgtgtttttcgtgtcatggtttagaaaccattgctaatccaaggtcattagaatttactcctatttctttttctaagacttttatagcccagacgcagtggctcacacctgtaatcccagcactttgggaggttgaggcaggaggattgcttgagcccaggagttcaagaccaatctgggcaacatagtgagaccccatctctataaaaactaaaattaggcatgatggtgcagcctgtgatcctagctattcaggaggctgaggtgggatgatcatttgaggccaggattgaggctggccaatgagccatgattgcaccaccacactccagtcggggcagcagagcaagactctgtctccaaaaataaataaataaataaaattaaaaagagttttatagttttagctcttacatttaagtctttgatctattttgcattaattcttgcatatggtgaaataggggtccgtttttatttttatatttttgtattgtgtatatccagttctaccagcaccatttattgaagactattcgtttcccaatgaatagttttaacgtccttgttaaaaatcaactgaccatatgcattttctgtatctactgagttaatgcagtttttacccttcactctgttaatgtggtatatcacattgattaatttgcatatgttaagtgatctctgcatcctagagataagacctacttggtcatgacatatgattcttttactgtgatactgaatttatttgctaggattttgttgaggatttttgcatctatcagaagtattggccaataattttcttttcttgtagtgtctttgtctggctttggtatcagagtaatgctggcatgataaaatgagttgaaagtgttctctctttttcaattttaggaagagtttaagaaggactagtgttaattattttttaaatgtttgatagaattaacctgtgaagccatctggtcctgggcttttctttgttggttggttttgttttagtttttgttttgagacagagtctcactctgtcacccaggctgcagtgcagtggcatgatctcagctcactgcaagctccctggttcaataaattctcctgcctcagcctcccaagaagctgggattacaggcgcctgttaccacgcccggctaatttttgtattttagtagagatggggttttgccatgttggccaggctggtctcaaattgctgacctcaagtgatctgcctgcctcgacctcccaaagtgctgggattacaggcatgggccaccgcacccggcctgctgggaggtttttgattactaattcgatctccttacttattagtctgttcagattttttctttgttaatcaggcttggtaggttgcatgtctccaggaatttatccatttcttctaggttattcaatttgttggcatataactttataatagtctcttgtgatcccttttatttttgtggcatcagttgtacattttctctttcattttggattttagagtcttttaaaaataaaagtttacctaagggtttgtcaattgtgtttatcttttcaataaaccaattcttagtttcattattttttcttgtttttctattctccattttatttatttttactctaactccttccttctgctaactttgggcttaatttgttcttttcctagttccttaaggtataaaagtaggttgtttaattgagatctttctttttttttccttaatgtaggcatttattgcaataaacttttctcttagaacaacttttgctgcatcccataagttttgttatgtttccacttgtataaaggtatttttatttcaccttttggatttttttttcatccattggttgttattctagtttcataccatgtagttaggaaagatacttaatatactttcaatctttttacatttgttaagacgtgttttgtggcccaaaatatgatttatactggagaacagatccatgtgcacttgaaaagaacaatatattctgctgtttgggaatggaatgttctgtatatatctgttaggtccatttgttcatagtgttattcaagtccactgtttccttgattctctttctgaatgattctactgttgaaagtggattattgaggttctctactttactgtactgctgtctatttctcccttcagttctgtttatctttgccttatacacttaaagtaattatagataggtaagtatttagcattgccattttgttaattgttttctgagtgttttgtagttcgtttgatcctctcttgctgtcttcctttggccttatacatttaagtgctctgttgttggatgcatttatattcactagtgttatatcctatttatgaattggcccctttatcattaaataatgacctttctgtcttttatgacagatttttctgacataagcatagccacccttgccctcttttggttaccatttgcatggagtatctttttacatcccttcactttcagcctatgtatgtccttaaagttaaagtgactctcttgtgggtagcatattgttagatcttatttttttgttttgttttgttttttcattcaaccattctagtcagtcttttgatgggagaattcaatctatttacatttaaagtaatttaagataggtatttactattgccattttgttgttttctgagtgttttgtagttcctttgttcctctcttgctgtcttcctttgtgatctgatgacttttgtagtggtgtgctttgattcctatctttctcttttctgtatctactagaggctttttctttgtggttaccatttgtacaaattgtgaccaagatgaaactgggatgttcagctaggtttacccaaggatttgagagtaaacagatttagattatgtacactaatttggatagagttgacatttttgcaatattagccccctatctggtaacatgctatattcctgtgagagagacagagagatagctgttggtgtcctcctgggacgccactcctttgtgcatgatgatcatgtctatatagtcagcttaccagcaatacataagcaaatggctatgagtcttctctggactatgcttacaacccagctatgcagcttgtagtttgttctactgtactagtacatttcttccttcttatattttattcttgtgattattaggatgaatggttactggatgattactagttgaataaacatgggagaagttttatacttatgtgagatgggattgatatattttgtggagctttattttgactggttagtggcttatttacaactgtgtgatacaagggcttctgctaatcattgaagcttagcttctctgaagcagtggaatatgcatagctcagataatttagtcacatctaggatttagagctggtgtatggcataggccctttgtgcagggactttctcaaggggcacagatagctacctgattaaggcagggtaccagagaagtactggtgtttctactagtgttgagattctccagtccttggacaggctatgttcatactcaatatattaatggattactgaataaaatcagtttctcccatgccatttatcccttcagaccagtaaaacgtttctatttgtttaaaaatattattttataacttttgataaagttataatattttcttactggatttcacatttcttattaaatttaatcctaaatatccctgattattttttaacctaacaagggtctaacagcctctgccagcaacttatctgggtgaaacaggccattctctcactagttctgagggatacctggggttcagcctctatgcaacaactgaatactgaacacatatctccctctttgagttgaagagtaaagtaaagcagtagatctcaaggttcagagcctgagttgctaaagacagattgagactccgaagtaggggcaggattaaccttcaccttgttctggctctttaatgacagacctgccatgaagaaagaagaaggagaaaggaaagtaggattttcaccaggagaagaggaattgggggctagaaagccagatttcctaagaggtctacgatgaaggaaaagaaggaatgatgagaaaagtggttaaaacatcactttgcacaaccatctaagagaataaactaaatgtttgagagagaaaaaaggcaggctgtaaggaaagaaagtaaccagtcttgtttgagatcataaaggcaggaagaaagttttcagactggataataaagattaattcaagattccctggggcatgtaaatactgtaagagaagactgggtgactaagtgttttccccattacttgttaattcaaaggttattcctgtttggctgaaacgagaatgacaaaatgtgaattatgggtgagaggttagaatgacagaaggttggaaattagttgagacaaggagagtctaggaaatagtctagttgaagaagtcctagctatggaactcaaggggacaaacacctacttctagccactggtgactgtggaaaattcattctccattaggaactgagggttgaatctacagcctattcaaagactggtttcaaaggacctgtcctaaaagctggcctgcgcatggtgaaataactgaactaaaagggccagacatcttggtgaagtgaggcaagctggtgttataaaatgtgcagtagacttaaagttaaaaaatatagaaagctcccatagtggttaagaacacagacaattgagtcaggctgtcagggttcaaatcttagtcttccacttcagagcctgagttggcaaagacagattgagactccaaagtcagggcaggattaaccttcaccttgttttggttctttgatgacagacctgccacaaagaaagaaggaaaaaggaaaataggattttcaccaggaggagaagaggaattgggggctagaaagccagatttcttagccttgggaaagtaacttaacctgagattcattttatttttctgtaagatggaaatgataataatatctactcataaggttattgggaggattaatgagttaaggcacacaaaatatttgaaaacaattcctaataattaaaaatgctcaggacattttagctattctagactggactctgcaactaaattgttaagtgacctagggcaagtcacttttcatttcttggctttagtttcttcatgtgtaaaatggggtagtaaaacctactgtatatactaatagggctaaatgagatgataaatgtaaagtgcctatctgattcctgacaaatcaaaagtacacattttcaacctgagaaaaggtgaatgaaaaacaaataaaaaatgagaaccacacaaaagtacacattaggctgggtgcaatagctcatgcctgtaatcccaacacattgagaggccaaggtgggaggctcacttgaggccaggagttcaagaccagcctggtcaaggtagtgagaccctgtctctacaaaaaaaatttttttaatgtagctggcatggtgccacacacctgtagtcctagctacatgggaggctaaggtggaagaattgcttgagcccagtagttggaggctgcagtgagcttgatcatgccactgcacttcagcctgagtgacagagggagaccctgcctctaacaacaaccaaaaaaagagtacacattaaatgttatattctgttatttatcttataatatgtcaaggagattccatatgcatcattgatatagttgtctgtgcccaaaatagattttgaactttcagctaccttctgtggatgcactaggctaatccaggtagtggaaaaggaagggtacaaaagccatagtctagtgaggagaattctgtctacctggtaaaaaggtagtagaagtctcaaaatagaagaagcctctgtttaaggatataatgcttagagttttgactcaaatgccagggtgaaagacttagctcttacgcaacatatgtaataccacctcgggttttaggggttaaagctacagaagattggcgattatcctagcaaggaaatggcagaaactaaaatggaaaatgagctctgtaagatgaaacaaaagaaagtagcacgctgaaatttaagtaaccaggaaaagaaggaggagggcagaaaaggaatgaaggccagttagtcaggtggcaatcaggcttaggagattctgaacaaatatttccttgctcacaatggtgaattgatcacaaatgggattttccagctaatgcaagaacaatgagatgatcttccggagtgcaagtctcttaactactagattagtcaaggcttactctccatatactactatactcacagttccattaagcccaggtgctggcagggcaaatttagcaatgaccccttgctgtagttccagattagcaggcctaggtgatttcagccaagtcatttaatggctgtcatagaaatctccttttcctgtctctaaaaataagtgaagacagctgcaaggggaaggataaagggctaatttcaagtcagattagttggagacagttatggtttggctgtgaccccacccaaaatctcatcttaaattgtaatcccataatcctcacgtgtcaagggtgggaccacgtggaggtaattggatcacaggggtggtttcccccatgctgttctcatgatagtgaatgagtctcatgagatctgattttataagtctctggcatttcccctgtttgcactcattctctctcctgctgccctgccaagaggtgacttctgccatgattgtaagtttcctgaggcctccccagtcatgtggaaactgtgtgtcaattaaacctcttttctttacaaattacccagtcttgggtatttccttatagcagcatgagaacgaactaatacagagtcagttcgcattaagaatactggaatttctcacacagattccaaatgatcacaatttatcctatggtagtcaaataacaatctaaaacattacagctatcagtagattttagctaaccatatggcttaaagtcttgaatacacaagaaaatttatttttcatctctccagacttcatttctgagatatctggagcataaccactagatatttccatgtaaggaatggtaaaatgactaggcatggtggcttacacctgtaatcccagcattttgggaggcttaagggggaggattgcttgagcccaggagttcaacaccagcctgggcaacaagcaagacaccatctcttaaaaaaaaatgtatgctaagaagaacagctaaatgatgtagcagagagtcatcacagaaaaggccagtatccatggccctgcagaaagggcagtaactaatttgctttctcgccaccatttcatcatgtgtttctggttcagtctacccacagctacatcccatggtttatatttaacttacttatcatgcttacttacaataccagcattctcccactaaacaaagagctccttataggtagagaccatgagatcagcttttttagatgccacatatgagtcagatcatgcagtatttgtctttctgtgtctgatttattcacttaacataatgttctccagattcatccatgttgttacaaaatgacggatttacctcttttttcatggctggatagtatggtggttaccaggggctgggaggctgatgagggaggagttggggaaatgttgatcaaaggttacaaatttcagttagataggaagaataagttccagggatctattgtacaacatggtgactataataaataacaatacattgtattcttgaaaaattcaaagagtagattttaagtgctctcaccataaaaatgacaactatgtgaggtaatgtatatgttaattagcttaatttaaccattctggaaggggttttgtgtgtgtgtgtgcatttcaaaacatgttgtatgcaataaatatatataacttcatgttaattaaaaaaaccattaaaatatttcagtagcttttgaggtacaagtgattttggttacatggatgcattatatagttgtgaattctgagattttggtgcacccatcacccaagcaatgtacaccgtacccaatatgtagttttttattcctcactccatttgcaccctcccccttctgagtctccaaagtccattttaccactttgtatgcctttgtgtactcatagcttagctctcacttataagtgagaacataacagtagctagtcttccattcctgagttacttcacttagaataatgtcctccagctccacccacgttgctgcaaaagacattatttcattccttcttatggctgagtagtattccatggtgtatatatatatgaaattttctttatccacccattggttgatgcgcatttaggttggttctgtgtctttgcgactgtgaactgtgcttcaataaatgtgtgcatgtgtctttttcacataattacttcttttcttttgagtagatacccagcagtaggactgctgaatcaaatggaagatctatttttagttctttaaggaatctccatactgttttccatagagattgtactaatttacattcccaccagcagtgtataagccaaatacttacaaccacatccttctcttttcaccatatccataccaatatcttttttggctattcttgtaggagcagggtggtatatcattgcagttttaatttgcatttccctgatgattagtaatgctgagcatttttttcatgtttgttggacatttgtatatcttcttttgagaaatgtctattcatgtcatttgctcactttttgatgggattattagtttttttcttgctgatttgtttgagtttcttttagattctggatattagtcctttgatggatgcagggtttacaaatatttccccccattctgtaggttatctgtttactctgatgattatttcttttgctgtgcagaagctttttagtttaattaggtcccatttatttgttttgttgcatttacttctggggttttagtcatgaattctttgccaaggcctatgttcaagagagtttttccaaggttatcttctagaatttttatggttttaggtgctggatttaagtcttgatccatcttgagttgacttttgtatacagtgagagattgggatctagtttcattcttctacatgtggctaaccagttttcccagcaccatttattaaatagggtgtcatttccacagttcatgtttttgtatgctttgtcaaagatccgttggttgtaagtatttggctttatttctctgttctctattccattccattggtctacgttcctacttttatactagtactatgctgttttcgtaactatagccttgtagtataatttgaagtctggtaatgtgatgcttccaggtttgttctttttacttatgattgctttggctattcagggtcttttttggttccatataaattatagaattgtttttcctaattttgtgaaaaattatgctggcattttgataggacttgcattgaatctgtagattgctttgggcactgtggtcattttcacagtattgattcttcttaatccatgagcatgggatatgtttccatttgtttgtatcatctatgatttctttcagcattgttttatagttctccttgtagagatctttcacctccttagttaaatatattcctaggtattttatattttttgcagctgttttaaaagggattgagtgttcttgatgcgattcttagcttggtggttgttggtgtatagtagtgctactgatttgtgtacaccgattttgtaacttgagacttttcaaaattcgtttattaaatctaggagtcttctggaggagtcttcagggtcttctaggtatatgaccacatcaccagtgaatggagatagtttgatgtcctctttccaactgagatgcctgttatttctttctcttgcctgattgctctggctaggacttcctaatggactatgttgaatagaaatggtgaaagtgggcatccttgtcttgttccagttctcagggggaatactttcaacttttccctttcagtatgatgttgactatgggtttgttatatgtggcttttattattttgaggcatgtccccttctgtacctagtttattgagagtctttatcacaaagagatgctggattttatcaaatgctttttctgcatctattgagatgatcatactttttttttttttttttgagacggagtcttgctctgttgccagtctggagtgcagtggcacaatcgtggctcaccacaacctccgcctcccgggttcaagcgattctcctgcctcagcctcctgagtagctgggactacaggtgcatgccaccatgcccggctaatttttgtatttttagtagagatgggatttcactatgttggccaggctggccttgaactcctgacctcatgatccacccaccttggcctcccaaagtgttatattacaggcgtgagccaccatgcccagccaatcatatgtttttaattctgtttatgtgatgtgtcatgattattgacttccatagatgttagaccatccctgcatccctgggatgaaacccacttgattatagtaggtttgatcaacccacttgatctttctgatgtgctgttcgatttggttagctagtattttgttgatgatttttgcatctatgtttatcagggatattggtctgtagttttctttttttttaatgttctttcctggttttggtatcagggtgatactggcttcatagaatgttttagggaggattacttctttctcaatcttttgaaatatttcagtagaaatggtaccaattcttctcttaatgcctggtagaattcacattagaatccatctggccctgggcttttttattgctagcaatttttaaaaattactcattcaatctcactgcttgttattagtctgttcaggggacctatttcttcccaacttaatctaggagagttgtatgtttccaggaatttatccatttcctctagattttctagtttgtgtgcatagaggtgttgttagtagtctcgaatgatcttttatgtttctgtggtgtcaactgtaatatctccagttttatttctaattgaatttatttgaattttcttttttcttggttaatctagctaatagtctatcaattttatcttttcagagaaccagctttttttcatttatctcttgcatttttttgtttcaatttcatttagttctgctctgatttttattatttcttttcttatgctagctttgggtttagtttgttcttgtttctctagttccttgaggtgtgatattagattgtcaacttgtgatctttccgactttttgatgcaggcatttagcactataaacgttcccattagcacttttttttttgctgtatctcaagaggttttaataatctgtgtcactactgtcattcatttaaaagaatttttaaatttccatcttgatttcattgttaactcaaaaataattcaggagcagattgtttaatttccatgtatttgtatagttttgagggtttcttttgcagttaatttctacttttattccactgtggtctgagaaaatacttgatataattttgatgtttataaatttattaagacttgttttgtggcctatcatatggtctatcttggagaatgttaaatgtattgatgagaagaatgtatattgtgcatatcttggatagaacgttctgtaaatatctgttaggtccatttgtttgagagtgtcatttaaagtcaattttttttgttgttgttgactttgtcttgatgatctctctagcactgtcagtggaatactgaagttccccactattattatgttgctatccatctcatttagtaggtctagcggtaactgttttacgaacctgggagctccagcgttaggtgcatataaatttaggattgtaataccttctcgttggattgagccttatatcattgtataattaccttgtctttttttcactgttgttgctttaaggtctattttattttagataagaatagccactcctgcttgcttttggtttccatttacatggagtatctttttctacccctttaccttgagtttatataaatccttacatgttaggtgaatctcttgcagacagcagatatttggtttgtgatttttttaatccattctgccaatctgtatcatttaagtggagcatttaagcaatttatatgtgacattaatattgagaggtgaggtactgttccattcatcatgttgttatctagatactttgtatttttcattgtgttattgtttcataggttttgttagttttatgctttccagaggtcctattttgctgcctatcaagcttttgtttcaagatttagaactctttttagaatttcttgtagggctggtatggtagtgacaaattccctcatcatttgtctgaaaatgactttatttctccttcatttatgaaacttaattttgctagatacaaaattcttggctgacagttactctgtttaaggaggctaaagataggaccccaatcccttctggcttgtaaggtttctgctgagaagtcttctgttagtctgatgggttttcctttacaggttaactgatggttttgtctcactgctcttagaattctttccttcacatcgactttagatagcctgatgactatatgcttggtaatgtcctttttgcaaggaatctcccaggatttctttacgcttcttgtatttggatatctaaatctctagcaaggtcagagaagttttcctcatttattccttcaaataagttttccaaactttttgctttttcttctccttcaggaacatcaattattattaggtttggccattttacttaattccatatttttggagactttgttcatttatttttattcttttttattttttctgattgggttaatttgaaagccttgtcttcaagctctgaaattctttcttctggttgttctagtctatttttaaatctttccattgcattttgtaattccctaaatgtgtctttcatttatggaagttctgattagctattcttcaagatctctatctctttagaaaatttttcattcatatcctgaattttttttttttaatttctttgtgttggctttcacctttctctggtatctccttgtactcaaggaaataatcaaagcttaataatcaaccattcgaattctttatctggtatttcaaatatttcatcttggctgggtgtggtggctcacacctgtaatcccagcactttgggaggccaaggcgggtggatcacctgaggtcaagagttcgagaccagcctggccaacatggtgaaaccttgtctctactaaaaatacacacacaaaaatagctgggagtggtggcacacacctgtagtcccagctacttggggaggctgaggcaggagaatcgcttgaacccaggaggcggaggttgcagtgagccaagatcacaccactgcactctagcttgggtgacagagggagaccccatcacaaaagaaaaaaaaaaattcatctttgtttggatccatcactggagagctaatgtgatcttttgggggtgctacagaaccctgttttgccatgttaccagaattatttttctggttccttctcttttgggtagaccatttcttctagttattatagaattattttgattgtgttttttaaaaatttctttttaccctcttaaggatctgactttaatgtttactgtagcctaattcggctcttggtgctttcaggggtgaagattctacgtaagttccttggttactggcagtctttgtatgatggccttctcagatgctagtttgtagtaacaatgtgcacagtatgtgcgcaagtttactgtctcacagggggttggaacagcagagttctcttgaagcttacttatttcattcccctgtggtatacacctttttgtttacttatttttccctagtattttatttactggttgaacagtctgggcttcaggccagcagaggaggtatccctgtgtagaaaccagttgtggctgaagcaggtgggtaaatgcagtacccaatggtgggcagaggtcccaagtttgtcagaggtggctgggggagctctcagtgagaaacactgaggttttatcaggcagaagggtgggagccacctcagctcccctgccaggccagcaggacacactcctgactgtgttctagctattcagatcagacaggtacctcttttcatctgcaggaatgttgatgttccaagtaaggaagaattgtgactctacctcttgtgcaagcctgaacctggagagtgctcctcctatggggatacagtcaccttgaagtgttccagaaatgctatgcatagatgcactcacaccaagctcccatgggagaagccccagctgtgtctgcaatggtggatgagggggaaaagaagtccccctctctgagattcttcacaagccgcaggcttggtgcccggctgttggagtagagctgcagactttccctgctaagtccagcactgcaactgtgcccctgctgaaagaaacttccaccagcagaaagatctgggactcagggcctgccatctagagtcctttgtcccatggggtattcccttgacgtagtatactcccctttcccctagaagtaggagtccctgagagccagactactgtgaattctgttgctcttctggatctagccacctagaggggctgccacactccaggctggtactagggaatgtctgcaagggatccagtgatatgatgtgttctcaagtttcccagaagcaggtactagcactggctctgatggggtttgcaggggagtgacatagactctgtgagattccttggttatagctagccttagtgtgttggctttctcaaatgccagtggtagtaagtaatgacctggtcacacgaacagactcaggacctcctggtcggctagtgtggtgcagacaatggtgatagctgaggtcaggcacaagtttcttccttcccgggtgcagtgttattctacctggaggtgctgtaatggactgtgttggcctctagccacaaggtggcacttggaaaagaacaccagctgtggtagtagtggtgggatttgtgcttgccttatatctccagggaaggtattctggtttctcaggcaatggatagggtcataaagctccccaaagtttctgtcctttgtgttaagctaccagggcgggtggaggggcaaagccaggtggaggctggataagccaggtctgtgctctggctctccacatgcacggcaagcagcggcccctgtggagctcaagggacagttctctggccactgggatattattccaaggagaagcatagctgtttctactgtacagaagagttcgcacaaggagtaagagtagcaggtggcagtaagtcccacccagctctcattaacatgacaagacagatctgacactcccagtaatctactagcagcagcaagctaaggtccaggccatcttgctcagaactaaaaattgcccaggccataagccttccctgcagagatactatgtgaggtactgcatatgttaattagcttgatataaccattctagaaggtatgtatatatttcaaaacatcatattgtacacaataaatacgtacaatttcatgtcaatttatttaaaaaaggtagagaccatgttttttcttttctttaaatctctgtagcctaccgcttggctcagcattaggctctggatataataaagatttgttgaatgaacaagtacacaagtgaaaaatgcttagaaacatgttctgctcaattggggtcagattgctgtccaaactcctccagtagaggacaatcgcctcctccttatgggaagatctatataatcacagaacagctggactcaaagaggagcctcagctaaggctaatggtttgttgacacttctatgcaaaagtcagcaaaccagaggatattcagcatggctgtagagggtgtgtagaatgcagtgttaagaagagctttgagaagaagctcactaaagtctggaatgtcatgaaaagtccagctcctgagctactactgatctcctgcacctctaagtctgaccatcccctaaagcttcattaatttttctgtctgagttaagcaaaaacaagtctaaaattgttcaaaggagcctaaagaaaatcaaaataatcataaaagctgtccaatttattaacaagggtccatagaaggttggtttggctggcacaatttaggacatgctcaaaaaccaaaggccctattccctactccctttacagacctttggcttctccctttctgtagggcagaagctgacaggaacatccaggcggatggaaattgggagttgtgctttcgtactctgaccacatttggaatctgggaccaatgatttctcatcaatgcagtaaaggtaaaatcaggcttgtatgactgaactgctagacattactttcagtgcttctccatcataaaaccttccctgggatagcagacgagggtttgggagttatatgaaaagccgtcagttagaaacaaaatgccttggtgatgctaaaaaagcaatttaaatctaaaggattcaaaccttaaccccttctgtttagggttgccagatttagcaaataaaacattcagatacaagataagtatgtcccaaatatcagatgggacacacatactaaaaagttatttgtttatgcagtggcatgatctcggctcactgcaacctctgcctcctgggttcaagcgattctcctgcctcagcctcccgagaagctgagattacaagcacgcgccaccatgcctggctaatttttgtattcttactagagacggggtttcaccatgttggccaggctggtcttgaactcctgatctcaagtgatctgcccaccttgtcttcccaaagtgctgggattacaggtgtgagccaccgtacccggccactgggaacttttgatctgtcttttctaaacaactttatgaggtaaaatttataaaccatacaattcacctattgaaagtataaaaattagtggtttttagtatgttcacagagttgtgcaacctaaatgtctacttttgtgtttatttaatgctcttttgtagagtattctgttactaagactctgattaactttcctgtctacatgccacaatatctatgccctcttccttcctagagtcctttttctttttttccttttctgtcctttctttttagtttctccaacttagttattttccatttgtgattacacttttttctttttattaattttaagaattacccaaagtaatataaaaatacatttccactgtaaaagattcaaaaacaaaaatatatacagaaaaaatttaaagtttcctttcctgtgccttccactccttcttttcctaaggaaaccactataaatagattggtgtatatcctttaggtcccttccatttcaaggaatttatacacaaatatttatgtatatatacacatctctctatatatatatttttaatgagatcctactacatgtattgctctgcaagttacctttttctttttacactatgtattggtcatcttcccttgtcaatatgtatagatttactccaaccttttgaattactacctagtattattaagctaccttttgataactgttgataatttttattgttgtcttgtggtggtggtggtggtgatgaagatggtatttacagaagtgtgtggaaggtaaaggaaagggaaaggagaaatataataatgggacagtcttgcaaactctctaggacagagagaactctgaaggcactatgctaggcagacaatctaatggaatcacacaacatagatgtaaaacagcaaagcatgtcaaggcagggtgtacataagatgttaaatgaattgtagagacccaagataattaaaattgtatgtccacacaaaaacttttacacatgtttaccgcaacattactcataatacccaaaaaaatggaaacaattcaaatgtctatcacctgatgaagagataagcaaattgtggtatatccaaacactggaatagtattccgccataaaaaggatacatactacaataaggatgggccttgaaaacataagtgaaggaagctagtaacaaaaggccacattttatatgattctatttatatgtcaagtccagaaaaatccattagtggttgccagggtataggagagcagaggaaagaactgagagtgaatgctaacgggtatagggtttctttctgggatgatgacaatgttctacaattaagttatggtcatggtttcaaaactctgaatatattaaaaatcactgaattacatgctttaaaagggtgtattttgtgacatgttaattgtatctcaataaggctattattttaaaaaactgggccaggcatggtggctcacacctgtaatcccagcactttgggaggccacttgagtggcctcccactcaagtgggtggatcacttgagcccagaagtttgagaccagcctgggcaacatagtgagatcccatctctataaaaaagtacaaaaattagctgggtgtggtggcatgtgcctttagccccagctagttgggaggctgaggtgggaggatcacttgagcccaggaggctcaaccaatgagcctcaagttgcaatgagccaaggtcacaccacttcactccagcctgggcaacagagtgaaactctgtctcaaacaaacaaacactgtagaacccaagcactacaggaattcaagaaggagagataaaggggggcagggcagaattgttggaaagagcttcatggagaaggacttgcactaaactcaagagacgaacacaggttaattaggtagagatgcaggggacagttctgtaggcaggaaaaaggacttaatgaaagggttggcattgagactagacaagttgtatgatagtacagtaagtacgaaaatctgaaggaggcagaaaacaagaacttcaagtcaggactttaatattaggataatgatattaaactttatctcagagaatcctacaaagattttgagtaggggaaaatgtgataaactggaagttcagaaacattaatatgatagatttacaggggaacggagtgcagacagaaagaccacttaaaagacggctataatagtcaacacttaaaatgatgaaaggctgaactaagaagtggtagaaaatagaaaggagaggcccggcatggtggctcacgcttgtaatcccagaactttgggaggccaaggcgagtggaccatttgaggtcaggagttcaagaccggcctggccaatatggcgaaaccccgtctctactaaaaatacgaaaattagctgggcatggtggtgcatgcctgtaatcccagcttcttgggaggctgaggcatgagaatcacttgaaccaggaggtggaggttgctgtgagctgagatcgtgccactgcactccagcctgggcaacagagcaagactctgtcaaaaaaaaaaaaaaaagaaagaaagaaaaagaaaagaaaatagaaaggagagggtagacaaccaagatgttagaactggccagtatttatgtactgtagattttccaaccagaataggcctgaagattctgaatattcaaaatagtgttacctgccaaatgattgggtttagcactgtcgttttgtaaattcagtggaataggccaaaatcttgggtaaaccagtattaattgcttactgctcaaaatagcagaagcagtaaatctacctgcaataggtagtcctagcctacctgtagggatttaccaggaaaactggtttcaactctttttccttggtaaaaggtttggcttttgaaataacacacatttatagatgaagttcttaattatctttctgattgaaagtgtcaagctcttatagattattttgattattttttacacatttaccagtgtttatcatgtggcagatactgtcctaaatgctttataaatattacctaatttaatccttacagcaaccttatgtggcagcacttttattattatccccattttacagaggaggaactgtagcagagaaattaagagatttgcccaagataacgtggtaagtggtggagctaggattcaaacctagacggtatgactccagaattcatgctcttgactactatacttcccatatggtatttatttcactgcatttatggcagatattttatatttattggtgctattaaatatgctgttaattaatgtttcccctcgctaaaccataatctcgctaagagcagaaattctgtctagttttgttgccattgtattgccatacctagcacagtggctcgcacttatttaataatcaataaatatttgtcgaatgaattgatcagtctttattgatgattattacatttttcatttgcctggaacttaccacaccctaaagtattctggctctccatattttctgttcataagaatatgcagagcagttgattatcttctgggtcctttagccctttagctctcctgagggtagcagaggactccctggttttcctttggatggaagtttcctgactttctacttctggaaccagggccagtgtccttgacatgggcttcctccaggatgaaatcggacaactgcccaatgacagcaagtaaagaaagtatactcgcctataatcccagcactttgggaggccaaggcgggtggatcacgaggtcagctggagaacatactggctaacgcagtggaaccccgtctctactaaaaaaaaatacaaaaaattagccaggtgtggtggcgggcacctgtagtcccagctacttgggaggctgaggcaggagaatggcgtgaacctgcgaagcggagcttgcagtgagcccagatcgcgccactgcactccagcctgggcaacggagcgagactccgtgttactaaaaaaaaaaaaaaagaaagaaagtacactgtgaccttcaatcagtgaactgatttcattctgcactttctccattcctcaaaaggaagcctaaatctaaatcttcctttttcaaaatttcacattagaaataatttgttgttgttgttcttacataacaggcagttccattctgaaagatggctggagtgtgattattcctgctccctttaggattttttttttttttaagatagagtttccctctgtcacccaggttggactgcaatagcacaatcttggctcactgcaaccaccacctcccaggctcacgcgattcttgtccctcaacctcccaagtagctgggactataggcatgtgtcaccatgcctggctaatttatttatttatttatttatttatttatttatttatttattttatttttagtagagacaggttttgccatgttggccaagctagtcttgaactcctggcctcaagtgatctgccggccttggactctcacagtgctgggattacaggtgtgagccaccacgcccggcctccctttagaatcttgattcaccaaaggaaagcacagaaatggtatggaaatcctcccttactacagagacagatccatttgttctgtccacaaaaaggctgcaaaggaggaccttatctgcctcagcagccttttttcacactgatcacctctttttagcaggaggcagttatgaagaatggggagagaaggaaaggtacacaagctttactggtgaatttccaaatataaaagttaagagagtactcaaattaggattttcagatgataaaacagtggagcttgtacttctaagtacaaagtatttacttttgaaaaatatatttcctttcctgatcagttgtttggtaggttaacaatctgattgccaggttgatctgccatatgtgcatgtatacacacacacacacacacacacacacacacacttcagaggtaataataatgacatactcagatacattttcctgagtttacctacgttcatcttgtctgtcctcacttgggcttttaaatagagacattgcagagtagaccaactataattccatggaatttctataaaggaaataaagattcagaatatgagaatttctcatgctgatactgtgtcattcaaacacattcttaagaaacttggaacttgatccctgaagtccaaaatgatctatctctaagacacatatggtagtttggaattcactttatttatcttcatcataaagttatagtttcaaagcttgggaaacagatttcatttcctgacaactaagttgaagttgatgactacaattgtcagaaaagtcatctgaaacctagaaacaggtgaaataaattattggatgatcttttagtacagttttgtgtttatatctttgattagttttctattgactggactattttataactcgttagggcagaggttaacttatagattttcatctagtagtgataaaaatgttttatgtctggtggaaaagatgactccaaaatttatgacttattgcactttaggaccttaattagttttgtatatcattcagaaatcgtattttaacattcctttattaaattgcctataaatatttagctcttaatttttcatttgaactgatcttaatatcttactggttccctcattaattaataaataaaatattggagacctattaatttcgtatttatataaaagtcaaattttttaatacttggaaaaattatactttatcaaaccccacgatttgctatacagacatatccttctttgcttcctatttttctctccattcttaacccaactcagaaaaggccaataaagtatatgtattttaatcaatttctttcaggtcccctaaagtacagatgagtcaagactagaaaactagaggttaccttgcttaacttccttattttacagatgaggaagttcaggctcacacagggaaaaaatctttctcacacagctatatagtggcagagttaaatctagaatacagattcttcctactacttcaccatgctttgacgctgcactgggtaatgagtaggcacttaatatgctgacgactcattcttaaatttataaggggtttttgtctcttttggttcaatgctaggcctcatgtctagatgaatacctggcacatagtaagcgctcaaaaaatatctgttgcatttgaacctagtaccaagcaagacaaattccttggaagttaattagaactcagaggatcatttataataatcccctatacacttagagaaaatgtatagttttcaaagtgctttcatatatatgagcccatttgatccctctgaggtagacatggcaggagttattagtcctagataacagattcaagttattgaggctctgagaagttaaaggtcatctcctgactagaatgtagcagaactgggcccaatcttctgactcctacttcaataccatctccactatttgttgcttcttcaactttgcctgtctgcttctgggcttgggaggatcattcagggagttagtccgaatattcacaatgaatacgacagcgacaacttacgctgaaagatgtgatttttctttcttaaaagtccattgttaaaggtacttctgttctaattctgattagatatagcctacagaaattagcggctaattcaaatctgaaagcttgctgaagccatgggtagccagccagagtttgattcttccctctagagtaggtatcctatgccaaagagtgggagggaatgatagcaaacgtgccacttcagatcaagtatgggacaaggattatgacttcttcgagaatctgcacagtgctggaaaagtggaaaactccctgagttaacaagaatgtgcaattgctggagctttgggggtatctcttcatgaaataactggaaaaatgtgtgccctttaggagttacatgggggataaagctccccttccttagataatctcgacaaatatgtcctctgtgggagtgtctggaaaaccagtatactcgaatatggggagttgtctcaagaaagtataaggatagacagctactggaaatactgagaggggacagtctctcttcaaggaatattgggagggagaaggcgataacttctactcgggcacccactttgggagcctcttgctcaccgtcgccgcccggcctccaactccggcaactgccatctcaacgcaccttcctgcgcagacgccctagagacccaggttccggcgtagagcagagccccgcccacaaaccacgcccatctcccatgagcccgcctctggccacacccctaccctcaggtgccagacccaccgtttctccatggagagggcccctaggggccgatctggctttgaagtacccgaactatgctggccgctggggaaatggagatacaacactcagatcctgcctttgggtagatcacaggctgatgaggggaaagagacaagtaaattataacaatgtagagtgctgtggggaggcgtccagatagcagagcctagaaagcagtggaaaaggctggcagattttccagcaaggggagcagcatgtgcaggcacggaggggtaggagcacacagtgcttgtcggggacctgccggggcagtactttagaacagctgcaggataggggcaaggggggcggtgccggctgcgctatcttggagggtcttggagtttcagcctggaggctatgggtgaccactgaatagtttaataggagaaggactttatattggagtgcgtgaagagagcagggtaagaacggaagcaggggattatcacagtaactcaggcatgaggacctaaaagctgccacgactcttgtggtggtgggaacttgaggcgacccaatggattcaagaggtaattttgaggcagaaatgttaagtggctggcttgggagaggagcggggaggaggaagtttttaaatgagcaactgaactctaaggatttatttagcaagcagtggaaacggagctagttccctgtctggtgccccattagtccctgccccacaagtagtgttagtgcaggttgagagtaggtgagcactctctttcttgtttcagcttttcccatttccacgccatgaggccttttaccttatttcttcccctttgggagtgggctttctactgcagctcttcttcctcgaatagagcctgaatgaaagtccaaggtacagtcctaagcctaatcttctgtcctgtctgtggcagcctcagtcctctgccaagacgggcaggcacacctctccccagtgggcccctgccttgtcctcacaacccaggctgtgatctgtcctagtgattctagacaaagggaagagaagcatggactagttttcaccagaatacctctcctgctactcttttggaccttttgtaggaagctggtgccgtaggtcccatgactctgttaattagattggtggtctcaggtctaggacaggatgttagcccagtggtgtttatccagaaccactttaggcttcacccactggctgtcaggtatgggggtggaggagtgtgaagcagcaaaggaccattaggccaaaatctaccattataaaggacagtcatttccatggctttccacacattagcagaattaccaaaccccaaaggctgctataagataatttattacagactagcctataatctcctgtaacaatggcacatataataattaacaacagcaaagatgcttggtttcttgtttcatgtaatggccagtacatctgtggacaatgtcgagtcctcaggaagtccaggaggctgctacagaggaaatccaagaaccatgtcacatctctcaacaagtcttgggaagtccatctgactctctgaaacagtttgtctctgacctcccaggaagtgtggagggccccttccatccagcctgtacagagggatcagagtccaggctccttctatagggttgaatatcagaggggaatagcaaatgaccccgatgagagagagagagaccaaaggctagattctttctgcaaggtggaggacggctagaaggcagtggccacagatgagcaggactttttctagactggtttctacaatttttggctttgttcagggcccacccaagaagaaaatactcctggatccttcaactagccctcaggtagacacatgttagaacagcctgtcacgtcctgaagcatcactcccctgcctagaggagtgaggcagggagactcccaggcaggtggcccctagtgcctggggtccaaagaaatattcttctcagggctttgaagcaccacgtgaacctgattctactcatgatacaatctggggaaagggattagtacagttcatttctagaagttatcttgttcagtttcaaagccttgttctcactggagccacagaaaatcagtggattctactcaagggacagtctaaattctattctgtgtactcctgccctggccatactccaatccagaccaccgggctcagcaacaggctcagctgactacccagccagccaggcacaagttccacaccttctaaacttgttcttctaatgattggtatgtatgtgtctaactggataaggtgtggcatggagatgggtagaggtgggatgaggagtggagaggtgtctaccaagaatggctgacactctcagaaatgtttgtccttctctcttaatggaaaatctctccatgtggtaaccccacatcccagcccctagtaccacagtcctgttgggccagggcttcatgaccctttctgtgaaaagccatattatcaccaccccaaatttttccttaaatatctttaactgaaggggtcagcctcttgactgcaaagaccctaagccggttacacagctaactcccactggccctgatttgtgaaattgctgctgcctgattggcacaggagtcgaaggtgttcagctcccctcctccgtggaacgagactctgatttgagtttcacaaattctcgggccacctcgtcattgctcctctgagataaaatccggagaatggtcaggcctgtctcatccatatggatcttccggcccaaggggcaccagcaggcacagctgcccttggctgtgacatccctcagaggcatcacagccagccctagcacgcgatcttcccgggcaaagcagtaatccttcacgcatatctgcaactcataggactcgggcccctcctcatttcccaggaggctgtgagcacaagatagaagttatgaggccagagttgagtcttcagctgatttcaccccagtctgccatccccccgggccctcctctccccccacccctcaagtcttacccccatcccagagtcctgtatgtcccccccgtaacttacaagtggaatgtctcattgtacttgggggcccagttgttgcttttggatttggttgtgaacttcctcttcttatcactttggtgtgggccaaccatagtcacctccacgaaaggccggaacatacccgctgtctgccacttgaggtcattggcagccaccactgcccaaacaagggaaacctgtgagggatcccaccaggatttcccagttcttgaaccccaggtgaccttccccttggaggagggctgagctggagggctgggatgagcagcccctgcttttgagtgatgagtgaggccactgggcaaggaaagggcagacctgtaagtccatcactcacctttcactgtgaccttgtgctccccagtaccagggtgtgtaaacaagtccacctgaatagagacttctcccacaggatcgtccacaccagaccctgagggacaaatggagagatgattccccattggagaactgtaggaggtaaacctgaggggtgaggaggtcaccaccctatacccaaaagcaagaagcaatcaccacagtaaccatgggaagtaagcaataggagaagggaaagaaatgggataaagaacaaggctgtgtcttgtaacacaagttaagctgacagcatcttaggcgcaacattttccaaaagtgcactaagactctctctcaaggatccccaaaactcttatctcctaggctgaaggacttttaactgaaagacgttggggtagggcagtgccatcaccttgtatctgtgtctgggaattatgttgacctggtagtgtctcttaatggaaaaatgtgggtcctctctagccaaaagcagcaacctcccacctatgcccaggattcctagaggtccctgcttgggaggctgctgtgctctgaaatacttcatccccctcaaacctgggcccctctatagaatgaactccccagttccaatctctgaaaagagccaatctacaggctccccttagcagagaccccaccctattttaagaaaacacctggccaggtgcagtggctcacacctgtaatcccaggactttgggaggctgaggtggggggatcacgaggtcaggagattgagaccatcctggctaacatggtgaaaccccgtctctactaaaaatacaaaaaaattagctggcagtggtggcaggcgcctgtagtcccagctactagggaggctgaggcagaacaatggtgtgaacctgggaggcggagcttgcagtgggcagagatcgctccactggactccagcctgggcgacagagcgagactccgtctcaaaaaaaaaaaaaaaaagaaaaaaagaaaacaccaccacaatcttacaccccagagaaaatccttctttgtcctgaggtggaggggtgggagaatgctgagaatacgacagagatcaacaacagaaccccttcctgggctatatgaaggcattacccatctctaagacttgagatagagctcctaaaccttgacagcttgttcccccacccccagcacgagttgctcattctagctcccaggggtcagtgttagcccatgttagatccatatctgcacggtgtacaacatacccttttccggacgaatgtcctcattagcagtaaatctaatacctttcccatcatgcactgaatgaggacaggcaagtcagaggtagtagcagcagcagaacagagaaagaagaatccgttagcagtctaaggagttaacagccattcaaagcagctctacacatattctgagggagcacagaggtggggcagagtggagaaagaagtgaaagagctgcagtcagtgtgtgaatgctccaaattagacttcatgggtcagagaccaaccaaatcatgggcagaaacagtagaaaaatacagagaggaggtatctgagacaagcaggacaagagacaggctgtaggctttaatttcctagacccttaaatgataaagcaacgggtagaaaatgcacacgcatacacatggattcttcccgcagttgccaaccctgctctcatcatatgtgtgctcattccaggctctcctcatcttttatcaagcttaaagctcaatgcttctaaaaagcctttctggattaactcagatcttccttgatggtgtatgcctgaacatgtacccagctctgtaaaagttctacctgtccacttaagtgagactcacagctcttcttttgctctctattcttccctccctggattggaaatgagaacagatggggaatagagcagtactttcggtcccttccattttcttactttccatcaccagtctacctgcttagagccctctcccctctaggtcagccctgtgccccagattcacacacagctcagtaatgcctaagcgccaacttcccccaccaggttcactcccccaggcagcctgctcaggtttccttggaacaagcagtaacaaatgtgcctgaggtgcctcctgggagggctctgctccagcgtcagaatttcaacctgagctacatctatgcagatgtgttttgttttggacaggccatgctggaggtagggaggggttctgaggactgaaagtcactgggagaaaaccggcttcctgggtcccctgtgcataaacagcacccctgagactggagcctcagctgtgcacagggccccaggatccacaccctcccttcagcagctgccatggtttgcctctcttccttgtctccctatccatgctgcagagtctggaaagtcttttgccttctctccccagaacaactcccagcaaagctccacacactatgagccttcacatttctcatggcttccattcattctcaaggcttcctcacagatttttcattcttgccgcttaccagtcagggtatattccttgagtttaataaacatgcatgggccaggcaatgtctgggaaaagaaatcttagacatatttcccaggcctctgtgattctcctgcctggtaatgggtatggggtggaggtaagtactgaggtcccatcaagcaatagagatctgaatttgaagggctctctgaagaagtaactggatctgctcccaagggcatgaagatacagactccctaggggaagatgtgtatcagagaggagaggtggatacccaaagccctcagggccttaccttgggtggtctgcgagcgcacaaaggtcttgatgagagtgtcagtagtctgtgtgtacagagacagggcatagcgtagagactgcagatctgggctcttctccaggaaggttttcttcagcccattgcctcctgcatggaagtattgctgcaagataaaagagcacccgtgactgcttcatccccttacagaaagcagctccccaacattgtcctcagagaagcaagaagaggactgtgagaataggctgttcaggaacacccacagaaccagagcataggctcttggatgagtattatttgggtatttggcaggattagtaggggatggccacattcctggaggtacggcagtgtttgaaggatgggtctttctggacaggcacagaaatggaatagaaacacttcaggcacggagaagaaccaaaagtgctcttttacccatctgaaccttagagaacttgagacctatgacatacctctcccaggtgccttgaagcacagttcatatgttcctgccttatatcaccttaccaatgataagcatcttgaatttaggaaccatatctgattctgtatccttggcagtacatagtaactctcttctggatgtggagtgttaagaattggagggacacctggtctgggagagtggaatgccagggccaagtgagtgtggtggttaagactgtctgaaaaagggggggcctccaccttgatggtgtccagggcgaggtcaaggactgcacactgctttggagtgagattccgtgtttcctctcgtaccatgtgatcctgttcagagaaatcagcagcatcaggacagctcacagcagtcatgaaagtcttgcacccacctgccagcccccagtgcatattcatctcctccttttcctcttcagtctccaaagctccaatttccttccccgcagccaccctctctccatgacttcagaaggaccacacctgccaggaggaccccacacccagagtaccttgagtttggaaagatggctcagctccttggcagcagtgaagatcagctgggtgccctgggcagagagggaatcagtcaaaagcagaggaccccaactccatcaggaagcagggagtgaggggaagggagacagcaggaggaagtggaaggaggtgtccttaccgtctggtcagtgagtgggggcagaacaatcatcctctccattgtgttcatcaccacgcgccagagctccttcagtacacgcttcagaaccgtcttctcacacacagtggcaaagagggtgaggctgcaagtccaggcaacaggtgagaccagggtgagagtttgagaacccctctccccaaggggctcccttgcccgatagcatctgctttgctcatccccacaggatagtcctgaatgctgtactcacttgccatccaggaagtccatgagaggccggagtacgctatctgcatcctgagccgctgaggccctggcgtctggagatgcattccctgtgccccgaacctggcccaggatgtcggccatttgtcgaacacactcatcaatccgtacctggaaactacacatgtgcccgcagtgtagcctttccctccccaaacacacactgtccctggagcggcaccagctatttggtcccattcccatatgctcatggtgcatttccagcagggacagtcagcaggagtacagggaagatccacacacctgcagctatatggagaggtgtggggcaagggctctgggattggctagggaccacatctggctctgagggccttgtattgtggggtcactgacctgtttccaaacaccatgctgagctcatccagaaccgtattcagtttcacctgcagctccttcagactgtctgcagcttcaaggtccagctgtattcacaggaggtaagcctggctaggctgcttttcttaccctcttctaccctgccacacccctactacttccttgcagggcttaccccagtgcctattcctccctcgcagggccttacccgaatgcctacctcagattaagccagcccagaccccaagctaaattcctggcctacacctagttaagagagggtggagttctatggccaaggagctcaggaataaagggaaaatacagtgactcccaaaccctaagacctacctccttgcctcccatggcctcaaacattttctccagctggaccctcagttgctgcacgttgttcatcaggatgcagggctttggggacagatgtagctgttgagtcttggctcctttcagcataggacccattagcctaggttccctccctctctcacaaaagccacagggacttcacatatgacataggtttctccctcagcactaagagctggggccagttcagataattctccttgactaaaagcaaatgttttcatttttaagctgggtggtaggtactcaagtattaatgtattatcctttataactttctgaatatctaaagtttttatatatatattaaaaaaaagactaagcaaaggtctagcttagcagaggataatgtaccaaatgagactcacaggaactctgtcaagttctcgtaattttgtggcatggatctgaagcaaagccatggtgggaatcaggcatcaggagtgtcaccccaaccctcaattctgaggacagcttcaaaagcaaggattcaaatgtcttccactctctttctgtaagagtcccagggcctgaacctaccagtttctcctttgtgcaataggctgggaagtcctttgacaagatgtctgcatactgcatcagcaccttcccgatggtctgagaagaggagaaaggaaagaaaaggaaagggaactcttagctcttctatggggatcttgcctgaggtggcacttctcatcacagaacaataacaacagggaggtaaagggggaatcccacagtacaggagaaagctctctctcaaccacagaacagcactaagacagaaccatctgtctgccccagaaaccagcaaaggagaatgggggtcacacgagctttaccaggaggccacagtggagaggtgctgagctcaggcctgtgatgagactgtgagtgtggtggtggtaagggggagggagtaggaagagttatggtcaccttagcaaacctcctcatgtagtgggcaaggatgctggggtctgggcattccagcttccggatgatctcaaagctctgattgagttgtgtgaagacatccaccacagagcaggaaaagagtgcatgctctgatgtctgctggaactaaggaagaccacacacagggtcaccatccacagctgctatcttttcccaagcttgtagagtttgaaaaggctctgaccagcaagagtggctaatggccctcaacagccctcctgtgaactccacagggcaggcatagccatcctggccaaagcccaggaacttctgccaatagctaattgctgggagacctggcctgaacccggtgcagccaaagcccctgacttactccatccttcttatctcgttccagggccccacgcaggaattccagggatacatcctcattctcatccagccattgtagcacgaactgctcaaaccacctgcagccacagcaggagaacaggggcttagaactagcggtgggaatacgccacttcctgacagctccaccagactggggtcctcgggatggcagggcacagtttaacacttttctttgtctacggtggtacctgaacaggcagtccccgagactggcttgctgaaatgaattggggatactagccctgcccacccagagggctcccttccctctgtagtgcccacatgatgactcacgctgggtactcaggcacctgcccctggaggacaggcagatcccgcacgtattcattgtggagccacttcaccttgaagtgcaggttcatgtagtcagcacttttacacaggtggtctttctcatgctctagtggtagggagaaaggttgggtcaggtcccagcagtagaggccatggttcctgagccttcccaaggcagcagatctggtcaggcagctccatcagatgtcttaggacaagggtgactcccaacctccttctcacagccatctctccccaacagtgttctgctcagcaactctccacaagcttggcccaaatcttcctctagaaagactaagccagactcccagataaagcctgcagtctttttgctctagcgtttggaagtggtctttttgttctagcatctggcctctggtgtagaagaggagaaagggccatgggtgctgatgctgattagtagggagactgcccatgactgtagaggacaatggttttccagggcctttctgatcacagtagctgagtcatccttcagacaggcttaaaggcagagatgagcaggtgtacatggcatgaatgggtcagtgacaactacagagacagggaaaatcaaactgggcccaagttgacagagcagttgggcagccatggtgtaatggaatcttgaggcaaactgaagggctccagggcagagctgagacattgaaaaaatgaattctcagggaagtatgcaaatatgaatagtcagtttggaaactatggaaacacagccagatgaaaggacatatcatgctgcagaaaatggggcacttactacgaatttgaaaagtcatcttgctgaatctccagagccttctggaaaatctaagacaaagataactcacaatttgctcagagtctggagcactggccacacccataggttctcttcatctacccgcttcatagttgaagcactaatttgaataataaaaatcaattgtatgctgacacatcaacataatggtaaaagcaagcaaatgtgggagaggactaagcagcagagaagagaaggccactgtccttggggactttgttgctcaactttgagttgccatgggtgatgctcctccaagtcaaggcggaacatccaggctggggcagctggcccttgtgaactagtgtagcagacactgaaggaggaaatggaagcccgggattctgcctcaaagggcttcaagtcccaggaatttcattccctggcactgcaggcagcactgtctcaacctaaagttgcatttgcagtctcttctatgaagcagtgagcaggagaagagggaaaaggtgtaagactagaggcaaaaggacaactaaatgttcttaccacccagaaagaggacttttcgtatatgaatgacagtggttgcttgtgacagagcagacaccaatgagcaacaaagagagtgaaaaaatcagggacatcagagagaccctcagggacatcaaaagagagcccctctcctccacccccatcccctgctgttctggaaccagtctaagaacctagaaacatcaggagggccctcctccttccttttcaagcaggactgcccatcactccataactccctaactctttcttttagggaccttcaagttactgtttctacatataattttcactttctctgtcaatttattatctgcactctggcccctatccctaatttctgtattaacttctctggtataaaaactaactgacaagttctgaaacaccggtcacactttaaactattctaacaagtcccatggagtcatgctccagtaaagttgtttgaggtggggtaatctgtcagaaaggccaatccataacctcctgcccctgacttccacctaactccctcctttcctcctggagagctcttccaacctcatgatttcaactacccagtttgctggtatctccccctaatctctctttggttctggtaacgtctatataaacttcttattttttttgagatggagtctcgctctgtcacccagggtggagtgcagtggtgctatctctgctcactgcaacctctgcctcctgggttcaagcaattctcctgcctcaggctcctgagtagctgggattacagacatgtgccagcacacctggctaatgtttgtatttttagtagagttggggtttcaccatgttggccaggctggtcatgaactcctgaactcaggtgatccacccgcctcaggcccataaagtgctgggattacaggcgtgagcccccatgcctggcctatataagcttcggatggaacatttcatcatgcctagatttaacttgcccctgtctctcactatcttaaaatctccagctgaagtggaacagagtacaccaactaatcttaccctcttgttcaatgctgagcatcatcctcaaatcttctttctacctctttattcatacccagttaaatcgccagcccctgatttcacctccaaatgtctctggaatctatccattccttctagccacgctattacctgcctaggtctcattacccccatctgtaacctggattactataatagcctccagactggtcattctgcctcccaatccactctccacactgtagacagagcgactggcctttctacataataatctgatcatgtcaatcccttgcttgacatatgtcagtggctcccagctacctcaagatagagtccaaaagtcagctggatgcattggctcacacctgtaatcccagcactttgggaggctgaggggggtggatcacttgaggctagggttcaagaccagactggccaacatggtgaaaccccgtctctactaaaaatacaaaaattagctgggtgtggtggcacacgcttgtaatcccagctactcgggtggctgaggcatgagaatcgcttgaatccaggaggcggaggttgcagtgagccaaaatcagcccactgcactccagcctgggtgacacagagagactcaaaaaaaaaaaaaaaaaaaaagagagagagtccaaaagcctatgcatggcttacaacctccttcacgatctgactccgtcacacctctccatcttcaggtcttacttatctcttcccctaccctctgaagtgctagtcacactgaactgctgcttccagttctccaagcatgccagctctctctagaccccaggtcttggacatgctgtagcctctgcttgaaatgttctgtgtctccctttcttgtcactaccaccctcctggctaaatcttattacccttcaggtttcggcttgtacatcacctcctccaggaagccttcccaggtcctcagaatctgggttacatggttctcctgtgtgctctcagcaccctatacttactcctcttgtggcattataactttgtgttgtaactaccaatttatacgactgttttctagactgctctgtgagtttcttaagggatggtgctatgccttgttcatctcattgggttccaataaccagcacagagccaggcacagagaaaatattcaataaacatttggtgaatggagtggggatttactgcaaagtggcaagaaggaacttttgtttcatattttaattgggagagttgttacacagttgggcttatttgtcaaaactcattaaattgtattcttaaagtggtcttattgtattgtctataaatgataccttaataatgttgacttacaaaatatttggtgacggacagcattttcttttcttttcttttttttaatgtttcacccttttctttattttattttattttttattatactttaagttttagggtacatgtgcacaatgtgcaggttagttacatatgtatacatgtgccatgctggtgcactgcacccactaacttgtcatctagcattaggtatatctcccaatgctatccctcccccctccccctaccccaccacagtccccagagtgtgatgttccccttcctgtgtccatgtgttctcattgctcaattcccacctatgagtgagaatatgcggtgtttggtttagtcagagtcaatgccactctcctatcatccaggcccccaaaactcctccccttctcttgccctccatattctgacaatcacgaagtcctgttctggcttccttccaatgtctatcaaagcccattctcctctctccacttcccttctctaatcccagcaccctctatccctaaattattacaacagctcttcattatctgcgttctctgattctagtctctccctattctagctgccctcatctcccactgaggtagatcttattaaaatactgctggcttcacattgcatctctgctcaagagcctgcaatggtttcttattgttcttaagaactaagatttagtcagtgctgagtaagtgccaggcagtatgctaaatacatctcagtacttcatcagttcaaagaaacagatgctatcatcactcccattttacagatgagaaaatgggagctcataaaaattaagtagtttggaccaaattcacagtgctacataggcggtgaaattgaggtatgaaatcaggccaacattaattctttctcttaaagtagaagttttcaatccttttgtgtttgttttaaacattagcagaactcccctttcaaaagaaatctcagctagaattccatgtaagattgataaatgcagggctggctgagctgtcatcatgcaagaggcctggagcctagcctctgggtttccccttcaacttagctcctaagatacttctgtttgaaaacctctgccccacctcacactacttctcttgtggagttgattcacttttcacaggtgttttctcttttcccccaaacccactggagccagagttcttcaagaactgagactgtactccccatcaggctcactaagtggcatctggagggagagaccaatgacctcctccctggcctgacagcaggcagccctgctctgggcttgtgttacagaatgtatgcgtgtagtctgtggctggctcaaatgtaacacagatcttcaaggtttctttcaatctcaagactcactgattctaaacctcacacattcaagcatctgagggtggctcatctgccctgccatcccacccaaataacagatccagactctgctttgtccttgcccagatggctcctcctcctcctagatgggctttcacagactgagtagagagactaccacacataaaatggcaggaaacgctgctaaataggtgagtacagatgggtacagataggaaggtctaatacaggtatggaatgatatctttgtggaccaaggtaggaaatgaataaaagaacaagctgaatgagtaagatgaataataatttgcctgtggccctgctctataggagaagtgagggaagaagtatcttcctggcattgtcatactaatccagagcagcttgcaagaaaagccaggccagagagtccccaacataagaaaacaattacatctatctgtgtatttaaggttctctgattctttaaaactgaagtttcccaagaccattctccaggaagtgggccacctaagaacacccaccatgggagaatttcatctctgggctgggaaggtcttgaacaggcagttgctccaaagctggaaggaggaagctacatccacacagccattttcatatgtcctttggctgcaactttgcccacccaaggtctcccggggcctacatcccactaggcctagaattcctttagtttctcactataccactcacccagaacttgtagttgtctagaagaggaaagggacagtgaacgaggagcttgggctaggagcctggcagcccactgatttgaacagatccttaccctccaatgcatatttcatgtcttgggcaaacaaatgccacatcacttctgcgctgacttttcccacattcaactcctgaggaaacctggatgacagaagaaaccacagtcagagaataaggcaagagccatttgatttgattcatttcaaggctaaagtgcctagttcttggaagtcatattggagagaggagatgcttagggaacagggctaggtccaatctggagaaaaggggcccaggggccaggggccagtggcaggacaagtgagggcagaagggatccccataggcaagatgggcctgggggcagaagatgcccagaaggcagggaattgagaggtagagactctccaggcagaggctggaaagcaggcgcaggctaaataagctggaggagaaagggcaagtgggggtgggctataagaaggcccacttcattcacagtggacagacacatacacacatggtctctggatcccctggggctcctatggcagtcccagtcccagaagtctctcactccagggaagctggctcaatctggccagggacccccattatgtttccacacctgtctccagaaacagttacccagacagatacaagggacagagggacagatggatggacaggaagaagaggtggcactgcaaacatacagagacaggaaagaaagaggttgttagacagatggacagaccaaccaccaacagacagggccaaagagggtgatactcactggttcagaacaggtgtgtaggaattcttatcttcctctatgattgacacgatgagtgtgatgagcttgggccagaaatccaggttccgaatgctgggcccttgttcctctggaggtagctcctgcttcttgatccagaggacacagtgagagagagggagaaagagtcagagtagaatgtagagggtgtctccaacgatcctctttctcttccccttcctatacctcttcctctagaatcaaggacctttcctctcctagagcctgtcttccacaagactatccctgttctgtaagagtgactattgtgagatccctgaacacagggagcctatcgctgagaagttctctctgataaacttggtcagtccaagagacataaggatgcccatcctccttccttctctcagttgctatgggcagagtaactcgctggctaaaggaaacagcccctccagccttactaaataggtctacttctatgcggcccctacaggcaggcagccctcctcttctggtggtattcctctactgacagcacaccacgaccacacacatacacatctcagctctgagaagctctttcaacttctgcaggagctactgaacagatctggtgcgcatttcagcctttcagtggagtaggacttcccttgatcccctgaagttattagggggaagaactgcatctaggaagctatctgcctaactagataagatagggccttacttgggaagaggcaagggaatacaatggtgactttcaggtaaagagaaatcactctatattcacagcccagaaaagtgaagtaggagtcaccacagggagggtggaacacacattatctcccactaagtcaaaggtgaaggtggagctgcccagaaggacaggaacagggcctttatgtgggatgtcatatgtcactggaaagcttccacagtccttaataagcctgcattatcaagaagttcctagaaaccaggacagaatctttaatataacttaaatacatctcttccttttatttttctgtcactgtcctggctcaggctcttatcattcaaggatttctgaactggtctttgatcttcaatccaatccctcctccttgcagctatcgtgatctttctacaaagaaaatctcaatgtgttactcctctgcttaaagcccttcaacggcgttcaatacagtttaaattccttagtttacaccttccagaatatgactctcaacctcataccttacaactctttttgttccagctattaccacaccaccaccacttatttactgcttattatgtgccgcacactctgctaagacctttacacacattatcctatctaatcctcacaacaactccatttagtagaaattattatcaccttcatttacagatgaggagagtgaagggcagcaaggttacatgacttgtccaaagtcatgcagttttaaagagcagaactaagatttgatcccagatagctgaatcccacagctggatgccgtaagtaccctaaattgctatacttctttatcttatttttattttgtctttttttttgagacggagtctcactctgtcgcccaggctggagtgcagcagcacgatctcagctcactgcaacctctgcctcctgggttcaagcaattctcctgcctcaacttcccaagtagctgggattccaagcacccaccatcatgcctgcctaatttttgtatttttagtagagacagggtttcaccatattggccaggctagtttcaaactcctgacctcaagtgatccacccgccccggcttcccaaagtgttaggattacaggcttgagccattgcgcccggcctgcttatatttctttaaattaacaagctcatacataattctgtgcctccaagcattctattctctctgtggtatgccccttccctccagcccctttctttagttaattcctactccttcctcaaaattcagattgaactttgcctcttctgagagattttcctgacatccttggtctgggctcccacagcaccctctgtgaacctttggtgtagatgtatcagaaaactacaactacaataaaacatagtaacaacaaaataacaacaacaaaaaaacaataaatgtagtaatttgccctgacctccactaaaccatgagatccccaaaggctgaaatgtctcttactcaactttatgtctctaatgctctgttaagtaaatgaatggacgaataaaccaatgactgaaggtcaacagatggaaattttaaaagacatcaagagtttatgccagtgtaaatatggaataaggaaaaaatgaaattgagagaaagtaaaaagcagatactaaaatacaaaggctaaagagtatccctgaatagtttatgagaacagtgtctttcctcaaccagagacttcatagacagatgacagaggagcctagaatgtatcaagtaaaacaaaggcctcaggaaaacctcccatggatttcagaatcaacaggaggctttagaaaccttaaaaggaagaagccttaaatacatggctggcacagaaagtacacttgggaatgagaagaggcagtaggaacaagatcttagtctttatgagggtgttcctaggaagctttacaaattggatgtagttacttaaagataaatgtccaagacatttaggttgtcctgccatcattggttgtccaaatcccactgccttttaaggtctatctcaaatgttccttgttttatgtagcttttcctggtatctgatcaagagtgcgaaaagactcttcctccttggaattcctttaatcttatccctttttcaaggcccttcaaacagactcttttgattagagttatatatatgtttatgagactgcaaacttactgaaggagcactgtgctctcctcagacctggcctagaacaaacattcaatatttgttggactgaagggaatccactctgcaaatgtatggtcagcaagaaactcctaagattggaactgtaattgagtaattggagctagaagtaagttctggctttcaaataagttgggagcatggatcggggacactattagaaggatctgggaaaatgtactaagtcaccaggtactgacttagggtgccaggctaaaacaggtgaagtagctcagcctcacagaaggatagggtcagtcttgatagccagtggatgaatacaacccagaagaaccacacatttcagagagaagtaattagagggaaaagtaaagcttccaggagccagcagctcagagaccacttcagatctcagaggaaggaagcccagaacttacaagagtctgcaagagtcagaataaagttaaacttgagggagaaaaaaagactctgggatggactgagaattcccctactcaacccctgaactgtgcatgaatttaggtttactttcttcaacatcattattgttgccatttctgttcaattcaggtatgtctcatcttgcccaggggtctctttccatccacatatctcacatggtccacatggttcatactccacaactcactcacccttgagaacatcaagtactttgtcctgagtgcttttccaccaccatcatgaaggaaaactgaggctccaaagagccactgacagctggccccacctgatcctgaacctcttaccagctggtactggcggctgtataagtcgtggcagttgttgaagatatattcatatgtggagttcaaacaggccttcacacaatcctttaccacctggctggctcttggagggctttgcagttcttgtacctgccaattaaaagaagaaatatgggcccaaggacctgctcacctgggtgggatattctcctagcactaccccaaacctactctagattctttcatccctgtctgggtccctagacttttccctgtgatgaaattgccaggatagttgacagggaaaacttccaccccatcctcatggatccatagtctatgtgctctctcagaagtaacccagggaacaggtacacagaaatgtaagcttagaggtgatgaatcctgtagcctcagactctgcccaatgattctcattcttcacgttcctgtagccaggtctccagcccagcaccacccaagccccagtccatttcttaccttcattctgaagaaagtaatgctggtcagcaaatccactgtggattttaagtcctgaagccgttcaggactcccagcagggaaattattctgttgcaaatcaagcaaatgtaagaaaggaacagaggactatgaaaaccttccctgccaaaagtgatgatatcaaaagcttccctaattgttacctactgggtttttctctagttgagctggccaaaaacactgtaaagttacaggtctccttctcttttttctattgatgcaaacaggctcttgccaaaagcaggggttaatactccccaccctagaaagtgacacatcctcctccagccctacttcccatgcaatgtataagcacttgtacaaaggaacacacaggcacacacaaacttacacacatgcttttttcttggatgaagattcttacacaccaacagtgagttcttcgaaaattacaatctaactgtatatcctggaatataagtggagccacactacagaccaaactgaggtccaggacctgtactttttgtacaatagaacccagctcttctactgttctgcagccagcagatggcagatctctgagcagaactgcttttggagtgagttccttaggaatttccagccatccttacttcattcactttggcacgagtcttaggagggagctgctatgaagagctgaagggagatgctgagcctgtcttcacattaatggtcagtttttaaaccttcaaatggctacttatatgccaaatataagatatacagtcagctgtccattatttgtgcaaatggagggcacttgagtgcagacaattaaaacctcatttctttttgactttaaggttgtttttatacttactttttaatgtgcatatattgcctgttctgaaaattcacacactttaaagcaagtaatgaagccatttctaagatctaacataggaggaactaagaaactgcccatttccttatcctgtcccgtcccagtaaccatcctcctactatacctatttcctccctttatactaggaatggacatgctctctgatacagattacttgcaaaagccaagctactctctgtcccctagccagattctcacacctccgctggaaaacgaggagagtatggaaaaatgcaaaaaagaaatgtaattaggtatctaattttttaaaaggatactcctggaagagattatcctcaggaaactccctaatgagaatgtcaccagagagtttagtagagtgttaagaatgaggttggaaagacaactgtctataaaaactaaccatacctgctgctatttatacaccacatggtccctggagttaaaagaaccacaggtgtcagtagcattggccatttgggtggatgtgatgacacagaccagttttccctggcctcaatctttatagccaagattggcctacagtctctctgggaccgtgcttgatatctattatcctgcccacagccgtgtcttcactcaccctgtatgtagagaggtcgatcctcagtgagttgtgtagctggtccagcagttttacaaatctctctttctgagggtgagaaacaaataaaggggaagaaaaagagaacctgtgtctgagtcccctaaactataacagaaacagaaccacccctggatgagtagaaagagtcgggaggcattgggttggagacacatccctgcccatgggaagaacaacaaacagtgtaacggaaaaaatgagatagaaagtccctgttctatctctttgcagctctgtcccaatctgggaaatctcacactgacaaggaaaaagccaagtccctggggggagaaatggctccttctatatgagagtcaatagggcatgaccagtgcatctctatacctttgggactgtaacttatcttagttagataagaagaaactccaaacacattctctcttgagtctgaggtctcctgacttatctcggggtagtgcataacagttatacagccacagcctagcagtgatgataggagggagaatctgatgcatatgaaagataacaggacaggcaggaaggggtctctctttaaaccacattccacacacatttcccatagtgtatactttttaaatgttaaaatatctaacatatactattttaatagctgattttcatagaaaaagtataattaaacgtggaatcatatgcctgcaggatgttggcatcccactcctagaactcatatattgattatatgagtagatgttgattaagtcaatacataatgagatgaggcaaaatggaacaaatatttgactggcttaataagttacacatctacagaaaggctctatcaacaacaaaaaattcattagtacaaaaaagtcagatttcatagactcagtgaattggggtgatatcagtaactttatgcccaaaatggtaatttttgtgttgggtcagaattattttatctagtttatactgaattaatgtcaggtgacattctgagtaatgactcaacttctcaggtaccttaacccaggaagggcacaccctggatagggaaaacagtctggacactagaaaaggaacaggttcaagtgcacactggcatcattgcttagacatcagtctcatatcaactcaagtaatatgaatccatcacagacagactgaacaagatttttaaaaatccatttgtggacctgcaagactgaagaatatggaagactatcgtaattcaaccaagttgttggcccagaggggttctggccaagcccaggtggtaccacccccaaccaccttctcttctttatctgtgtgtgaggagaggctattagtatagtccgcatacccataaggaaacaggaaacaagattcatctatcaaaatggtagctatctgaattttaagcacatcaagtaactctataggaccagccaagaaaaatcaaacttggctgggcacggtggctcaagcctgtaatcccagccctttgggaggccgaggtgagtggatcacctgaggtcaggagttccagaccagcctggccaacatggcaaaacccccatctctactaaaagcacaaaaattatccgggcgtggtggcgggtgcctgtaatcccagctactcaggaggctgagaaaggagaatcgcttgaacccaggaggtagaagttgcagtgagccgagaccacgccactgtactccagcctgggcaacagagcgagactctgtctcaaaaaaaaaaaaaaaaaatcaaactttattaattggtaacaaatgcagacatatgtgtttacatgatacttaccccaaagttggaggctgcaaagcgatcagatgcagagacattggtagaggcagttgtgtgggcatagtaggcgttgatgttggccagtaaggtgctcatcactgctggcacaccaggacacatgtacttggatgataaacatgcaaagtgcctgaaaaacacagcacccgcagcctcaaagactcttcagggcttgcagcaaaagccaagcaggaactctaaaagtttatgggataaatgaagcacagccagggcaattgctgccctctcttgcctagggctactttctgcacacagctctaggggcagcctcactgacagaaaggctaccctgcttctcatagcaatctggaattcccattcaaggagtcctggtcaactccatacacagctgctttccctgcagtttagtgttctctttgaacccccaggccagtctaggccagaccggttgtcacaaacacatgtacacgagcacacataccctgtctgctcaggcctgtgatgtctaggcaggttgtccttgcatactctcacatgcctctttccctgcagagttccctcaactctgaggcagacagaaataccttttctgtgagttacaacattctttttctacatatacccttcttgtcttggggcatagacccatctcacccagctcagagaggaaagtaaaggaatcactgcatgctacctcactaaggacctgcccaccatgtcagtgtgccttaattagccaccccagtgattagtagccacttcccggtgccgcagcagagactcacgtcatggcctgatatatggactcaatgccataacgcatggcaaattcatccacaatttcttgggctgtctcatcaaagtacaccttccaggcatcgtctcctcgagcttcagggatgcggactcctccactgccctgaatgtctgtgaggtaatggaaaagattctgcaggagacagagcagagaaagggaatgggttaaacacatatgaaagacaaaaacaaacttggtggtaaagcccagaagaatgtgcacaaggtcccacagaaattctgtccttccagtcattgctcagttcctcctgtggccccagtaggctgttctcacattagtggaagagaatgcagtctgagttcagtcactcggactctccagggtaacagagtgaatcaaggataaaatttaaaatgggcctcggattccaaccacctagcaatcctacttatggccaaaggcctctcccagcactgctttctgatcccccacctaccaagggctggctcacctcatggagacatgtatactgcacgtggtatggggctactttctcctcccccttgatctccacactgatttgtagtcggatagcccctgagacggctgatttgtctgtcctcttctctaggaaggaaagaagactggagattgacaccaatgcaactagacagcatagatagttccattctggcttaacccaaggaagagaaggggccaacccaaggaaaagaaggggccaacccaaggactcaccaaatagggtgaatcactccagtgaccacatattccacaagtacccttgaactagctgggtaggagaacaggagtgtggaggggggacaaaagcactagtatgaagattaaagggccttctgaaacctagagaacattcagccagagtgactcacagccactgccactcctctgtcccccatccctccccacagtcagttctttgcaggtgagacaggctctgtatagaggtatgctttggggacagatggtggttttggtagaaggactattcccaggtccccttcatgctttcccttccaagcaactttctcgggtccagtttcctcacccaagttgtaccagacgtccatctcgccacttagggtccgaacctcaatgatggtttggccaaggaaatcatcagactctcgctttaggcgttgctttactcttgacttgatgtcatcatcctcatcccatacacgcaccttaatgcggtcagaggagttgtggcactcactgtgagagaattaggcaggctctgttaggggcagacccagtagcgccaaatcctgttacttcctattccctcccaaaagctccgacagctgcacttgaggccctgaaagaggagaagtcagaggacagcagtacaaaagttccaagaaagttgggctatcctagcaaatgactcttcattcctcggcctgggtggctctatctaccactgtacagttcttattgtcctagaacaaagggcaaggggtggagggaagagtaattcaggtcaattctgacttcctatacagctagctgtatcagcaacaccaagaggaaaatagctagacatgccacggagctccaggaagcaactgctagctccatcctcagagcccaggacatgaagtcagtaaaggtgctagacatgttcatggtaggcccatagggttataactgtttggctttctatctaactctctcatctgcctaactatgtgcttggtgaacttctatattagcctatcatatcccattgaattgtcatctcgtctatcgggtttgctttggagaaaggagttttcccaggtcttgtctcaagctctcctctccaacagttgctttctgggatctgttgtttcacccaaaagttgtaactggcaaaatgtgctcttactttccctatgttcttatgttatctttccacattccattaaaatattacagtataaccactgctctgtgagaagataatagacaaatcaacaaggagcttcttgaagccagggattgttctattcatttttggatacactgtattatgtatagtgtcttgtacagaatatgagcttaataaactgtttactaaaagtgggcaaaaatgaccaagagctagttcattttaaattagtcataagaagaattcaagcaggaactattcagattctcaaacaggtgtttctcctggtagctattaatattatctctggattagagatgaattttactatatcctaatcccttttttttttcttttctttttttagacggagtctcactctgtcaccaggctggagtacagtggcatgatcttggtgcactgcaacgtctgcctcccaggttcaggggattctcttccctcagcctcccgagtaagctgggactacaggcacctgccaccatgcctggcttatttttgtattcttaatagagatggggttttgccatgttggccagtctggtctggaactcctgacctcaggtgatctgcctgcctcagcctcccaaagtgctgggattacaggtgtgagccaccacgctggccttaatccctttctgaatcttctgaggagccaacagaaggaggcctctacatagccagcctgcttggctgattcaaatccaaaatcctgaccctaggccttattagggagcgacaaagcatgtggattctcagacattagtttgccatttttcaataaccatcctttactgtcataagaaatagtttgtaagaaagtgagataataaaaaaatgagtgagtgtagaagctgaggcaggaagaaacactatctttatgggaaacagcatcttcttcagaacccagatttccacttttaagccagaattacccagttttaggacaaggacactccctccccactccttataagagccttccttatgagagcctaaccctactgtaccttcctaggcaagggtaggaggtacaataaggcagtcagtccctggttctgtcactgagcagtaaagtagtaaaatctttctactgctagaaaaagcaggatggggtgccctagggcccctttaatagccctggtgaagacagggcatgggcacagtaatcctgacacaacagctcatgagaagaaaaccagagaaagaatggctgatgtctgaacgaagcatgcgagaaatgagttttctcccctgcctttgcccaatcttcaagctcaagcccagaatggcaggatgtgatcctgctcccccaatacacacagtcccaggtaagacaaagctctctgtgacttacaaatggaacttctcctcccaaacaggattcaagtttccaaaaatggtcttggtacgcttcttagttttgctgacttgcacagtcacgtaagggtcactggatcctgttttgtccttggcttgtaggccctgggcacacaccactgcaacccaagcatgtataggaggcttcagagtcgttcagaagccccccacaacactactcatatgctttccatcttagagcagtctatgctccttgcacagataccgtaatcccattcctccatatttattctttgtcctgggccaccagcctttcccttaaagcccaagcatcccatctccctacccaagccctaactgaccacttatctctatattgatctttacaccctctgatatatacatgcttcagccccacccagttagcaaaccactggttagctactccctggtcccctgcccttccccttccccctccccccacctcttataatatcaaactgttagccaagtctacagcgttaggttgttagcaaatccttgtattatggttcatgttgtttgcagatagcaatcttgcctctccggcaccagggtctaggtaaggagaagtgattaataaagaggcctttccttcccagtgatttcctttttctttctccctaatcccttgctccctcacgctcaggatgtttcttccccagtctcctccccatagcccaggccttcctgtcccctcaaactgtggcctgctcaccagtaatggtgatcttggctgaccatttggaggtgccatccagtacactctgcttcactgttttcatctgctgcacatgggcagctttgttcactgtgaagacgtcccggataacttcaaagatctctggcttatttcgctctcggatcttcatgcggtccttcatggccatgataatgttctgggtccggtcctcagctccatgtttacagctcttttctgcagcccctgaaggtggccaggaacacaacaggtcacctaccagaccaagggttgagctgaggaatggggcctgggagaggctgcagagcagtggagaaactatgcagccagcctggttgctagttctcagcaattaagcaagggccctctggcacctgcacttgccaccccttcatgatggattttggccaagtcattactagcatttgtcttcaggcagtcttttcagagcccatctcttccgctgactctgtcctacctgtctcttcacgtctaacctagccttgccattggcaccaatttgaggctcttcaaaggacattttccatgaataattgctcaaggcctctccctggtccccttttatatgtcatagctgtccttgggataatgaagtacttgtgggtctagaggtgaccttcccttctcctagcacaatctttaaagctttcagtgctacagcttggcttgtgggtaatacctgggaggtctggagggcaggaaaatagtttcccacttccttcacccctgcttttcctggggtccagccacagtgagtgcaaggccagcaggaggggagcaaggagatatgaactttgagcgctaccatttcctctaacaagaacttgttgcttttcctgctcctattgtccccactccatcatggcaggacaagtcatatatttagccaaggccctgggggtctggtatactctcctcttggacctctaccagattcatttgacatttctatttctggcactattgtctaaaaacaagtaatgaatgctgccttccctgagtcctagattctaggctttaggaggttcctctgtggggcctggaaccccacaaaactctatttctttcctctcattagcctcagatcctgatgcttttgtcatttggacaataaggccgctgtgctgtatacactacaaagctcagtctctgggatcaactgaatcctataagattctagctacactaccacagaaagctcaaagaatttttcctaaaggtgcttaagaaggtagtgtaagacctgttatttggaaaggcaatgccccttgattcagaatcctaccttctctgaaatggatagggtttcagaatcaggtggactgggggaatgattggttcagccatcccagctctttgctgcagactattttggaaagcccctgctgccccactccccgcccctcatcccgcagggcactcacgctgcaggcagtcagcattgagcagatcctggcacttctcatggcacttgactccacattcgctgcagcgcatgccctgccgggcaatgccccagagcaggccttcacactcatagcagtaggttggggtagtggccgtccagacctcaaagttatgaggagtggtgcacgaaatggggtagattaaggcctgcagggttttcttatacacgtgggatttctgaaagacacataccccatcccatgatttttgttttttgtttgttttgagacagagtcttgctctgttgcccaggctggagtgcagtggtatgatctcggctcattgcaacctccacctcccaggttcaagcaattctcctgccttggcccccaagtagctgggattacatgcacatgctaccatgcccagctaatttttgtatttttagtagagacagggtttcaccatgttggtcaggcttgtctcgaactcctgacctcaagtgatccacctgccttggcctcccaaagtgctgggattacaggcataagccaacatgcctggtccccatgacttttgggttctgcagggagataccagaactgagaccctgtgggacaatcaggaccttgatttcgtgtctcctctggcaatgaagaagatgctctatcctggcccagcccagagcccagcatagcagaatgaggcccacaatatagtgtgcttctggttgtccaacacaggttggacctgatgctggatccgagccttgttccagcattcacgctttctaagaaaacagaaggtactaggtccatcataaaaccttgagttcagtggtcacacccttcaacatgagacttgggcttactctctgatctagacttgcttagagtctttcccagtgtggaaaactaacacctgatgctatctatctttttcatcagcaatgtgtgtccagcactcttgaattcccagaattcccaattattaatagcatggctacagagatgatcaccagtcctgaggccagtggacttacgaaagcacttgggacacttaccagctcttcgtccttaagagaagtgcgtgtagccattgcagaagtgattcctgccttccgagactggaccagtgactgtcagggaagatctgctgttagccctgaccactgccaagggctggcaaagtctgggggagggagcttcagtgaccaaagccacttgactatagcttactacagtactttctatttttattgtcactcacagcaaccgccctaacaggtgacaagtgtcccaggttaagatgcaaaacccaaggccctcagggggctgctctaactatgttagaacagcactttcttcagggtatctatcatccaaagagtttctttttctttcactcttcttagtgtcctaccccacagaaactccttgtttatgggaaggcaaaggaaaatgaaaagcttagaactatagtaggaaacaggtaattaagaataatagagacacacaactctgtcagagtcacattcaagagccattatggagaaaaatgattccatgctaacctctataccttggcacctccccaagcccacataatccctggatggctgcagaggccagcaggcctacaagtagggcacttggcaagtgaaaagggcattgaagcctcagtcaaatcaagcaggacagagagttaagtctgagagctggggctgccttgctagccacactcttgcatagggggccccatgtatctgccaagcccagagagttaagtctgagagctggggctgccttgctagccacactcttgcacaggggccccatgtatctgccaagcccagagagttaagtctgagagctggggctgccttgctagccacactcttgcacagggcccgatgtatatgccaagcccagagagttaagtctgagagctggggctgccttgctagccacactcttgcacagggcccatgtatctgccaagcacagagagttaagtctgagagctggggctgccttgctagccacactcttgcacaggggccccatgtatctgccaagcccagagagttaagtctgagagctggggctgccttgctagccacactcttgcacaggggccccatgtatctgccaagcccagagagttaagtctgagagctggggctgccttgctagccacactcttgcacagggccccatgtatctgccaagcccagagagttaagtctgagagctggggctgccttgctagccacactcttgcacagggccccatgtatctgccaagcccagagagttaagtctgagagctggggctgccttgctagccacactcttgcacaggggccccatgtatctgccaagcccagagagttaagtctgagagctggggctgccttgctagccacactcttgcacaggggccccatgtatctgccaagcccagagagttaagtctgagagctggggctgccttgctagccacactcttgcacaggggccccatgtatctgccaagcccagagagttaagtctgagagctggggctgccttgctagccacactcttgcacagggccccatgtatctgccaagcccagagagttaagtctgagagctggggctgccttgctagccacactcttgcacaggggccccatgtatctgccaagcccagagagttaagtctgagagctggggctgccttgctagccacactcttgcacagggccccatgtatctgccaagcccagagagttaagtctgagagctggggctgccttgctagccacactcttgcacagggccccatgtatctgccaagcacagagagttaagtctgagagctggggctgccttgctagccacactcttgcacaggggcccatgtatctgccaagcccagagagttaagtctgagagctggggctgccttgctagccacactcttgcacagggccccatgtatctgccaagcacagagagttaagtctgagagctggggctgccttgctagccacactcttgcacagggccccatgtatctgccaagcccagagagttaagtctgagagctggggctgccttgctagccacactcttgcacaggggccccatgtatctgccaagcccagagagttaagtctgagagctggggctgccttgctagccacactcttgcacagggccccatgtatctgccaagcacagagagttaagtctgagagctggggctgccttgctagccacactcttgcacagggcccatgtatctgccaagcccagagagttaagtctgagagctggggctgccttgctagccacactcttgcacaggggccccatgtatctgccaagcccagagagttaagtctgagagctggggctgccttgctagccacactcttgcacagggccccatgtatctgccaagcacagagagttaagtctgagagctggggctgccttgctagccacactcttgcacaggggcccatgtatctgccaagcccagagagttaagtctgagagctggggctgccttgctagccacactcttgcacaggggccccatgtatctgccaagcccagagagttaagtctgagagctggggctgccttgctagccacactcttgcacaggggccccatgtatctgccaagcccagagagttaagtctgagagctggggctgccttgctagccacactcttgcacaggggccccatgtatctgccaagcccagagagttaagtctgagagctggggctgccttgctagccacactcttgcacagggcccatgtatctgccaagcccaagctttaggggcagcccctggagaggcacatggtttcctaaaggcagaggacgctgagaaggcagaagtcataatatcagcctaagcaggaggaacagctgggaagggcccaagtgatttgggatgaggattttgtttgtttgtttgtttgtttggagacagagtcttgcactgtcgcccaggcaggagtgcagtggtgcgatctcagctcattgcaacttccgcctcccgggttcaagcgattctcctgcctcagcctcccaagtagctgagattacaggtactcgccaccacggctggctaatttttttgtatttttagtagaaacagtgtttcactatgttggtcaggctagtctcgaactcctgaccttgtgatccgcccgcctcagcctcccaaagtgctgggattacaggcatgagccactgcaaccagccagggatgcagacttttaaagaggatgagaaagggctctggagacactcaccatagcctgcgtagaggacagcagagaaaagaacaacatgatgttaaaggctcgaaagggcatgaaaactttcagaggcaactgagaggttcttccctatagtccaaagcagggagcatttcccaatccactctgcttctgtccactaaaaactgtcttcaacccagaccactggccaggacccaaagcctagagcacctactctaaggagtattatgccataaagccaaagatagggcaaaagacagagagggatagcaagaaataaactagatacttgctcatgggcaaacagtgagaaaggatgaggaaaaaaagtaggaagaagaggaagaaaaaaaagaggagatgagagacattaaggaaaggaaaatggtattgaagaagacatggcatcagaatttatcttcaaccagctagatgaagagctagtggaagaagaggtacattagaaaggaggagtcgggcatggtggctcacgcctgtaatcccagcactttgggaagctgaggcaggaggatcacttgagcccgggagtttgagaccagcctgggtaacagggactccgtctctataaaaaaaaaaaaaaagaaagaaagaaagagagagaaaggagaagatgaacaaatggtaagaaataatggaagggaagaaaaatgatgaagagaaaatggcagatgatactttcattcggtcaactaaggagggagaaactagtggagcaggaaatggggaagagggaagaggggtggttaggaaaaacaatagatagaatagagagaaaaaagaaaacagaaacagaaaatggtaataagggaaaagggttcacatttaactgaatccttacacccgatttctagctttagagctctgagagaacctggacctcacttcacccccaactacccacaaggctacagaaaattccttgggttgtttgtgcctcagaaggtatgacccagaatggggcttctggtcatcctgggaggatgggatggaggccctgggatcagctttaactcttaagcctgtttcaattcaattccacaaatttttatcattgcctctcagtgcctgacactaggttacagagatagtctcaaaagcctatgtcttgagaagagacttttgcttgacttccaagaaggcatcaagctccagtcatgctcatcccataccaagctcaatgatcaagaggtcaagggctggaggcaatttccattacaggtcatcaaagaaggctgtagagatacctataagagctagatgcctataggaagacacaaaatcctaactttgagagcccaagtcacaaatattccaggtaggagcttgagctaataaattcaggactctgactagggagtgaggtagaacacagtccctgtgaagccactgctaagtctccgaaggctttaaatgattgatcatcagatcaatttgagtcattaaatggacgacttccaatcctgacagcttgccaaggcccaatgggggataccccaaggctactgcctatgcctgcacaagagtcttcactcaccagatcactgacaagtggcagtggcttctttctgcgtaaatctggcatgctgtcaatgccatagagccctccggctggcctgaggagagaagaaaatatgtcaggaccgtcagtcttgctttgagttagctggtgggttcagtgttccattcaccttgctctccctctccccagaggaagatgaactgacctctaccatgtgcttttaggacgggaaggaaagacagaaagtcagggaaataaagtcatggaagagtgagcaatagaatctgttctcacaggacccctcagtgtctcttacagtttcagctgagaactgaggctcttttatcccagtgatagttcaaggcatttctatttatttgaaggcacttttatgctccataaggcaaggtaggaattggcactcaagagggcttctccccacattcagggcaaagacactgctccccaaagataagtcttgccaaggctgtgctagaacagaacccacagggtggctctacggcaagagtctaggtgagtaagactataccagacaatggcacatagaaggagaccgtctccatccaagagtaaaagagtcaccagttctgtctacctaggcctcctgaagaaaagccttctccatggagaaaggagccctcataatcaagtgtaataggggaggtggtatgagagacttccaaaagaccacctaagggaagaaaaaacaaaacaaaacaccatttaggaaggaaacagcaaagggactgtatgagtgtggcctagccctatggacacatcaacagagcctggagaaaaattacagctacagcagctggacatttctaaaacttttacaccttttctatactgattaattttattgttcttttataacaatatgcaataaaaacagaaaatgtacccaaaagaaactacactgaaataacctggattttaactccagttcttctattaatgtactatgtcttctcccaaaattccttcttcactttgggccttggtgacgcttctataaaatgagatggataagcaacaaaaaactctctggccttaatgcaaagaactcatgtacttggttttaatgagagcaaagacgttgggaaagttgggtagctgggctgtataccacggctggtctaaagacagaaatatcccaacagaaaaagtaggtacttgtagctatctaggcaaagaatggaaccacaaattgggtcaagtccaggagttgaaacaggccactcaatatgctgatttctaataaaacagctccctgaacataggcagtaggctttgtttttaatgagactaccagactgagggaagttctatacttaggacagcttctaaggacgaaggtgaaagaaaaggaagaaagacaatagggaatcatttagaaaactactacatagctacattcagaagtagtctggatatgtcccattgacatgtgtgtattttacaattattagaagaaaaaaactaaagatcactgaagaagcaactgatgccacaactttgtagctaattctagaaactacaatatgtatctcttaaggcaagaagttttttttttaaacataaatgatctttcaataaaagaagaagggggtagctcattcaatgattcacccttgattaaaagaagacaaactaaaaaaaaaaaaaacagatactgacaaagctgcagggaaaagagaacacttatacactgttggcaggagtgtaaattagttcaaccgttgtggaaagcagtgtggtgattcctcaaagaactaaaaacagaacaaccattcgactcaacaatcccattattgggtatatacccaaaggaatatacagtgttctaccataaagacagatggatgagtatgttcgctgcagcattattcacaatagcaaagacatggaatcaagctaaatgcccatcagtggcacactggataaagaaaatgtgatacatatacaccgcagaatactatgtggccataaaaaagaacgagatcatgtcctttgcaggaacatggctggagctggaggccactattcttagcaaactaatgcaggaacagaaaaccaaacactgcatgttctctcttataagtgggagctaaatgatgagaacacatggacacaaagagggtaacaacagacacgggcctacttgagggtgaagggtaggaggagggagaggagcagaaaaaataactattgttatagtacttgggtgatgaaataatctgtacaacaaatccctgtgacacgagtttaactatataacaaacctgcacatgtacccctgaacctaaaacaaaagttaaaaaaaatttttttttaaagatgacaaattgcaagggaaaggagcatgtaaaaatatagtagatcatctacctgatctttcttcttccctggccacaagaggaagcaactactgagacttctgatgtcagaagcctttgtaggaaaaagggaaaaggaaggtctagataactaattggtggtatttgtgggaaggagtggggaatgagaaggtacttgaactctcttctctctttaagaacagtcagttacaggctacactgagcagcttaaaatgactctggtacaatcacacaggtctgaaactcccaaacaagaagcacggacagaacatacagagctcagaaaggggtgttacttatatcctgactacagtggaatggaataagtagatgactcacaacagctggagcaggatcaagcctaggagtaacttaatcagccacaccatcaacaatggaatggatagaatgaataagatctagtattgatagcacagcagggtgactacagtcaacaacaatttattgcacattttaaaataacgaaaagagtgtaagtggattgtaacaaaaagaaaggataactgcttgaagtgatggataccccatttaccctgatgtgagtattacacactgtatgcctgtatcaaaatatctaatgtaacccataaatagacacacctagtatgtacctacaaaaattaaaaacaaatgaaatggaaagaaaatgtttccaaatgcagatatttttctaatttcctctttgttctacttaaagagtatttcaccactatgaaaagatggaccagaaattatagaggcaaggatgagaaggccccaaagctccctcccctgcaccagggtaaccattctgcaaagttccctcttctgcctccaaggaatccatcagcagagttctctcctctgcctcagagaaccaaccaacctatagtggaaccttttccttccccaggatgcagcttatgaagctggttcccctgcttcccaggggaaaagctaaaagcatcaagagatactgaataaaatccacagaaaccttgcagtgaattacttacccttccgggagccactgaggcagagaggggtcaccatcatctggaatctttaaaaagagataggaaacaagttagatcctgggaaagatgggagattgcctgtaatctgagcagcgagcagtagagtacaagcccagagcagtgtaagtcacattcaccatgtggtgacagcctgtctgacatctaaaccaatgtcctgatcagtcagggcaacaagcaggctgctgaaatgagtggtacctgtctccttggtgaataggagatagggcaaagctcactgagtttgcagggctgaagtctactggaatggcagaactcatatcactcttatatgagccattagtgtagacagcagtaaaccaagcacaggagaagggcctacttaggcttccaggcctcactaaagcaaaaggacaccttcatatagagtccagtcttcttccagctatattcctaaactcccttaatgtcccagagtcagacctggtctctctggattcctatctcattttgtggttggatttagtttgggtgccttgaacctctgactcactgacactaagtatattctctctatttaataaattctacataacaagagaacccagggtagattagacacttggattatcattctagtgaattctataggccctagaatgagaagtcgaaacttgagacaccaaataattcaaggaagggaacagttcaaaaatcaccttttaaaggtttctgtaccaaaagaaaacaaaataaacaaaagcaaatccttcaagcagcatgcagaaaggtccaaagctgccagagtgctccagaggtccaatagcacatgcttttttcaggctaacaggtctggggcttcctgcccctccttgttttcttccactcccaacaacttccctgcctcctaactatcctggagcaaatgagctccagaagggaggcagaattaaggtgcttagctttgaacagtgagtgatgttttggagagctaaagtggggagaagttatggataacaatgaggcaatacagaggagaatagggacagataggacagagctaatggtgatggaaaagtgagggagaattacctgggtcagcaataggctcacatgaattttggatttaagactcctcttaggttgtctatgttttaatcaagcctatctccctacggaccagagcccccattccaccccatctgcctcctatcctttctataggtaggatgatattggtaatgggagggccaggtccaaaaggcagccagaagtggctgaagcaaaagacaatggggatagtatagaagaaacaacagtaggtgggaagaaacaacagtaggtgggaaataacagaaaagctgcaagtcttctaaggttgcttatggaaggggtaagggttgagtgttggggagccaatccctaaatccccagatcttaccaaccagaacttattttccctctggaaatagccaccgtactcagcaggttcttatttcctatccagagtgagatatttgccagaaaccactgggcttaaggaaacaaagtcacaaaaagtctgagaacctggctcagatcatgcacatttcctgtgctcagaagggataacaacatgtctgcaaaagcctgcacacatagtacacacaacttgtgtctgaaggaaacacatggtgagcatggatcctaggcttatggcttcagaacataagcttcagagtattcagtgatctgcagaaactcatctgaggaggattcacagtgtttactatggcccaaatcacaggcaaagcaaaccctcatggtcttcaagagccagtgcttgcaagcacagggcattagtatactatgcattcacatggtttggggaaaccacgtaacagggctacagaagcctgtgctcaacagagaggtcaggaagcctgttcagagcacaagtaccttcacacttagggcctcaggcaagaggcaggaaatgcctgcagcaaagcctgctctcaaatacaaagtacacatgcgtgctgggctcagccaaggttttacagcatatgccagagtttgcagcaacaggtagaaaatggacacacactgagctgagtaggagaaaaggagggtaatcagtgtctgggggagtcaaactgagtataagcacacacatgctacattgaatgcacacccatgctggtgcacacacattctcgcagtgtgctccagggatatctgcaggagcacacacaagcaaggagcatgcacacaaactgcttttcagaaaaatagactgcatgagccaaagctcagaggcacagatcatgcacgcacatgtgcatgtacacacacacacacacatacacacacacatacagtgcttgggaaggaggggagggaaatagacaaaaaaggacgacccaaagggtcataggcacaacctgaagggctcctcgcttttcttctgcaaggagagaaagagcagaaaaaagggcagaaaggttagtagagtcagtcctataagtagggaacccaaagaaaatgccagctaaactccaagggacatggaagagagggagaggtcctcgggacaactaggcagttcatagagcccagctgactggcttccagaatccttcctgcctgtatttgctggcccaggatttttagtttggaacatccctggagatgttccaaactaaatcaagggacaaaatctacccaggggttccagtcatccttttcccatttccaaagtggcctgcatcaagggtcagggctgccaaggttgcaagaccagatttgttaccaatgaccactccaacagactatctaagctggctgagcacagagtgatttccttcctcagaagccacgtgagcttattctagatctggtataagtcctcaaactccaaaggccctggtgactgagccttttccattttgcaatgcaggcttggccatgcattcactcaatgagctctggcccgtttctcggacctgaaattaagttggaccagggtagggcctggagttaagtccaggaccaggatgctgaatggctacaggcctgggggcatcgactggctgctttcctaatagaaatcacagtgatctagatgataaaaccatgactgcaatcccaaatctgattatttatcaaacccaggacaatactctaaaggaaactgacacttccagaagggcccgatcaagccataacaggataaaaataaagcccagagattactcctttcctattcatcagagactacattgccttctaggccatacatggataggcccacaggcttccttctgtaaggaaagtccacccaccttggtccattagtgcccctccattttcttttctcttttaaaggcccattgatgtcacatcacaagtagaggggagaattcaagaatcgaattcacaggttcccaatttttcaagctatttctgcttacttaatgggtcacctgtcctggactaggtgacaaggaatcctccaaaacagtgcagctccaggaaggtgggaaagatgagaaagacactccctggaatggggacatatctcttccatatctacatctcaacccccccaggataatgtgttccttttgagtaagaaaattaggcaaacaatcctttaactgaccccatgactcaaactggaaatgtacctctcccccttcactatcttaaatatattctacaaccatgtcaaagttgattgtgtccttctgttctccacaggtttccccataatgcctaaagattaaaatcaaatcaatccattgacagagccgtcacggctctccatgatctggcccaaatccccaaattcctctcctctgccctctttcttgaccccatatacattcctacaatctaattgtcttgtttcacaaagacgtcacatactcaaaaccccaaatttttatttactcattctgttccattagcctgaaatagcatctcacacctcctttccatagaggaaaatccaactcttcctccaaggcatagttctgggaagccttctctgatgcccacccaagcaagagttaataaggccatcctagtgcacctaagttacattcatccttctcattggtatttaacacataatgccttgacaagtcccaccattgtacagatgagaaccagagcaaatagatgcagattttttttttttttttttttgagacggagtctcgctctattgcccaggctagagtgcagtggtgcgatctcggctcactgcaagctccacctcctgggttcacaccattctcctgcctcagcctcccaagtagctgggactacaggcgcccaccaccatgcccagctaattttttgtatttacagggtttcactgtgttagccaggatggtcttgatctcctgaccttgtgatccgcccacctcggcctcccaaagtgctgggattacaggcgtgagccaccacgccccgccctagatgcagatttttaacttcaactgggccctctgtgtcacttgataagtctcttcttccattagtcagctccctcttccacttctcaaaggagttatacctaaccttcagatacctactttatcacaacacattaaccactgcttagtgtgtatcacctagatatcgcatgcttagttcaaattcaacatatccaaacactaaacttctatcttccatctctaaacgtctcctcctgtccccagccagacaatggatctctccctctctgcactctgtccctatccaatcactcagccctgtactttttacctcctaaatatctctggcatccactgctgcctttccatttcacactgccactatcatctcttaactggactataacaggagactccaagctgatctctctgccactagacttgctcctctccaatccatactccacatttcccatttcgaaattctgatcgcatttttttctttgcttaattgcatcaattctccccgttgcttactgtagcacataaagtgcttcaagatttgtacttcccctaccgttctagcttactttccttccgctcctcacgtgtcctgtattcaagtcttactgaacattctccatcacatctgagacttttcacacctccctcccacacccagcctactgggtggactcaggcatattccctaagacttagttcaaatactaatgactctgtgaaatttctgtctgctttccttcccaaggtaggattaagtgcctctccactagctgccctggtctccaccattctatgtccacacttctaagacagtatgttgttaatactgttttgtagtatcatatattgtagttgtctgtataaacatcttcctttataatatttctcactttatactacttcttcagaaaaaaggattatatattatttcacctttgtagcctgagggcttagcacatcgcctatcatttctatgtagtaaaagaaaactataactttcaggacttagaaaacaacagctattctaagaagtgtctcttgcccaaccagagaaggtataagtctcttaaccagtagtctgtaccattttccagaccctgaggaactgctatactggctattcagtttgtcctacccgttggacaaacattaaaaaacaactttttttcttaagaatcaaactttctgtgcttcccaactccctaaaatgccttaggatttttccacttagatttagtttgcaggttaagttataaatgtctacaaaacaactgctttgcaggaaaatccctgaccccctaagaatgatctctctcactgttccagacagtccattttataaggaagtgacatacctcctcatcagcactcccctcagtatacccaataatacaatcttaactccattattgagagtcaaaagacttgagacgttcaacttatttgagcctacatttccttaactataaaaagataggtatatgaacaactacctcccagggttattgcaaggattcatttcttaagaacctattatactaagggctggtcatggtggctcatgcctataatcccaacactttgggagactaaggcaggaggaaggatagcttgaggtcaggagctcaagaccagcctgggtaacaaagtgagacccccatctctacaaaacatgaaaaaaatagctgggtgtggtggcatatgcctgtagtggtggcatgtgcctgcacgtgcagtgcagctacttgagactggggtgggaggatccattgagaccaggagatcaaggctgcagtgagctctgatcactccactgcactccagcctgggtgacagactgagactctgtctttcaaaaaaaatttttaactaaaaaaattttaaaagaacctaatgtgcacactaggcactgttctcaatcagtgctggtgatgtggcagtgaatgacacaaactccctgatcctgaaaagcttttattttagtaagaggagcagataataaacaatgatgaagatgatgacagtagctgatactaatcaaacacttattttgtatctggcattttatttgggtaagctcatttatttctcacaactccacactgggtaaataccattattacctccacttctttgataattaaattgaagatcagagaggttaagcaagatgccagcaagtggcaaagccaaaattcctaacagacattcttgttccagggtctgctttccataagaaataacaatatactatgtcacatgtgataggaacttggctgaaaaattcagataagggaaaaagataatgccccctgatgatggaggtagagttgttattaaaaatccaaaaaatggttgttagggcggcctcactgataggtgatatcaaagcagacttgaaagaaatgagtaaagaagccatttggagttctgggaaaaagtattttcggaagaacatatagcaaatgcaaagcctgaggtgagagcataattggtgtggagaaacagcaaatttgcaataaagtaccagttcaaatagggctctacaggcctttataagaatgctggtgtccattctgagtgagacaggaaatcattgagcagagaggtgatataacctgactcatgctctatggggattactctgattgttgtgaggagaacagactgtagagggacaaggttctagaagcagggagagcagtgagaccactgcagtaatctagatgagagaaaatggtggcttaaacaaggatgacagtggtggaggtagagataatggcaagattcaagatattttttaaaagtggaggaagtggaatttactaacggactgaatacaggttgtgagagagaagggagagtcaagaatgactctatggattgggcctgaatagctgcaagaataaagatgccactcatgggtaagaaagacaataggaaaggcaggtttggcaggggcttcagaagaaggatcaggagtttggctttggatatgtcaaatgagatgcctatttacatccataaggaggtgttacgtggatttggagtctggtgttcatggaagatgtttgggttggagatataaacctgggaatgcttatgaaactcgggattgaaagattatcatctaggaagtgagcataggaagtcaagattgaatcccaggatgctacaaggttggggagaggaagagcaaagataactaagaaggaatggccagtaatgttgggggagaggaggaaaccaagacagagaggtgttctggaagccaaatgaagaaagtgtttcaaaaagaaggaattgagcacaagaacagactgaatatcaatagaatagaattgagtccagacataaactcttacatttatggtcattgatttttgacaagagtggtaagactattcaatgaaaaaagaataatcttttcaacaaatcattctgggacaactagatacccatatgcacaagaataaagctggactcctacctcatactatgcacaaaaattaactcaaaactggctgggcgtggtggctcaagcctctaatcccagcactttgggaagccaaggtgggaagatcacttcaggtcaggagttcgagaccagcctggccaacatggtgaaacctcctctctactaaaaatacaaaaaattaaccaggcttcgtggtggatgcctgtaatcccagctagtctactcagaaggctgaggcagaagaattgctcgaactcaggaggcggaggttgctgtgagccgaaatcacgccactgcactccagcctgggcaacagagcaaaactccgtctcaaaaaaaaaaaaaaaaaaaaatcatagacctaaatataggagtaaaaactataaaactcataaaaaaaataggagcaaatctttctgacttcagattaaccaatgatttctcagctatgacaccaaaagcacaatcaaaacaagaaaaaaatggataaattgcacttcaccaaaatttaaaacttttgtgctctacttcatacccattacaatggctattacttaaaaaaaacaaaacagaaaataacaagtgttgaagaaaatgtagagaaattggaaggaacccttgtgccctgatggtgggaacgtaaaacggtgcagccaccatggaaaatggtatggtgattcttcaaaaaattagaattaccataaaatttgatcaatccactttggggtacatagccaaaagactgaaagcagggactcaaaaaatatttgtataccactgtttatagcagcattgttcacaatagccaaaaggtggaagcaatgtgtgtcctgatgagtgaacagataaataaaatgtgatacatgtgtacaatggaatacgatgcagccttaaaaattccagagtgaaatttcagagtgaaattctgacacattacaacatagatgaaccttgaggacattacgctaagtggaataagccagtcataaaaggacaaatgttatttgattccacttacatgaggtacttagatcaatcaaattcatagagacagaaagtagagtagtggttgccagggactggggtgagatgggatgaggagttactatttaataggtatagagtttcagttttgcaagatgagaagcattctggagatgaacggtggttgcagaacaatacgaatgtacttgatgttatggaactatatatttttaaatggttaaaatgttccacataatattcagaaaaaacatggtttaaataacacattttatgttatgtatattttaccacaaaaaattgttttttgatttttagtaaagacaaggtctcactatgttggccaggctggtctcaaatttctgagctcaagtgatcctctcgcctcggtctcccaaagtgctgggattacagacatgagccaacagacctggccaatagaatttaaaaaaaaaaaaaaaaacaataaaaaaatgtatgcttcaaaggacactgtcaagaaagtgaaaagacaacccacagaatgagagaaaatatttacaaataatatatctgataagggacttatatccagaatatataaagaattcttacagctcaaaaacaaaacgaaaaaaaacctcaatttaaaagtggtccaaggcttaaatagacattactccaaagaagatagaaaaatggctgatgagcacatgaaaagatgctcaacatcattagtcactagagaaacacaaatcaaaaccacaatgagacaccacttcatatccactaggatggctataataaaaaagataataacaagtgttgccaaggatgtagagaaattagaaccttcatatgttacgggtgggaatgtaaatactgcaatgactttggaaaacagtctggcagttcctcaaatggtaaacagaattaccatatgacccagcaattttacttctaggtaaatacccaagagaattgaaaatatagttccatagaaaaacttgtatacaaatgttcatagcagcattattcataataagcaagaagtggtaataataactcaaatgtccgccaactgatggatttaaaaaatgtccatcaataaatattgttcagccagaaaaagaaatgaagtactgatacatgctacagcatccttaaaaacatcatgccagacacaaaagggcacatattttataaacccatttatatgaaatgtacataataggcaaattcatagaaacaggaagtaaattaatggttgccagaggctgggggcaaagagaagtggggagtgactgccaatgggtaagaggtttcttatggggtgatggaaatgttctgaaattagatggtgatgatgtctgcataactatgaataaactaaaaaccattcgattcaatactttttaagggactttaaggtgaattttatggcacatgaattataactcaataaagctgttataataaaaagaggaaagtgatcatcaactgtgtcaaattgctgactgataaaaagaagactgaaaatgaaccattagtttggcaatatggtggacatctaatggccctgatcaaagctattttggtggagtgacaggaataaaagaattgaattttatacaatgcacatgagagtacttaaaacagtacctggcacataccaagaaaaaaaagatgaaaactaactcaaattaatcataagctacaactagtaagcttagggcctaaaagatcccaagcagaacagtaaagaaagcagagttttcaaaagcttcgttatgctggtagtctctgtgatactgaatcagtttactaggttaggggactgctccagtgaagtctatgttggtgagagtctggcctgtgtgcttgtcctgctctatgcaagggagtgctggagcaccctgtccatgattctgtctgcagccctcaggccagactgagtactgagtcttggataggacccagaactgtgacttgctttcttattggtgctttagaaaacctccttctattcatcaagactgctgctactaccacctgcctaccatggcaccacaagtttctgcattgcctagaaggatgcagcccagaaaggaaactctgcaagctgaagagttagacacaagtgtcctcatcattggtgctcatgctaacatcagctcccaccaatatttaaagagcttgtaagaagtattgctttgatatttgttgtttctattgttgctgtgctgaaataatttctcattgcctgggaagaagaaaaagaggctgcaaagttatgaagacagagaaatccctcacagctgagaaattactgcctcagaaagcttcctggaagaggtgatatatgttgaagaataggtaaattctgctaggttgaaatggcaaacatagcattttatgttagaaggaagcatgtatatatgaatgtattaagaatagaaagtgcaaggcaaatttgtatgacagcaaagcttccttttgaaagacttatggtgggacaatgggagataagcctggaaatataaactagagaccaattgcagtgaccttgaatgcaaagtgaaggaatttagactctttttgataagttctaagaaggagctctagggaaatttgaaaagagaatgacgtaattttcattttttaaatgtaactttatggcttagtattatattcatatgattcaaattctaaaaattaaaagaaggcacacagagaaaaatctccctcccattccatttgttcacctaatacatttccccatgggcaacaatgtatccgtttcttacatatctttcattagataatctatacatatacaagcagacattataagtgtgtgtattgtattctttccctctttttatacaaatgaaagcatcttatacatactgctctgcactttgcttttttttgtatgtcaatatatcttagataactttccatttcagtaaagagctaccacattctttttatagctacacagtactatatcccattgtttggacgtgccaataatttatttaaccagtaattcctgatgaatttttaggttatttttaatctttgctattaaaagctatgcttcaaaaatagccttgtccatatgtcacttccacatgtgaaaatgtgtctgcaggatacattcctgtaagtggtgttgaggacttaaagggtatatatatatttgtaattttgataaattttgccaattaccttccttagagattatgccaatttatactcccatcccaccagcaacgtacaagtgcatattccctcacacctttgccaacacaatatgcttcacaatttagatgttgccttaggaagattaatcaggttatatgcataagaggacaaccccatttaaatttaaaactggatgaatatagcatatgctctttggataaatttaattttgattgggaagagtaattttaaagctacatatctccaaactgcctagaaaaatgttctcttacttcctgtagtcaaaaaacattccatttgccagcttgcaggtgagcagcttttagggggagatggaagaaagggaataagacctgtggagggcaacgttgggctctagggctaggtcagcactataagcagctcctggatgccccaaatcagaaataaggttctgtgtcagcaagtcaggtactaggaagagacaggtacctggggtaggggaaattcccacaggggcctatgagagaagccccatcagctactggggaaatggcaatcttatctcagcaacaaatccacagagaagaatttttaaatgcaacacaggattctttctcagcccttctagtgcctgtgagcaaatatgtgtcatccccaactcctgcctctcactcccaccccttctttacatctgatatcctaaaagctctgcagctgcaaactacttctgctccagatgctcctccctcttttgaacaggtatagcaccacaacaagagactggaagataaggacggcttcctcttgcttgagaaccctctttaactccaattcaagcttcctcttgcttgagaaccatctttcactccaattcccacaggattagcttaagctctctacttgagtaatttagcctgattcaagctatggacgtcaaccaacaccttattaaactggccaccacaccaggtctcatgctggccagatggaggtcatactttagccagctgggaccctgttaaatagtgactcagaatacctgagtgtatgtcttctactgagagacggtttgccttctgtactagctcatgcagaagttttttctgccttagtcttttctctcttagaacattcttaaaattgttgatgcacttgttgaggtaaacggtctctgtacacacttgctctaggctcagtctgccctgcttgggagatccaggcctggaacaagtctcacttcccagacatggagccagagcaacacttggcaaggagttattagaagcaagagagaaggtgcttggatcctgaggggtttgctctccctgtgtggagacgccaactccaccagagaccacactgagcaagctttcactcccctgactcccagggctctccagtgagcaatcctgggcaccccctgaactcactgtcccaagaagtcgatcactgttctctgactgggaaccactctcattgctttccaggtcctcaggactgatggacccactgttctccagcttctgaaacacaccctgcagagcagaacgaaagtggtgaattgctcggcccagtttacttgtataaaacttgatttccacatcctcatcctcctgagagccacccagaacacaagaggacttgtcaaagacatccttgaggacgtgagcagcacattcctcctcttcattcaggtcaatatgaaccatgtcactgaaagtctcaggccctatgataatttcctccatcatgctgtcacagctcagagctgcaagccttctggacttgtctgccaaaaggtcctctagttcctttgagctcagaatatcgagcccagcttcgcagcccaggagcttgtcctctgcgtttattctctctgtcttcagtaacccagacaatgacaggcagctgctggcctcacttttatcgtggcagtcattttctggttttcctactttacatgcttcatgtttttggctgtactgtttgaaaaactgggacttcccagaagcctcctcttttgagattaatactagggcaggttcctcaaactgatggggggtagacagagaagcctttttctctgacagttcatcacagctgccactgataacttgagatgttcttgatgctccttttatttcatcccctagcttgggcacatcactttcctttgataaattgttcttgagtagaaagcaagggccttgctgctcaggggcctggtgctctctctgttgatcctgagccttcatctgatatgttcctgttatgggtcccctgtcccctgtttccatctgaagaactggttcatcctggtttaaagaagtctgactataatcctgatgttgttgttgaaaaaatgatatagactccttctggggattcttattaccctgtgggcagcttggttcttctctggtggcaattcggactcccacattctgcaagaggatggatttctgcaagatgaagtctctatgctctagatgggcaagcttcacaacagtgggcctaggggaaggggatgtgcctgccctgtaagcctttttaatgtacctgttgcactgcatgccattaacacaaaggtgcttggctagaaagctttccaccagttccatagtattttctccatcttgttcaggaagtccgtacaaatacagaatggcttcctcactgggtctgtccacgtggggttcctgggccttttcaccctcacacaccttggccagggaacaggtgctcacctgtaagccttctatttcactcagtactgagtctacacagctagagacttcatccacggaaccctggacttggctcaagtgctgctgcagctcagcaatctcagtctgaagacggctgatgccttgcagctctctgatgatgtattctactacatcccccaaaggttcccgctgttcacggctacagccttggccatggcctctggacaaaagggtcttggtttggttcctctctgagggctcctgacagcttgtggtaatgctgacagatgagggatcctgagaaccagaccctgaaacataggcagtggagcccagaggaagctggctgttgttctgctgcccaaagctgcaaagctgggccaggtccccatctctatctccaccaatggctaaggctgctgacccacagcaagggggcagggagttgtcctctggtaaggatccagcagggccagaggatttgctcttggtgccacacatggtctctgccttagccttatctggggaaagcctggaggagggtcccaaggtaaccatgatttcttcctctgactcttgcaacaatcgcttcattttctccctcagggtttgaggggttctctgcttcttcctcttatttctggtcaggatgcttaatagagattaccttggaaggcaacagcctgtcctgctcttttcagtttgtttctagcaattattgctggctgatgctttgggcttagcccacagtgctgcctggaatggccccatgtgtggcctccaaacctcgcacatgcccctggatcctggcttgatttatcctgtagctagtgaaaaaggaaaatagtgcactcaggtcagaaagtagcaggatgattttagtttgaatcaagttgtcaagcaggaataaaaacattatctcctaagattataggaatcaaccctgacctgcctcccaaccccagtcttaaaggctatgggcagtcagttgtttctcattagcttccccttagagtatcaatgtaaaattaaaataaagtccttgtgttctgggcaagtacccaaagtcaacgatattgagacaagctgctgggaggtagatgaagtaaggtcaatgagtaagtccttatttgaactttcacaaaattcagtactaggagtctggctcagaaataaacaaacaaatgcttaaccaccaaggctcaaatcacatacacagtgaaagacaagacatggaatgtttctttctttctttcttttccagtttgttgttctggtgaagactccacttactcaaaagtttacccctgcctgtgcttatagcacaaagtattttccctttgttgagtgatggcaaccgttcacttggagaaaggacaatggtttacgtattttaaacttagcaggaaaaatatttctttacctaattctagaataaagtggcacagtacgcacacactgtccagacgtaggtggcatttagcatgagagaggcaggtagagaggcaggtagccaaagagacaggtatcatgaactcacaactggggatgaaggaggtttaggcttagcttggtgctcctgagctccacttaatactctctaagggcttgctgcagctagtcaatatctgggtttggctttcctggcccacagaggatctttcagagcaccacaataagtgattgtccagcacactgtccactgctcaagtattaataacaaagggttgctctaatcctctgcctggcccagagagaatatcacatgggacatgtgggggagggttacctcacagagggctccagggtgctttactcttctccaataaggtaaagacagacttgccaccagtctagtccctacaccctaagctattggtgactgcattacagaggcagagacgatgattacctcatgtggagtgagaatacattccctttttactgagaatgtggagagtgtacggaagcagtagagtggaaagtacaaggaggaaagcagagatctaggaggcacatgggacaactaatattccagtcctgctaggtctcctgggaggggtaagatggattggtgggagacatgctactcttcatgttctttgaccagggatgctttccccattttctagatttgatggagatttctaaatcttctaaactctgcctccttttattttcccagtactcaagttaatcctaaaagtgggaaaatgccttaaagaacacaggcagactgctctcatggcaacccattttcaggaaaggccaccacctacatctagtctgtgggcctggaatttaaaagcattgtgcttccccagactaggaggaaccagaaggacgagtcagaggacttgggataaagatgaagctgattctttttactagaaataactaggccaagaaccaagagacagaaactgcatgtattcccatttcacatctctccttttctttccagcttatctaacaactctaattcattgaggaattcttcatctaagaaccctatccatcctgtgaggcattactgcttcacctcaaggtctcatggggccaggaacagccatgcccctaatctggccaactcagtctagcctgcgaggatgcactacctgcacaaccagaatttctgggtcttgggcttggtgcccagctgcctaggtagaccacgctccaaagtctagaggatgccaaattcttccttctctcttcccacaaggacaaaatctgaatttccaaagatactcctttttttttttttttttttcctccccaaccatgtagggattgggtatccctgatttgctcttggtattagccatgaacaatgttcctggctttacaagggctgcagctggcaagtggcctttcaaatttgtctttaaaaaagaagtactgcggctgggcgtggtggctctcgcctgtaatcccagcactttgggaggccgaggcaggcagatcacaaggtcaggagtttgagaccagcctggccaatatggtgaaaccccctctctattaaaaatataaaaattagctgggagtgatggcaggtgcctgtaatcccagctactcgggaggctgaggcaagagaatcacttgaacccaggaggcagaggttgcggtgagccaagatcgcaccactgcactccagcctgggcaatagagcaagactgtctcaaaaaaaaaaattagaattgcttagtaagcttagtaaactaagatggaagctctgtgtacaactacatgaagccatgagcaagtgctactggactggcatcaagagacttaagtttgggtcttgttccaccagtgaccttggattaaacacttgacctctatgtgaattagtttcctcatctgtaaagtgggggagataattacaggaatgttattatataaagctaaaatgagagaactgtacttactaaactgtaaagcactgtcctgttgttattgctactgatgtggcaagtccctgagtcaacaaagtagggaaacccatatctaaagcaagcatccaaccacctaactggcacaatttgagtgagccatgacttctacttctgccccagactcctgcctttcccactcccttctaatggtctgcagcagtgcctggaatcctacgaggagactgtcacccttaaagttagtcctgctttctcctagaagttttctttttaaggtaaggagaaggaggagtaaatcattcagttcccaacacctcattcaagtgtcaggaggccggccgtctctcagacagcctgaacgctgaggaagagataaatggctatagaagccaagctttatttttccaatgctggtgaggcccagaattcattgccaggtcttctaaggccagcctcactttggtccagataaggcagtttgtcgggaacactaatgaagctgactcccctgctactgctactgattcagtgtagaccaggctaacctggggcctatctgcttctgcccctcagatcaatactgcagacataagtttttgttttgttttgttttgtttttgtttttgttttagtagagatggggtttctccatgttggtcaggctggtctcaaactcccgacctcaggtgatccgcccatctcgcctcccaaagtgctaggattacaggtgtgagccaccgtgcccagccctccagacatacttggcctcatttcccggacaccttacaaggtattcccttccaaactacagtgcttacgacactggctggccagccacacagggggcaaatggcatagccactgggttcagagtcctttcctgtggcctcctgaagactgaaggcagagctgcctggttccccatgttactgacaaataggaaattttcaactagagctgccatagcagcttctcccagcctcaaacaaagatgcttccttccatattaaacaaacaaaagcctccacaccttcttatgagttggtagccactgccctgggatgaactttgaactcaagaatctcttctggtgatataggaagggcaccaaactcacttagtaatccagtctttgggctttgaagcaggggatggagctcgatgtgatgctcagaggaccaaccagtcactgtgctgagctcagtagaatatcagaagccagaatgggctgaaagggcaaccctcagggacaggaggcccaattcacctccttcccagcctctctttgctactactgtccacagaagtgaaatgacagggagcaaactgtaagaaggaccatttgatctccaagtcagttgaactgcatgagtacttactgtgtgtgccagggagataagatgcagtacctgctctctaatacattaagatttggagagaaagatatatatagatgatcacaatataaagtgatacatattataataaaagttataataaaaagtaagcatttagctgggctcacgcctgtaatcacaacactttgggaggccaaagcaggaagatcctttgagcccaggagttagagaccagtatgggcaaggtagggagatcacgtctctacaaaaaataaaaaattagctggatgtggtggcatgtgcctgtggtcccagctgcttgggaggctgaagtgggaggatcgcttgagcacaggaggttgaggctgtactccagcttgggtgacagaacaagaccctgtctttaaaaaaaaaaaaaatgaaaaagaaagtaagcatttaattcaggggttgggaatggaaaggaggtgagaggcccagcaaaacgaggcatacaaggccacagaaaagtaatgtttgagctgggatggggtaagtaggctctggagtccacctagccttggagtttcctttaagatacccaatgttatctgtctgccctactttgttggcctattgactctggacaactctccaaatttcatacacacacattccgacaaaaaccatacctttctgtgctcttttcctcaggactgcctaaggctgggaaaaataaggcagcccctttcaaggactatctgcatttgaaaagggagcacatcaaaacaaaatgaattaatcaaaaagattaaagctttaatgatggaaagctaacaattactgcagggagtagatcccttaaaccacattgcatcaccaccagcctaccaacgaaaaagagaaaggaaaacacctcagttttttgaaatggctgattcttttatccttctctctgacttatcaaataaatgtgattaggaatgtaactattccttgtaaaaactgcttctaacccaaatctggcttagaggaaacaaccaggggacctctgggaaaaggccaggactcgatgtacatatatcaagcagcttcccagtttgtgtgaaacaatcccagcaagcagaaatccaagagctctgagcccccaacagaggacagagcatttctgggccatatatcaattatgttgtatggctaatatgggctaagaggaatggatttctagggccacagcaggtatggggattctcaggatgttaatcatcaaaatgatcagggcacaagatatggcaagtgagattagccaaagggaatgagaaatgccctagatcaaaggcttagcaaggtcccagtattgcagttcctaggacttgccatccatcctcatcagcattaagagcagccccatttataggccagaagctagacatatacaagggaaagaaaacttcaagcctctatatccaagaagggagacaatctcaggtaacatacagttaaaagacagtggcatgagggcggacctagccttcagagggagggcatatcaatacctcataatggagactgaatgccaggcatgagagcaggctattctgtgccctgcccagggctccctttcagcagtagcaaggttttttataccaaggagtataacaaagcatacaacaaatacaatcacacccagaatctaacccatgacaaagactcttctttgacgaaacataagtcaggctcctctgagtcctctttctgagtaggcccttgacattggctcatttagtccagttttaacaagaatccagccaggtcattttagtgaaaattcccacccttgatttctgatcaaattcctcatctttcacccttagtatctgtctatgcttggtatctgaccaaatttcttatcccctacccctgatatcttaccaccttggcctgccttcagcaaaaatcctgtcaagtaagtttagccaaaatcccctttgatacttcatcttagtaatttccgtccactgataccccaccctgctccttggctaaattcccacttttccttatatttggagttgagctcaattgttcaccctcactacaaaaccccagtattgtcgtccccccacataaagtctgtcttatcatctttaacaagtgtcaaaataattttttgtttaacactcacataccctctttttccttactacctcctgctcttgtgagtacactgaaaaagatacgagtgcaggagaatctactcactgaacaccccaccacaaaaaaacccatctctatcctcttcctctagaatttccttcatagaactcattcccatctgatagcttgttcattatctgtctccctccctgacctctgtatcccaaaacatgagcagggactttgttttgttcataactgtatcttcagcacctaaaacagtgcctgtgctaaaaacaaacaaacaaacaaacaaaaacccaaaacaaaccaaccctgtcattgaataaaagaaaccagaacatagttggacaaaccctttagagggtgtctaggcctggaatctcacactacattgtgatctaggttatggagtagtcttaccatcatagtgcttttctatactttgaatttgaaagtctttaggcagggcaggtgctctagcttctcaaaagccctactacccttgacctagaatgagacccttgttgtcattaatctgttttgctgtggcagactactagatgggaggctcctattcaaagatccgcagcgggtgtgaactccattacattggaagctgtgtcttatttgtttctgaatttccagtgcctagaacagggcattactatgcctgacacacagtgagaattcattgtcatggaaagcataaatgaattgatggcagagccgaattagaatccaggtctcctaattttctcatccatttctgtttccatgacaacatgctgcattcaagttctaggtttccttctagattgatggcttacagtcctctttcattgtaaaactaaggtggaaatctttccccagttgtacttaaaattatctgggaactcactcaggacaaaaaaagaaaaaagaaaaacaaaaaaagagtgtgggggcatggcagcaccggtctctgccagaccatcaattagctggtatctctccagtgtatgagactggcagggagagatcctgctgtggttcctgttaccccagggatgctgtgacagggctcccatcccctaccccgagttggaaaagctgccctgatccttgtgctagtgatgggtgagtttagagcagcactgactaacagaaatataatgtgaaccacatgtgtcattttaaaatttctaatcgccacataaaaaagaaacaggtagaattaattttaatatattttatctaacccaatagccaaagtattatttcaacatataatcaatataaaaaattattaatcatatacttgcatttgtttcctatactaagttcttgaaatctagtatgtatcttatgtttagaatgcatctcaaattagactagccacattttaagtactcagcagtcacatgtggccagtagctaccacattggacagcatgggtctagaattctggggtgggaaatactctggagagccttccaaacctggcagtagaagctcactgcaaagggcacactgtcatcccagaggcagtcgaatgttacgttctttcactcatcttttcacctgctcactttgatcctggctggaagcagcccatttccattttgtgtgaggttcaatcctcctcaaggtacaaaaaacaaagtatcaaggccccagcctacagaagatgagagcttttctccctctccacctgaccctttcacggtaccccgcttctttccaatactctgcagaaaaccacaggataaacctggttacctcaatagatgcttccccttcacatggaaaacttagaaacctctcacagacaagaacataatttcaataaaactggaccaagagtacgctatcctatccaactcatactagagggacacacagtagtaagagattatatttgtttagaattttcagtttatatgattcctattttatcatcacaacaaccctgtgaggcaggaggtttgttgttactgttctgattatactgatttcatagatgagaaaaatgaagctcagagaggctaaatgacttgaccaaggtcactgagtatagctaggatttaaaagtgagtcttcaatctgcaaagttagtgctctttcttcatacatgcaagacacaagtggacagactgtctattgcgcatgtgtgcatatattcaagactgagaaaactcaagatgacttttctgtttatatggcatatacacacatgaaagggatgaattaatacattaggatggtggttttttctctttctctctgtctctctctctctttctctctctctcacatatacacatacaggaagggtggaaatgatacagaatatattcaagaacagaaaggttacttgagtacatgcatacacataggagatgaagggatggattatatatgtatgtgcaagtagggagagacgaattttgcatattcatatatgcaagctggatgaatgagttgtctatacatatgcacatgcaggagaggaatggacaggtcatttattcataaacacatatggacacatgaaaaaggagaaacagattatttgtatatgaatatgcacacatccagagggtggctgggttatctatatacatacaggaaagtaccacagaggaatggatggtcagattatcagcacacaaatacatgcatgtgaagattctaccccagtgcggcatatgctacttttcactcattataatgacccccctcaccagcaagttgactcaagcaattacgtaattaatgtagctgctccatattccacccacaaatgctttccttttgccctgcttgttgttcagtcagtcatacacactcggtaccacttaccttgctgctgcaaccaaaataagggttaaggaaattaaaaaaaaaaattaaaaccatgaattctcaagttttagaaggcaaatgctgtctttaagaggaaatccatccaggagcactccttggtttgacagagaagccacaggacgaactttctgagccaaagcaccactgcttgcccaaccgacaaacagacccaaggagctaatattctcagttgcacccagctggctggctccacggcacaaagttgatgacagaaacaatgccctgcaaaaaaacccctcagtgaagggcttggcaggagtctcactggctgcaaacgtagaaatctaacctggtccacacctctctggcaagggggattctgagatcagcctgctgaaggcaacagcagccaaacttcaactggatgtggaattctaactcaatcgattctgggctttgagactgaggcagaaagcagggcagctcctgctcctgctgctgctcctcctcctctccagctgcttcctgcctgcaacctcccatagggcaccagccctcctcacacgttcctggcgcacacacccccttcccagcacactcacgcacacacaacccttgccagcaagctcactcacacacccttggtaagtgtctctcccttttgctaaatatagatcttactctctcccctcctccatttccttccctcgttcttctcctccctgctttcttttcccctatccacctctctcacatctgggctataggatataaacagacacagatggagacctatactttcaggagctcctagtctcagagggaagccggaacacagcatgccagccgtggaactgctggagcacaatacaaagggagtcttcccttctactgagacaagctctaagttggttggttggttggtttcgtgtatatataatctgttgtcagcatttggcaaagctgaaggataggtacagtgatcaagtgcagttaaaatcaaacagtgccatgttcttggagtagacatctattccagttcttactgaacaaccaccacaagagaatcaactggaaaataagagctccctcaggctatgccaaagcaacaacccgagagaaggaggggaagttaggtgagctgagatgaactctgtattgcagaagtctagaccaaagatggtttcagaatccagaattaggaacgaagtaacctaaagtgatatcaccatgaccaaaaagctgcctaaggttcagggccccttttatgaccccaaatttcataacccttctttgccaatggatgccctatctccctggagactcactagccaggtggctctcatgtgaccctaattcctaataattcaacaattctagttaggactcactgggaaattgaatgtccttatcttcaaagaacactcaagttgttcactgcaacataatgtccgagcacaagccaggaccccttgaagctctgtagcataaaatgccaaatacatgaaatgtgatatcccctttccactctgcaaccataggacatgaaaaacatcgcataatgaacctagataacctcagaatccttctcaatatagagctcgatcagccagtaacaatccagtgaagtcattcctcttctgactcccctgagcttgatcttaagagaaaaggccctcttcctccttaggccaacagtacgtgggcaagtttgatttacccagcatgcccaaaccaggctctcaaaccttgtgacttctgctgccctgcaacattcctcatggcaatccacaacagagtatggcctctttagcccacaaaccaggtagtcagtctatggggaccatcctaggatctgccattgcagaacaggcagccctttatggtagataaaacaagcatttaaattaagaatgatttgtttggcttatccaagatcctgagaagaaagggttgatttcagagccaacatgtgcctccctactgccttcttccaataacattgcttccccctcaaccaaggaagaaaatttagattccaagagatgctaaacaacccatttcttagccatccacctcattacacagccaacactaacagcagagcacatacctcctaacctagttgggagctggctagatgacagaagagataaggcctgacagcacaactataaccgcatctaaacacagaggaaaaaaataacttgaaaactgtcaagtttctgtggaagtcacagccaatttactgtggagtttcccatccttcagccaggagaaggaggtaaaaggtttaaaacaagaaatatagggaagattgattaaattagaattccctcccccaaatctgcagccactcataaagagcccagaacagtggctgtcactatcaggtttggtcaggcttcctaggctaaggagaagctcaaactttcaagagtgggaaagattccccagaggtaggaccctgctaaaagaacctacttcttcctgcctaattgacaaagtggccctaaggcctggctaaggcctccagatggcatttctgaggctaatggaacccaccctgtcttgtcacccaaacacatccagcccatttttctaagcagcttgggctttccagaaaaacaaaggctcaggcagtagaagacgtggttagcacatgaggcacaacaaatctgccatctccagttacaatcttcaaacttcacaggagagctcatgcagctttgaccacaaattacctttgtatctatccaccttcccatgttccagcaaaagcaagaaacagagtaagtggggaagtggcaaacagtcagtggaagctcttgtaaaagagcatggccccttctgccactgttctacagggcccacagagtgccagacaccacatggccaaaggacatcaggactcctcagtggactagctctttgggacaagcaggcaatttgttttgtgagccacatgggcaacaatgcagccccctcatcacagtggatctggccctggggaagcctgagtaggccgaaaggatggggtgctttttagaggtaagaaatagcacagcacccacctcagttgggaagcttcctcaaagtaggctgctcaggagctagctgggcagaactggaaaaacagattgggttaagaaggaaaaggcatttatccagaagctgtgaaatgctctgaacagacattctcaaggtctggttcccaatttaaatccttgcagggatcttcgcctagagacagatgagtcaagatggaaactcaacatgatacactgacactcacgcagagttgtgggaaggttcagacctgcaggagttctaaaggggagccgaatgggtgggttagtcagaaaaccacctggcatacaaaattcatcttcagctaaagcaactgagtggtgtcacagaaatactggaggagggcctcaccaatcacaattctccctactcatacaaaccagtctaagtctccctgacgtcagatacaactggtctagaagcaaagaatatgcctgctccaaacctggcctgccttttcaggtgtcaatgccagagacaggctgggtcaggaccagcaggtgcttaccttattgtccaatatcaacacagacgcagagtacaaaggatgggtgcggccaatatctatatcatgcaagagtcagcttgtgactgttttccttctctactgctgaggaaagccagaagcaacatgaaaaagctgacatatagtcacacagctgggatttatttcatgaggaagatgatttttctggtggctaagaaaagtcatttttcccgctgtagaatgatgccctccctacaccatggagaaagcatatgcagcagagaatgacgggcagcaggaggtaatcctgctccttccctgaggagcatgccatcctaggggagtgacaagcctggcagagatgtgctgactttactgatgcactaagacatagctgctttgttacctaaacagacccgacaagctgcaaggcaggccctaagagtcataaattgctgacaagtcttagtcctacaatcaggtcaaggaccatccctgattagcagaaacttgaacataaggagctgataaacttcttggaactggccagctaaccagttaggttttcagcctgtacctccaaaggctgtggccccctatctatttcaggaccaaataattaacaattcatgatcataagaaacctatatgtctactgccctctcacataaacccgatcaaaagtcacagctcccagatttaggactaatgccggtcctaaagtagtatttgtttatatatatatcccagcccaagccacagagtgcattggccctgcctcaatctctatacccaaaggaaacaaagaggccatataccgaggatcctctaaaaggaatccaaaatttgacatcccagggagaaatgaacctcttgtactaagtggagactaactgggttaatattgatcaaatatcccctcagttctttatggcttgttctaagatacatctaagaataagatatagggcaaacccaaatctggagaattctcctggcttaggcccctgtttctatagtcttgtggaaatatgtccctaaccagcagatgagtttcaagtgtcttcacattcaatgaagggatcccaaagaggtgggtttttccctacaggattctccaaatattcaaaagtatctgatatgaggtactgaattacaggaaggtagctaatgtacaaaggggaaaagaagacttaatgaaggcgtatccttcactggggatctctgacagtaagagggaagcatggtggaaagaaagggaagcactcaactaggtaagtctgaagagagaactacgtgtttagaggactaggctgccagctcacccatatcaacccatgcagagatgacttctctgctcagatactggatcattggaatccatatattctaattctttacccagtgagagaagcccctgcaaagccctttgtgcctctgccataatctattttaccttcttatctatcagtgtctcctctgcaatctttagtccaggcttatttctcacttcaactactgcaaaatattcattctccctagactccattcctccagaaccacctcccactcactcctctttacccttgatccgtgatgcacaatttgctagggggatatttctaagatgtacataagtttttgtcactcattttcttaaaatccgtcagtgactgtgaaaaaaaaaaaagtcctagttctttacatgttatcaaagttctttcttgacctgcccatgtctagaggaatttggcttcccaacaccctaactttagtcaaagcaaaccccttgcactcacttaatgtgccatctcatcctttctgtttccagatggccctatgtagagtgccatcagagagtaaacatcaggatggtgagaaggtaggaaccttttcaagtgctttgtcagaagataagacttgtaaataaacatgaaaaactactttggtacctgtaatgggttgaattgcctgaacgtctgtgtcactccaaaattcatatgttaaaatcctaaccctcaaggtgatgacattaggaggtgagcctttggggaggtgaacagatcatgaaggcagagccctaatgaatgggattagtgcctttataaaagaggcccacaggagttcttttgccccttccaccagctacttgggaagctgaggtgggaagataacctaagatatcctaagcccagggcgtcaaggcagcagtgagccatgatcacaccactgcacttcaacctgggtgacagagcgagactctttctcgaaaaaataaaataaataaaaaacaaaaaataaatgaacacctattaagtaacaacatcttgttaacaggcgtaatgaaaagatacaatccttgcccttaagaagttcataacctaacgggggaaatgttaaagcaagaggcattgttatacccatgttatatattctgagggagaggagtgttagattttatgtttgacggggtagtaagaaaggatatatagaagaggaagtggaggagaaaaaaaagatggtaagtacggtttgaacacattgtatgaagtggctatgaacattcaggtgacaatatccacaggaagctggataaaaaagtctggaactcatgaaagaggactgaggtagagatagtaatttgggatttatcagttacaggttaggacatggatgagattaactagaaaagaaaatgaggtagaaaacaaagcctgggaattatcaagttttaaggggcaagcagagaaagagaaatgctatgaagaaatcaaagatggggccaggcgcagtgactcaggcctgtaatcccaccacttatggaggctgaagtagaaggactgaggccaggagttcaagaccagcctgggcaacatagggggacccccatctctacaagaaaaatttaaaaattagccaggtctggtggcacatccttgtagtcctagctattctaatcccagctacttggaggctgaagcaggaggtctgcctgagcccaggagttcgaggttacagtgagccgtgattgtgccactgcactccagcttgagtgacagaccaagacccctttaaaaaaaaaaaaaaaggccaagaaggaagaatattttagagagaaatcagtcaacagttttatctcatctgtcgttaacaaatgctccaggaggttggttttcatctaaaatgatcttcctaacttgtcttctttggctgtttaagtctgagtgttctcaggtgaggactgaataaacacatttccttagcatgcttgaaggtgacaaccagcaaagagaagaagcagcttaaagaatgggctacaacttacctctttccctttggcttcaggaagtttactgaagtcttacaatatgactgtacttcagggcatagtggtaaatagcagctgcattgtccacaggaagaatgcaacatgccacttgcaagaggccatggatctcccccatggcatatgcttgcaaacacaggaagcaagttatcccttgatttccatctttagaagctcatgttattttatttcttggccatttcctgatacttaactgctaacttagtattctctgggaattcctctgagaagacttctctgatcaccctaatccaaagggcttgttccttaaagtcctgtggcaactattttcagttaaaagacttaattatttcttttgcaatcagttacttagggccgtgtaataccacttaatttttttaattttttatttgttttgagacggagtctcactcttgtcacccagctggaatgcagtggcgcgatctcggctcactgcaacctccacctcccgggttcaagtgattctcctctctcagcctcctgagtagctgggattacaggtgcccgccaccaagcccggataatttttgtacttttagtagagatgggggtttcgccatgttggccaggctggtctggaactcctgacctcaggtgatccactcgcctcagcctcccaaagtgctgggattacaggcgtgagccaccgcgcccggccacctaatatttttaagtgttcattccataaatctttgctgagtttttactaagtatcaggaggaattgatgctaagaattggtgatcagttcttgacctcaagagcaatctagcaaaggatttaaagcctgtaagtatgcaaggaaaatacacgtagaaagccaaaataataagaaaataagtggccaggaatggggtcttccctgaactgtttttctacctacatgcactagggatattaggcagagaagatactccaggtgaatgtctactcttaattcctaagacttgagactcaaacatctgcatggccttttaccttgataagccaagctgggccaaaagacgtctttagcagaagaggtttttaaccatttcaaaaggcaggtcaaacagtctgcaacttaaactttagcccctgggcccatattttttaatagacatctgaatttctccaagtgtaaggggaggtacaaaaatgaatatcagggctaggtgcagtggctcacgcctgcaatcccagcactttgggaggccagagcgggcagatcacctgaggtcaggagttcaagaccagcctggccaacatggtaaaaccctgtctctactaaaaatataaaagttagccagttatggtggtgggcacctgtaatcccagctacttgggaggctgaggcaggagaatcacttgaaccagggaggaggaggttgcagtaagccaagatcacaccactgcactccagcctgggtgacaagagcaagactccgtctcaaaaaacaaaaaaaaaaacaaacaaaaaaatgaatatgaaaagcccaaagcagttttctcaacctgacttttcattcccaagtttgttccaaatgacagagctcctgcctccagcatattagcccaattacagtgcttattcttctttgggcctgaagtcagacggcagccttcagcaactcctaaaggttggagtgagtgactaatatgtatcataagggacacagataaaatgtacaagaatttgagagagggaaatatttccagcattagaaacactggtttggatgtgagtcagagaaggctctgtgaagagcatgatatctgagattgatccaaagaatggataatatttggatatgtggaaactaaaaggaaaggatatttaaggcagaggatagaggatgggtaaagagatgaaagggagaaggaggaaggcgttggaaagaaaaggatattaacatttactgaatgctaacaacacaccatgccctgctctacatgtatgatattattaaacccttattcatccactgaggcaactatgatattcagagatgaaaaaattatgtttccaaagggctgggtaacttgcctaagcctaaggttacacaggccgtaagtggtggagaactcaggctctgttgagactataatttaattaccaatgtaaagaaaaattaatttttttgaggataaactttcattcacttctctattcactcactcactcactcatctgcaaagagtttagtgggtgccaggcatcagggatataaagtcagacattttctctactctgtattttaatgctatttttcatttagcttttatttaaactttttattgaatgataatatacattataattataacataaacaagtcaaaagtgtacttttacatccatgtaaacagaatctagatcaagaaaacaatataaccagaactccagaagcctcctgtgctcatatctaatcactacaaattccatcccccaaaggtaatcactatcctgatgtctgacaccacaggttactttttcctgtttttgaacttaatacaaaaagaatcatacaaaatatattattttaagaaatatataatcttgagggcaaatgctcacataattccaggacaatgtgattaacatcaaagttgattatatatgaaatgctatagaaagataaaagatgagactctaacttggcctgggcactttgggaaaggcttcaaagaatgtgacatccaagttgagcccttggtataaatggtagccatgactcgagctctatttcagaaagataaatctggcagtaatacataaaatggcttctaagaaaataaaagcaaggaaaccattagaagactaatactatagtctaagcaaataaagagaacccgaacacaaagggaaacagagaagagacagagactggtaaaagaaaccacaaagaaaagaagagcaagagctggcaaatgatctaagtgggaggcaagagagaaggaagaataaaaagtgacaccgtgattttgagtgggtgactagtagaatgatggtaactttaatataaatagagaacaaaggaaaaggaataggctcaagagggaagttttaaacattgggaaattatagtgaaaataactagtagataactagacaggaagaatagagcctaaggaaaaagggaaggtttagatttgggaacatctgcttacaaaggctagttgggaggctgggtgcagtggctcaagcctgtaaccctggcactttgggaggccgaggcgggtggattattggtgaatccccatctgtactaaaaatacaaaacaaattagccagacgtggtggctcatgcctgtagtcccagctacttgggaggctaaggcaggagaattgcttgatcctggtaggtggaggttgcagtgagctgagatcgcaccattgcactccagcctgggcaagagcaagactccgttcaaaaaaaaaaaaggctagttggaagcctactggttacctatcacagtaggtaggaccaagcacattaccttccatagagtagttgcttaattaaagattcttgattagaggctgaagagatgcagttttgagattaaaagtgatgcttgagggaagactgtagaaagaaatgaggcaggagctaaggaaggaagagaattgggagaatctaagaataatagaagaaaataggaaacgaaaaaagggagttttaaaaacactatggaatgctgcacagaaagtaagaatgaggaaaaagtgactgagagaaaaaagtatttaaatacttaactgttaattatttctacctcccctctggcctataagctcttggagaataggaaaatgtcttacaaatagtcccaacagtacccagcagtacccacttattaggggcttgatttaaaactgaaaaagtgctgggcacagtggcacatgcctgtaataccagcactttaggaggccaaggcaggcagatcgcttgaggccaggagttcaagaccagcctggccaagatggcgaaaccccatctctattaaaaatacaaatttagccgggtgtggtgatgcactcctgtaatcccagctacatgggaggctaaggcacaagaatcgcttgaatctggaggcagaggttgcagtcagccgagatcacgccactacactgcagcctgggtgacagagcgagaccttgtctcaaaaaacaaaagaaaacgaaaaaacaaaacaaaacaaaaaaccctgaataattacttaagttgcttcattttggataactttggcaaaaggatgttttttcacagaggaacagccagcaatgaatattctcattggttggatggtcaaataagcagcaggaatcagagaaggtggtggtaaagagtgagaaaggatgctttgcttattacttggaagcaagtaattttgtagaggaatctgacttattccataagagttaactatgtacctccctttattgatactatgcccagaaaatacctaccatttggagctaaggcccgcagccagtatctgatacccttttctctaactctggacaggttgatgacattatggcatcccttggaaatgttctatgtgctccttggaaaccagagccaaatccacccttccaaatgatccactgccccaaatctcagtccaggtgtgacatcctataattcaccaggctcagtcacagcccagaactagaaggtttatagaagatccaccattgatgaacatccagatccaggccataaatgtgtccagaatatttcagaggtaaaacaaacaaaaaacatccgtattgctactgacaagtgcatgaaagctgctctttgaaaatgttcccacattgcacaggtcagcctttggcttccgttgacttcttcctcttctttggtggtcccagagaagcactaacataccaaatagcctcattggagtcatccatagataagttaccctagcaaccctgttaccacaggggagacctggtggcctagatccctataacagcctgaaatcctatggcattggctcattgccacatcagccaaaaaaacagcagtgtcaatggatcctcacttagcagcaaaggttccagccatggtcagcaatgacctttgatgggtcattcagttgcctcaggtctaggctagaaaggtcatgacagatccctaaaagccaacagttctggaaagtactaggaggctggctagagacttttaagcaaatgcttgtagagctttgtactcaaaaatgcatttttctgtgatctcaccaaaatcctgtgagagagaacaagtcgctatccctaattttataactgagaagaacaacaaatatgaatttgttagttatttcagattttaagggtgagctaatacaaaaacccagttctcggcatttctatccagccctaaattttgttagtaacaatttaacagtaaacggatacaaaagacacaatattgtgaatgggctcttgggctctgtgtctaccagtctggaaaccctatttctctccaagtggacctcaggaaacaaatattgacaggcgagaaatactgaggcttgtgccaccctcttccctcttctgccatgggaggtatattagttttctagggctgccaaaacaaagtagaacagtctgggtggcttaaccaactaaaatttatttttgaccaggcgtggtgtaatcccagcactttgggaggccaaggggggcagattgtttgagcttgggagttcgagaccagcctgggcaacatagagaaaccccatctccacaaaaaatataaaaaattagctgggcatagtggcatgtacctgtggtcccagctactagggaggctgggatgggaggaccacttgagcctaggaggtggaggctgtagtgagccaagatcgcaccactgcactccagcctgggcaacagagtgagaccctatctcaaaaaaaaaaaaaatctcacaatgctggatattagaaatccaagatcaagatgccaagaaggttgatttctcccaaggcctctttccttggcttgtcaatggccatcttctctgccttcaaatggtctttcctctctgtgtctgtgtcctcatttcttcttcttccaaggacattagtcataatggagtaaagcccacccatatgacttcagtttatattaattacccacttaacgaccctatctccaaataatgtcacattctaagatacctggggttaggtatccaacccctggggaaggttaagacttcaacattatgaactttggggtgggaatgggaacaaactcagcccatgagaggaggaaaaggtgaaatcaggaactcagtggtatcagatatttaaaaggcaagggaagaaaggggacaattcggggctgggcgaggtggctcacgcatgtaatcccagcactttgggaggccgaggtgggcggatcacaaggtcaggagatcgagaccatcttagctaacacagtgaaaccccatctctactaaaaatacaaaaaaaaaattagccaggcatggtggcaggcgcctgtagtcccagctactcgggaggctgaggcaggagaatggcgtgaacccaggaggcggagcttgcagtgagcagagatcacactactgcactccagcctgggcgacagagccagactctgtcaaaaagaaaggaaagggaaagggaaggaaaagaaaggaaaagaaaagaaggaaaggaaggaacagaaggaagggaagaaagggaaggaagggaggaagaaagggaagggaaggaagggagggaggaaggaaggaaggaaggaaggaaggaaggaaggaaggaaggaaggaaggaaggaaggaaggaaggggacaattcagaaccagaagccaggcactctggttttttcctttcctttgtagggaaactttggaatacagtggaaggatcatctcagttggtggctttggagaatgagaactagaccagtctcagctttcatccctactctgggctgctgcttagcagatatggagaacagaagcaggagaaccacatgaatccttctggcagctctgctcttttcagtgtcaatagaggtgggagaggtggagggactttgctcatgtttaaaagaaaatttaggctgggcatggtggctcacgcctgtaatcccagcactttggtaggtcaaggtgggaggatcacctgaggtcaggaattcgagaccagcctggccaacacggtcaaaccccatctctactaaaaatacaaaaaaaattagctgggcatgttggcacatgcctgtagtcccagctactcgggaggctgaggcaggagaattgcttgaacctgggaggcagaggttgcagtgagctgagatcgagccactgcactacagcctgggcaacagagtgagactcagtctcgaaaaagaaaagaagaaaaagtaaaagaaaaagaaaagaaaatttgaagctttattcctaaagaaatcactgttgtcatctacttagcttcatcttttgaattcctttctactgacaactttagtttttacctaaatggttgaattccaaggacggagctagatgcgtatattagagaaacagaaaaggagggactgagaccatcaggatgctacatgagctggcagctccagaacatgctttcatggctgcaatgctccagaacatgctttcattgacggtaatggttaatattaggtgtcaacctgactggagggatgcctagatagatggctggggaagtattgtttctgggtgttgtgagggtgttgccacagaagatagaaatttgagttggtggactgggagaggaagacccaccctcaatgtgggtgggcacaatctaattggctgccagtgtagctagaacaaagcaggtggaagaaggtggaataaatttgcttgctgagttttctggctctcttttttcttcccatgtggacatttgcttcctcttctccggcccttgaacaggttatttgggacttgcaccaagaggcttcctggggtcccttaggtcttcagctgcagactgaaggctgtactgtcagcttccctggttttgaggcttttggacttggactgagcctctactggctcctctctttctccagcttgcagacagcctatcatgcatgggacttcaccttgtaatcatgtaagccaattctccttaataaagtcccttttatatatacatatatcctattggttctctcccactggagaaccctaataatacactgaccaactaggcaagctacttccacaccctagaaaaaacagctcctccttattgcttcagaggcttggctgctgtggccaatttccccagagataggcaagagaaagagaagaaaggttgcaagttagggcataattaaggcaaaacatggcaaattcaaaagaggtttgaaaaaattaaaaaggaacaggagtaggagaaaatatttgcaaatcatatgtttgataagggacttctatccaaaatatgtgaagaactcttacaactcaacaacaaaaagacaaataacccaatttaaaaatgagcggaggatttgaatagatattacggtagtccctccttagccactgttttgctttctgtggtttcagttacctgctgtacaatacaataaaatattttgagagatcatatttacatatctttaattacagtatatggttataattgttttattttattatgttgttaatctcttactgtgcctaatttataaattaaacattggctgggcacagtggttcacacctgcaatcccagtgcctcgggagaccaaggcataaggatcacttgagcccagaagttgaagaccagcctgggcaacacagctcttgtctctacaaaaaactaaaaaatagaaacttagccaggtgtggtggtgcatgcctatagtccaagctactcaggaagctgaggtagaaggactgcttgagcccaggattcaaggctgcagtgaaccactgcattccagcctgcaggacagagtgagatcctgtctctaaaattaacaaattaaaccttatcatatgtatgtataggaaaaaacatagtatatgtgaagtttggtactatccatggtttcaggtacccatttggggtctgggaatgtatcccctatgtttaagaggagactactaaactccaaagaagatataaaaatggccaataagcacatgaaaagatactcaacatcattagttactaaggaaatgcaaatcaaaatcacaagttagcacttcacacccactaggatggctataataaaaaaagacagacaataagtgttggcaaagatggggggaaaatgaaaccctcatacactgctgatgggaaggtaaaatagcacaaccactttaaaaaacagtctggcggtttctcaaaatgttaaacaacgttaccatatgacctagcggttccattcctaagtgcatacccaaaaaagctgaaaacttatgttcacacaagaacttgtacatgaatgttcacagctgcattattcataatagccaaaagtaacgatccatgctacaacatggatgaaccttaagaacattaagctaaataaaagaatccagacacagtaggccacatatgataggaatccattggtatgaaatgtccagacaaatctacagaaagtaaattcatggttgctacaggctggtggaaaagggaatagggagtaatccctaatgggtatgggatttccttttgaggtgatgaaaatgttctggaattaggtagtggtgatggttgtgtgatctagtgactatattaaataccacttaattgtatactttaagatggctttatgttatattaattatatctgaatttaaaaatatttgttactaaaaacaaaggaacaagaatttgttgtcaagccactgaggggaaatggtatgaaagtagggctgaatgagaaggctgcaagagtacaacggcagtgtatccttgtctctatgtcacttagaatagtaaaaggaagtggaggcaagctgtgtaagcagagggaagagccatgggtagctggtaaaagataaaatttggaaataaaaaaaattttttttctcaaccaaaagtgagaataggcgagaatgggtatggacctctccttttctagagatttttaggcaagaaaacccccctcattcctcttcacaactcaactgcccagaatgcaaaaggacaagcttccttactctacatcctgttcattcatcctgccaacagatatttatggagtactttttatgtgcataagatagttacctcatccttctctccctctgaggataagtgaaactccagctcctcattcttctacatcttaaaaagaatgtcttcgctttctcttatctctcaggagcccaatcacatctagtgggttcagggttgatttgggaagcatgggaacaaaatgcaggacgtaaaacaggttttagagaggtgatgtcttttgattgggacaagctgaatttgagatgctgatgggacaagtgagtgtccaagaagtagttagaaatatgggtttagggtctgggctggataagagagcaacccacatataggtgataggtgacataataaatgatatttcaaaagaaaaatgtatagatttatatgaaaagagcattgaggaaagaactctggaaagaacaacatttaagaaatgagcaaacagagaaatcagaaaagagactgaagacagatcaaagaggagagttggagatggtttcttagatgtcaaaacaggagggactgtgcagaagtgtcaaatactgcaaagaggtccaataagataaacactgaaaagcaaccactaagttatcagttaggagctcactgatgaccttcacaaatacagttttaatgaaatgacaatgggatctctgacgcagacttttctcaagtatattccttggaaaactagtcccacagaatgtgtctctaaaagagtgtttcatggtcaaataagtctgcaataaagctgtgcatattatattcccttcttaaagaatcacaataagcctaagtatactgaagtttctgagaagtcctaagatataaggcaatctattggctttgtgctctgttgaattctgtgtttcccaaatttctttgacatagaaccgtgtataatatgatacctattaatgactctagaaactggagtcctgtggaacatgctttggaaagtagggttctaagattagtgttaaaaagacaagctctgaagttaaatagatctagatttgaatcctggtcctaaatcttactagctgggtgatcctgaacaagtttctatctttctaaacactcagttgcttaatcaataaagtgggcctaataacataagcctaattcacagaattattattatgaattcattaggtaatgcatgtaaagatatagtgcctacacatagtagtattcaataaatgtggttactataatgatattattattatggcaagagttgagattaaaaaggaaaactgtgatgcaggtactaaaattttcaatgaataaatggggaattatgggaaagttgtaatctaattgcaacaaggaaggtggctgtagaaacaggttaggcaaggatctagtaatggcttggaagtggcagaggaagccagagaaaaccaaacctcacttctgacccagtaatgcatggggcatataaaaggcatagtctctaccaaagagggcttcaaggaacagccaggtccagtcaaggtcagaaggtagagaatatgttggttctggtctcagatatcaggtaaaggcactgcagtttctcagaaggcgaaaacagtctgttgagaacaagggttgtctcacagcattcagaggagcagctagggccagggaaggtcactctggtttgtgaagcaatagtaaggcctgttcttgggtagggcttaccatgaagtttgaagaggggtctcaaaagctgtggctaagataagtcttgaagtattcaggcttatgtacaggatttgcattgcaactacattagaaacaacctaaagatccatcaatgggggcagagtatataaattataacacatctacagaaagaaatactatataactatttacaaagcagtagccctatttatactaacagaaaaactatgcagctgttaatagagtatgaactctatttatactaataaggaaaaaaatctccgagatagagcaataaatgaaaaaagcaaggtgtaggacaatgtgtgtaatacacacatacaagttttggggcacacacatgctcataaatggatggattaactctggactgatccatgagacacaaataataagatgggggaaaaggagatgagggggcctgggaatctgaagtaggaaaactgtgcattatatatttataaatatatatctatatataatatccttttcaattttatattttacatttattacttattcaaaacattcttcagttttttttagaaatgttagaatggcaatggttagggagagggatgaaaagttgtgagaaaaaggagggatcggaaattggtagtctccatgagggcaaagagttgagaagttaagataggcagacatgatcagaaaaaattccagagtttaagattatggaaagagtatttccctggtgcaaagtctgaatggtgcagttctcaaaagccctctccttaagcctcattatttttcccctagggacccatttttgaggcttcaattatagaacaagaaggaagtcacttttcttgggagggagtaacaagtgagaacggaactttgcagaagagtttcgattcgttctctgtcttaatgatcgcccctaagaaaatgctgatctacctctcaggctggcagctgtaatcctacctctcctgagactgctccatttaaacccaggccttctcatctatttgctgttctgtctctgcttaccaaggctctccttcctcagctttcttcaacaacccaagagctcctgtcaagccttcttcctggcctatctccatgccttctcctgaactgtcccttccacctggaacacccacccacccgctgccaccgcaatctccgtttctagagctaaagtctcacctcctcccccagatttttctgcagctaagccaaataaggtacagattcatatccactcccacccacactaccaacattactgcctcatcagcaatagcaatgtcatcaaacacttattaagtacatatggccatgtactcagccagcccagaagacacagagatgactctatataacctcttccctcaagtgactgacaatcttataggaatagcataagtgtaactaggtttctatgattctcaaagtctctttgatgtaatattagctgaagaagtataagtgacctataaacttatgagatatattcaaatcacagataatcaaagaaatgcaaattaaacaatggtataccattcttctgtcaaattggcaaaaattttctaaaataagaatacttaatgttggtacagcacactcaaatactgaaagtacaaaccggaaaagcttttctgaaaataaattaagaagtttgacagaagtcttaaaatatatatatacccctgaagccgagtgtgatggctcataccagtaatcatggcattgcaggaggcccagacaggacgatcacctgaggctaagagttcaagaccagcctaggcaatgtagtgagacctggtctctattttaaaaaataaaattaaaaataaaaaataaaatttaaatttaaaaacttatacccttcaactcagtaatttaatctattttaagttaaagaaataatcagaaatgaaaacagatgtatgcacaatgatgctcatcacagcgttattcataatagtaacaagaggagccaggtatgagggctcatgcctgtaatcccagcattttgggaggttgagacaggaaaattgcttgagcccaggagttcaagatcaggctgggcaacataggaagactccatctctacaagaaataaatcagccgggcatggtggcacacgcctgtagtcccagctacttgggaggctgaggtgggaggatcacttgagcctggaaggtcaaggctgcagtgagctgtgcttgtaccactgcactccagcccaggcaagacgctgtctcaaaagaaaagaagaaaaaagaaaagaaagaaacaagaggaatattataaaatacctatataagagaatattaatctattaagtcattaaatcatgttttcaaaaatatttaataacccagaataaagttcacaaaaacaaagtgagaaaaaaaatgtttaaatccacacatattatgatctaaattcagtaaatttatgttcatgtatataaagcttatataagaaaatatagctaatgttaatagttaatattctgctattattgactttaagtgctgggccttgggaataattaaaaatagtattaattagaagataaagaagcacatggagacttctgtggaaataatgcggggcatctctggctggttaagcatccacaaaaggttagctaaacacactttgccagattccatactgggctcttgaatatcagccttaaaaagcttagcctgacattaaaggatcttacaagaagtacacagaaaagtaagacatagcagtaaacaagtaactccattacatcatcatgcagtagaaaaaaatatgcaaagagtctagaaactttaccccaaaactgacagctgactgggttttaaaagatgtgaatgaaaagttagctaagtgaattaagagaaagagcattctaagcatgggaaacagcaaatataaagtctctgagaatttttgaaatataaataattctatatgttggaagcatttcacctaaacaggatagcaaaaagagcctagcagataagtgaaaatccaaaagtttgatacattactgatgggttaggaaagagaaaaccactcttaagacattactagtgggagtataaattggtacactccctatgggaagcatatacttttgggggtaggcattaaagccattgacaaatatccttctctatctctttaaaagtatgtcatactgctccactttaattaaaacagagctagcattcaacccagcaatcccattactgggtatataatgaaaagaaaacaaattgttctaccaaaaaaacacataccctcatatattcatcgcagcattattcacaatagcagagacatcaaatcaacctaggtacccatcaacagtggactggataaagaaaatgtggtacatatgcatcatggaatactatgcagccataaaaaacagtgaaatgtcctttgcaacaacatggatgcagttggaggccataattttaagcaaattaatgcaggaacagaaaaccatatattgcatattctcatttataaatgggagctaggggccaggcctataatcatgcctgtaatcccagcactttgggagtctgagacaagaggattgcttgaggccaggagttcaagaccagcctaggaaacataatgagaccctatctctacacaagaattttttaatttgctgggcataagtggcacatgcctgtggtcccagctacttgggaggctgaggtgaagggttgcttgagcccaggagttaaggttgcagtgagctgtgatcatgcccgtgcactccagcctgggtgacagagtgagaccccatctcaaaaaaataaaattaaaaaaaaaagttttaaaaaatgagtggcatctaaacattgggtactcataaatatgggaacaatagacactgtagactactagagggaggaaggaggaagatggcagggattgaaaaactacctgagtactatgttcactacatgggtgacaggatctataccccaaatctcagcatcatgcaaaatacctatgtaacaaacctgcacaggtatcccctgtatctaattttttttttttttttttttttttttttttttttgagatagggtctcactctgtcacctaggttggagtgcagtggcatgagcttggcccactgcaacctctgcttcccgggttcaggcaattctcctgcctcagcctcccaagtagctgggattacaggtatgcaccaccacacccggctaatttttgtatttttggtaaggatgagggtttcaccatgttggccaggctggtctcaaactcctgctgggattacaggcataagccactgcactcagccctctgtatctaaaatattaatagaagttgaaattatttttaaaaagttaagtttggtttcatgatttcctttagctaggaaaatatgagcaaaagcaacatatgtattaataacttctgggtagaagttttaagagccaaagtacaacttgctatattttctttcacttgttatctttcccttccttttaccattgtgactggcagtgttccaggtgttggttgctccatcagcctggattgcagagagaagacaactttaaagcaaaactccttgatgtggaatacgagcaagaaacaagcccttgttattttaagccatagacaaatggatggcaatttggcaatatttatcaaaattataaatgcatatccccttggtatacctgcacacatgcaaaatgacatatgtacaaggttattcatttgtaacatggttaacagcaaatgactggaaacaaccaaatgaacatcaacaaaggactaaatacttgcagaacaaatatttcattcaatggaatattacgcagctataaaaaagaatgaaaaattttcttagagctgatatggaaggatctccaaatacaaaatcaagaaatgcttggtatgtataatataccatcttttgtataaaaacgggtaaagaagcattagtatattcatatttgcttgtacttgtagacagatattctagaacgataaataggaaactaacaagattatcttgagtggagggtgaaggagtgattggggtggcggggcggcagcggggcaaaaaaatccttggtgttgtgcttaacttctttctctcacataacttcaaccaatatgttactaaatctcatcttaagtacaaatggtacatttctgcttcaatcttaaactgttatcagaaccctctttaaactctggcttcttgttctcctcttggacatttctaatcagttgccagttactttacctgtgttaagaatatctttactattgttctcttattcaattaagttcttagttactcttaggtaaaccatgcctctgtctgtatgattccaagctttggcaactgttttcagctagtctttttgagagactgaattattatacttctgaaaaagaaaaggccataacttaaactgtgtcttctccaatatattcttatttttctaattcagagctttccttttacatggataaggctaattactttgctttgctttataggaagaattacaagacccttacttttaaaaaacttagaaataaaaaatcagtaagtattatgacattcattccataaatgttcattttaaatgcttgtttaggccaggcgtggtggctcatgcctgtaatcccagcattttgggaggctgagccaggtggatcacttgaggtcaggagtttgagaccagcctggccaacatggtaaaaccccatctctactaaaaattaaaaaaaaaaaaaaaaaaaattagccaggcatggtggcccacgcctgtagtcccagctactagggaggctgagacatgagaactgcttgaacctgggaggcggagattacaatcagccgagatcataccactgcattccagcctgggcaacagagtgaggctctgtcttaaaaaaaaaaaaaaaaaaaaaagcttctttagccagatgcagtggctcacgcctataatcccagcactttaggaggctgagataggaggatcgcttgagctcagaagttcagaagttcaagaccagcctgggcaacacagtgaaattccatctctacaaagcattaaaaaaaatcagctgggtgtggtagtgcgtacctatagtcctagctacaagggaggctgaggtgggaggatcacttgagcccaggaggttgacgctgcagtgagctatgatcatgccactgcactccagcctaagcgacagagtaagaccctgtctcaataaataaataaacaaacatttgtttgcctcacgtcagtctatatcaacagactcccagtgtttgcagttaggcagccctatccatggaaaatttttttagcatgaacctctcaacatatgtacgcttattcatttaaaaattatatagatgtataactgcattaatatatattataaaaattaaaatgtgaaaagcataacaaatttaaaagttttttaatgtttattaacaaaaatttttttgctgtaactaaaaatattcacagtgatacttttttttaaaacaatgtgatataatgtgcctaattgtttcctaaatcttattttaatattttgttatagaatgactttaaggtctgattgtacattcaattacttcaatacatggttttcatagctgtcacagccgaaaaagataatgatatatcaaatctaatgaaagaagagcaattggttccaacatactaattattcagagattttgttaaactttggctagtaatttttcctcttctctgatgtcagtcagccgttcttgcaaaattgtgagaaatattttcatatttttaacaagtaagttcaaaactcattgaaaatcttcattagaaatatttttaatatgttaatagtctctttccaagattttagagcatgcaattatgagtttttatcagtaacattgtttctgataaaagaacacacacacgcacatctatatacaaataatagcattttcaaatatctgtattcacaataccttttccaagcagctatcttttcaataattactaaaacattatcttctccctgaagggtcaaattaagagtgctcatatgaagccagaacgatttgagcaccaaaataaatgacaataatggattataactcatgtaataaattagaaatgtaagagtcataatgcaatattgacataaataaattaatgagagaaaagggaaatctcttcctaaaaatagagtgccaactaattaattaatatagaaagaataatagaaacagaaagttaccaattggcaaccatcattagtggtggtagattcagataggagacggctacttagctggtaggtagagatttgataaggaacaaaataccagcatatcctcagagtactgcaccacaaggcacttaacaattacagagggaagaaatggtaccttgacagtggagaaacctggccaatgcaaacttaaccaagtcatcaaggctgacattataaatggtaggacatgttgacatcaggtactttctgacgcaatgctctgaaaagagcacagcatcattttttttgtgtaattcctgccatgaaaggatggcctcagtccggacatgaggaaacactgaatggacccaaactgaagaacatgctacaaaatgaaaagcctataccatttaaaactgctaaggatgggaaacaccgaacgaagctaaagagatatcacgactaaatgcaacatgtcattctggattggattctggattagaaaggaaaaagagacattgttgggatggttggcaaaatatggatagggtcttgataatagtgttgttattgttgtttggcagatttgaatggttatatcatggttatacagaactgtagccttgtttatagggaaatacaaaggaagatttaggaatgacagaatatcatgtctccaattttctctcaaatgattcagaaaaagattgatcataatggagggaaggcaatgaagtaaatgtgaaatgtgaatagttggagcatctgggtgaggagacatagtagttctttactgtttttgcaacttttccttaagtttgaaattgcttcaaaataaattaatttttaaagtatatgtgcacatatgtgagcatgattgtgcttttaatatctgccagatattatactactgacagccaattgtcattaaacatgtaacttcaataaatcattatatcaaaaagatacctgcacccatatgtttattgcagcactattcacagtagcaaaaatattatgggctgagtatagtggctcacacctgtactctcagcactttggaaggccaaagtgggaggatcacttcaggccaggagttcaagaccagcctgggcaatacagcaagaccctgcatctacaaaaaaaaaaaaaaaaaattttttttaaattagccaggcatggtggtgcatgcctgtagaccctgctactaaagaggcacaggtaggaggattgcttgagcctaggagttcaaagctgcaatgatcacaccactgcactccagctgggcaaaggagcaagacctgaactcaaaaaaaaaaaaaaaaaaaaaaaaaaaagatacggaatcaacctaagtgtccatcaacagatgtttggcttttaaaaatgtggtgtatatatatatatatacacaccatgggatactgcatggtctcacttataagtgggagctaaataatgtgtacgcatggatttagagtgtggaataatagacactggagacttagaagggtggaagcgggtaaggaaagagaaataacttaatgggtataatgtacactattcagatgatggctacacccaaagcccagacttcaccactatgcaacatatccatgtatcaaaactgcacgggtacctcctaaatttatatggaaaaaaaagtaccttctgcctaaagactgcctacctcctaacacacagataaagacacttcaaacttgtaacactgaaaatgaaaaatatttatctttgtttttacatttttttgacgttgtttcagatcttagtgtgctgatactttgggacttaaactggcaaattccatagatatttttgtaccctgttttggccctacagatgagccagtatggaccggctaggtaagggagacaactatcctcaggggcttgaaatcatttcttgccctaaactcgccctaaactcaaacggcttcaaagagacaatgaacagtacttgaaaataagcatctaactttacagtcaggctctcagcccactaggtctatttgatttccattaatcagcacagaagaaagccactggccacttcccatcccttaaagctctggcttaattgtcatgcattcccagaagcacactgtaagaagatgactaatcactgattgcttctccagcaccatatgtctcccaatttcaaaggaaaaattgtcccaaccagtactagaacagatttcctacctcctgcagctggagtcgaaccttggtaactgctcggatccaatgtgctctggcttgggtaaatggtgaagatgcattctcctcaggaaaacttgtaacagagaaaaagtacatttcttaaaaatagccaaggccacaaggtgacactgctcaaggcaagactgccaaatgtctaaaataaaatggtttgtactcatgcctacacttatttagtgattcaggctactaaaacagcatagtacttgaatatccaatgtgaaaacaattcctctctaaaacgataactccttttagcttctcatctgttccctcttttatttatttatttatttatttatttatttatttatttatttatttattttgagacagggtctcaccctgttgcctcggctgaagtgctgtggcatgatcacggctcactgcagccttaatctcctgggctcaggcaatcctcccacctcagccttccaaatagctgggactacaggtgcgtgccaccacacccagctaatttctgtactttttgtagagacgatgtttcgccatgttgcccaggcttgtcttgaactcctgagcacaagcaatctgctcacctcggcctcccaaagtgctgggattacaggcgtgagccactgcgcctcatctgttccttcttttccttctttttcatttacccaatgagcagcatagtactgaatactcaatgtgaaaataattcatctctaaaatgacaattccttttagcttttcatctgttccctcttttcctactcgtttttgtcatttacccaatgtggtagctccctggaacagtctgggatcaggactctagaggcaatggcgagagccctgagtcaatacgtagtatagaaaccatgcagagaggggtggaataagcctttcaacccctctcactgcacttcttaaaacgatcagttcccttggggcttttgcatagcatccttagggcagaattttgttcctgcaaacccttcctgctccactaagtattttagaaggcttacccattcctttttacatgaaaagtgccaagaaagaaaagaaaaaaaacacacagcccttttactgccatgatctggttccttgagctgcttctagaacaacctcagtaaaatgaacaatacacataacaaaatacctttgagacagaaacactaccctgcattagaacaactcattatccacattattaactagaatagtggttaattcttggcaacaatgtttctcctttctctctttgaggtctacagccaattcagcagacaagtgtccaccatctagacatgttaaaatatatggtcgtttctgatgccaactaaatgtgtcaactgttgtaaaacatttgtgggcacttctggccaaggtagaactgggtttcactctcacagctaggacctgagaggacacaaccagtagagaaggacaaggacttgtgctgggcacttctgcttctccaccaggaactctgccctgataacagtgactgccaagtctaaggtctatggagagccagagtcagtttttcagtgagtcatcaacccaataagaagcctggtccacagctcacctcctggatgtcccatctattagatgagctaccagagatgaccaaaaaccaaaaaagggaagaagagagaaaataagttaatatcttcagaaaggtttgcgactcatctattaatccagtggtaaagtagaagcaccagtcactccctaatttttaccatgtaatctgcattcagtgctctggtgtttcagtgagaggctttattattagatcttgaaatttgaaactctaagtcacacccatcccttatcactctaccccagtgggcaactgtccccgccaggggaaatctgtcaggagacagttttaattgtcacaactgagggttgcaaggattgctactggcatctagtgtgtagaggccagtgatgctattaaacatcctataatatacacaacaaagaataatctggcccaaaatgtcacgagtgccgagactgagaactctggctctgctccaacctatcagctagtctaaccgatttagctcagtaataacattcagactctgtactcagcttcattatgagatgttaaagaggatacattttaaatttttcttcctatggataccaattggcagacacattgctaggccctgaggaggctgaggggtgggttaaatctgacttctagatcaattctttcttaactctgtcctgggtttctcagccagggaaaaacaaaacaaaatgttcaccaaaaaagttacaacagaaatcactgttattttccaatgggattttccctaagttcctcctaattgcctggtattttcaggctgatttctgatcctctagcccataccagcagaataggtaccaggtcactgttctgagtacttcaacacacatacacatatacctgtacataagtacatgcacacacactgaccctgaccaacccctttgaacaagtttgggccagaggtcaaagtagcattcttaataggttaggaagtcagccaaagtacctaccacagccccagtggatgaaataacctggctcaagtcagttcctgactcagaggctgccatatacaaggtcaactagtaagctatgaactgcagactcaagaagccctggtacactgcagctcactaactacaaagaacccaagtgctggctgggtgcagtggcacaccgctgtaatcccagcactttgggagtctgaggcaggtggattgcttgagctcaggagttcaagaccagcctgggcaacatggtgaaaccttgtctctataaacatacaattagccaggtgtggtggtgcacacctagtagtcccagctactcaggaagctgaggtgggagaattgcttgagaccaggctgttgaggctgcagtgagccaagatcgtgccagcctggacaacagagtgagaccctatctcaaaagcaaacaaacaaaaacccaaatattcttcagagatctccaaaatgtcttggaaagtgcaccataaatcaaaggaagcaatacagagttgagcctggaggtgttaactaccaccatacccagctgcagggaaacaaatgacaatcacttattttcagcaataccacagggcaggtactgaggaagccatgtgagctcctcaaggcagctgttgcctacctctcctggggacctaggaagtggtctttttgcagcaccagatctgggggagggtgggttgtggcatcttctttcatctccttgggttcacatgctgcctccttctctgcttgacctgtcacctccaagggtttctcttgttctccaaaacctgcttggccatctctggacaggctgtgagagctgtggcaagaatgaatcgagtccgtctcccgatggtcgtcatcttgttcgtgatactggtctagttcacttagctgagagcttccttgactcacattacaggaggagccatacctactgctgctggtggggctgtgagaatgacagaaagacagataagtaaataaatgcaatcagggaccaggacaaaagaaaggagacatccaggaaataatgactacattagtagcaagaatcaaataggaggttcctgggaagagaggaccaaacttcataatctagaagaattagtctctattcagcgaaaacacaacaggaaaacaacacaacatgctgggttctccaacgacacttaacctcagttctgcacttgactttgaagtatattttatcttaataggctatttgtgagtaggattaaaaattattaaaatggcctgttacttattcctaaaattctttattcagtcttctaaagaagcttgtccagtggctgtgattaatctttctttaatttccacacagtaaaatggaatgaatgaactccactctttttctattacttattacattgaggtcatcatttcttcctctacaattgtaaatgtgtacgcctgtaccttaggatgagcaaaggagagcagacatgttctttcagttatcatctcagtttcctcatctgcaagatgagttaatagaacccattggaagatagaggccaggaccaagagaatacacaaacgaatggtctcatcaacataaatgctacaatgatatccctggcagcataggaagcgtcccaaagatgaacatctgtaactgagcttctttcagggcaaggctcagttttggaaagagtggacaaagtccaactccaggatctgggtcagagccgtattcatgcatctctatatctgaagaccagcaagccaatcttttctcaatcacctgtattcccatatccagaaagtcatgagagaaagcagttatagcagagaatgtgacagtggcaagaagggcagagtggtggaaagaagagcagtatctagaagttacttccttgagttttatggccctgtcatctaagggcttcagttcttttgaagaattttcttaccacagagtcaagcctttaactaaagggcttgtgtttacccttggtcaaagaagagaaatcactgttattttccaatgggattttccctaaagttcctcctaattacctggtattttcaggctgatttctgatcctctagcccatgccagcagaataggtaccaggtcactgttctgagtagttcaacacacaaacacatatacttgtacataagtatacacacacacacacacacacacacacacacacacacacacactgaccctgaccaacccctttgaacaagtttgggccagaggtcaaggtagcattcttaatctgtactgtatggtactgcttcttaggggaaataacagtaccctctgcagatagatcctgtacactgctcgagactgaagaactacagcaaaggacagctctgagttcctgtgagattttactcaaagcatttatcagacatcagccttgagggtagtaaaaggcagagatgataccatggaagaaactatgcaaatctgtatggaataggatatgggaatacagactatcccaaggcatcctttgcactttgtattttgcttaatacactcattgccactggagaaagcatcttagaagacttgaaaaaacaaagcaaaatagatctatccccatctcctacaagatataagtgcctaaggcccaaggaagcatcctagcctatcatgtagttgtagttaatatataccaccaactacttactacctcttcctgccctcctttctccatttcacattatacaaggcagagcaaaccagagtgagtaaatatcgggggcccagcttttgctttaagcaggaagctccttgttccagtaaatgaattacatttggcagagagagaaggggaggatgaaaatacccacacactgagttcttgttatttaacccctaattaacatgaagctcgggtactaggaaagacacaagaaggataaaaagcaagctatgattaatctaccactaagtcacttgcatcataaatggtcaattccttaaagccatttatgatgcttgagttaagaacaggccttttgttggtcatgggctccttgatgtcattcagagtgactggctgctgtacattcaaatcagagtcagtactggcaggtactgcctcctcttcttgtttttctagctggtgaaatatctcagagacagtggagggttcttcctcatgtttccctgaaggacaggcggggctagacaggttggctttggtatcccagtgttctccagatgctgagatttcctgctggtttcccccttctccagaccctgaaagcccctgagcacagacctctggactggccaccagctgctcagaggtcccagagggctgagtgtagactttacctggctgagcactggccccagatatttgagaagacttcaaagctttgttagcctcactggagttaaggtcctgatcactgctagtaactaaaactggaggggaggattctgtaggcatttgttcagggacccctttgttctcttttggccatggaaatgaaagatctacctttccaaatcctagttttgaatcacttgctaatacactccctttcccctcactacttccctcaaatagagttgacaacttcttaaaactggacattaaaccagtctctgctgctctattgccagaggggagaggtgaggaaaagaaagagctcagtggtttcccatggttagtagcagaggatggcaaacgaagctttggccaagtggtcacatttgggatctcaaaacgtggtcttgactgctctgtttcctggggtactacaggtggatctttctgggcatgaattatctcacaactttctctggcagcaagcacagggtcctccagcagaggatgagaaaagtgcccttcggtttccagagtggtgctctggctcacacttgcatcattgaacagcatagtatcagtttctagtgaactggctggatgcagctccagtaagtcttggtttgtggaggcagtttgaatagctggctctggctcaagaggaagaggtggctgaatgggaggaggaagctcttcggcaatgcaggtaggatctggatgcaactgtgctggcagcgcaaagttctctgcttctaacgatgcctccgtgtctgtagcttgcaatatccccatgtctccttcatcactcagagacaatactccttgcccagtatcatcacccgagaaagaagatgtattaattgtttcagaacgttgaggttccagaatattttcaggagtattattgtcttccattttggttgttagtttaggatcatctgtcaagatatctgattctggctttgcactaaccacagtcattctacagtcactgagagtagattctgaacttagtgctgtaaaggcagcttctctcctttctggaggtactgatcctacagcatctctggaacaaccattttgaagccatgaagtagctgggagagatgattcttgtttgtatggctctggcttgggacttttgaaaattccaaataattcacctttgaggggctgagatgatacatcagaagcaagagagaaaaaggagtttttctttggagatttaggagaggagaaaagtccagagagtgttttgggaggttcaattaagctcccagagaaagatttcactttggtcacaaaccctgaaagcatgtctactgaagagcctaatgcaaatttgtcttcctctttatctgcatcttggttctgaaggttccctgcacaccctggctctggagaggaagaggctggctctaggatctgtggtaagacctcatcgggggccttttctaatggcaagttcactgggtcagtagtaaatttctcattttggtggcagttagtacaagtgtctaaatcattgaatttttcaattaactgtttagcatgtgaaaaagagttggacagtgagtcactggggaaggctttgtggttgaaagcctcttcttcatggggagctatcccaaggttctctgggccagtgaggaatgtttcagcctgtgcctgaaattctggtgaaggaggaataatgtctttttgcaattcattcatctggaaatccactgatgtccctggtacaatattggaactcagtttttcctgacagtccttgtctacactgagctcatctgcaagggaggtaacctcaatggtgttgttaatggaaatacaaggtgccatttgctgttcatgaactacttcttgggctatgctatctctatgaccactggaactttctctggtcattgtgctaccactctctacaaaaacatttgtcttcttacagggctgggaggtcactggaacaacagttgaaatgctttgtttttccccagaggtctcctttttttgatccaaaaaggacaagctgaagaaactaaaagtagaactactatgagaggcatccttcttaatgcttgagctagcagtggaaaaaaatgaaggaagtgtgaatagcccttctgcctgagatttggctcttggtagagtagcagaggctctgttctcagatttttcagatccagtgagaaaagaaaatatactctttttggttgataactctggttgagatgaagatgttgcagccatagagaaactccagtctttgtcagaaaaatgatcttgttcatttgaatttctcttgctcagggtatcaaaggatatttcattactttttgaaacttctgtcactgtagtcacaccactagtttctactgaagactccctggaagactctttgagactacttgttgaaaaagatgaattaggtgactgctggattagatggtctctgaatggtacctctttttcagtcaaatcattaccctggatccctctagttgattcctctaacctactgtcatcgatagtagtctgtttgttcagtcttctaactctagccttccctttagaggaaattggtgcagcaggaaagttcccagcaccctggctagctagctccataggagtaggacttgacctgacctcatccttaatagtcattgaagaaacagacgtattttcagttgtctgtataggagatacattggctttaaagaaatccccaagggtaccccaaaaatttgaaacaccagaagattctttcttttcttgaggtggtatcttgacatttgtatcaccaatcttttctaagtttggtgatccttctttattcacctgagtcttaaaaagattcaaaaatccagatgactgtttttcatttgctgtcatactaactgacgattcttcttgactgaagagtttcaatgaacttttaaataatgttttatcagactctttggatgactggccctggggaagctcataattctcacgctcatccccactatgctgaggtgcaggagaaactgaaatagagtctgttgtaatgatttcatcatcttttacacctgatttagcctgaggagttgtttggcttacctggaaaccagattttaacaaactttgctttttcacatggttgtttttatttaaagagaattcttgccttatatttttgatcaattctggatgctgaacattggatactatctgtctttctgaatccttaagaagacttttttccacatttggggagttaccctctaattgcttactcatgattaatgactgaaagccatcatttgtgagctctgctaaatctgactgctgattcactttctgcatggccaaagcctctaaggattcactcttatcaaacttcaaagtactaccaactgaggcacccaaaacagaaaatactgaagccactttgttcactaatgatgtctcttctgcttgttgtgagcctttagtcatattttcaggatgaaccaaagtggtaacttcttcaacagaagactgaagccaatggaaactggaaaggtgaactgatgaatcttcagctagaggctggtttttatctctctctataatttgatctctgcttgagacatgattactaatagtttggggctgatttctgagatctaatgtacattcagcgtcttcagaaccacacggcctttctttgaaagatctaaagtctcctttaaacttttgacgattatagcctgaaaaatctagtggctgatcgctttggtcacaacttgactctttaagtacttgtgaaaaggtttctaaatttagatacaatggttcctcacttcttggcaaagctaaagataaatcaagagggtcatcaattggttcctcttcaacataccaaaatatttcatcttccttatcaagtactttaaaactacaggcagaaataatgctgtcatccaacgtaatacttgatagaccatttgtctgtaaatcacaatccaaatactcttgataagaatcaggtataaataaatatgcatactgcccagtagaatcagtgagaagagaatagatatattgaccatcatgaaacatataatatccataatccccatcctctgatggccaccacactccatgttcaagacatgacaaccattcctggtactcataaccaaaacttgaaaaaacaaagttttcatccattcttaatgattcttgatcaactacggggcatgtagtcttttcatgatctgatgaagaacttaagtcaatgggtaattcttctagtgaattattagcctcattaattggaagaggaccagagtttccatataatgagttagctgcccacacatcacctcttaataagtaatcttcattaaatgctaactgattgaatgattcatatggtaagtcacaccaaatgacactgtttggatttgttctccactccaagatgtttgcattttgatctttttggcaaaaatttatcactgagttttctgagtcaagccacaagcaagcatcggctgatagaaatctattttgatttaacatataataaactggctgaagttttctggaatttttagacaaatcttttatgtcagagtcccattcaaaacagaaaggactgttcatctcttcaaaagcctgatagttgtttgatttattgagaatgttggtatttagtacaggtgaatttaacttgtttgaattttcatgtagttttgcctcaagaacatggtttggcatttgcctcttagccatagatttctccaaaaaacctagctgagcacttggagcacagtgaagtacaatgttctcagaggaggggtgatgcttttcactttgctggtttttctctgtaggggaacaataatgattatcatccccagcatcagataatggtatgttttctttaggtaataaggaggcttctatgaagctagaagtttcatgtttttcaacatggttcttcgggttctcagaagtcacacatgaagtagcagggacctcatccaaggataaatggttatctccattcaaactcttcatgttgcctaaagacatgaactttgcttcctctggtttatgatcaatcataccgctatttgatagcaggttaaatattccagagattaaacctggggtattattcttgtgatgggagtcatcatttttcaaatttaattcttgactagacaaattttcagcagaagaaaacctattaaacaggccagaaaggaagcttccttgggtatttttcttggaagtcttatctataacctcatcttcattaatttcattaaccaaagtggatttggaagtggtagaaatacactctaatgaagagtctgatgctactgaagatgctgcttgtataagattcttatcttctcctaaaggatctgaagttatatgttctttgggcacaactccagggatggctaagccatccctttcaaaattctgtcctgctgtgtggtcacttggatttaattcctctatattcccaaatttccccagatcattattaatatttgtaactgaatcagactttattatattaaatttggcatcttcaggactatttatttggtcattctgattaaattcctctgtactgtcaaatttccctagattatcctgagtatttggagctgaaccagattttattgaactaagtttggcatcttcaggacaatttacttggtcattcttattaaattcctttatactgtcaaacttctctagatcatcatgaatatttggaactgaactagattttattgaattaagtttggcatcttcaggacaatttatctggtcattctttttaaattcctctgtactgtcaaattttcctagatcactatgaatatttggaacagaactagattttattgaactatgtttggtatcttcatggcaattttttttgctctcctcatcagtggttactgctgagccacgtaaactctggtcattaacagtaaccttgctgtcagtgaaagaaaatttaaacaaaggaaaaatgcttcctttctcttttaactcctgttgcttttcagaatgaccaagacttctaaaaaatggaagatttagttttccactaaaggaaaaggaatgaccatctttcttagagcccctttctaaaccatcttcctccacctggcgaattttcacaggttctgacaaactttcctttgaacaagtctcaggggaagtgagcaaaaactggctaaatgattttctgagtggctcaaggaaatcatcattacctgtaactttgtcctcctctaatggctttgaaaatacctctttatttgcagttctactgccagctatacaaggatgtcctggagtatctttggcacatattttttgttgatctggtaaaagagacagatctatacagagtttttcttccaatagactctcatcatttttacttgcagaactaactaagtttgaaggttcactggttacttgggaggacaacaaattctcacttgtgggcatctggaaccagcccgtagtttcttcatcactcccatttaaagcaatgatgctactactgtaattgtcaagagtgccttcccttttatttaactccaaaccacactcaacaaagctttcttttcttggtggcttactctggtcatcatctttttttgtttcctccttttctgaaaagatcttcaatggatttaacctgctgaaaaccgactttataactgaactctgactctgtggagccaagtcctttgcaatactttctgttgtattctgaaagtataaactcccagttttattacccatgtgctcattttcagaggtttttctatgtctgtctatattcacattatcatctttttgagaggataatggagattgcatggaaagatccttccccaatactgccatggctctgggtttagatcccaaattaattgcctctatttgattaagagtttctgttttttctggaactaaggaaaccaacttttccacagagtttgttagatgctttgtgcctgaacccactttttctgtgagtgaactaaacaaagaaccaacagcacattgtactccagtcaactcagggaaagagatggccgtgtccttgtcattcttgacaatagttaaaggtggtatttgatccccaggcgttctctgttctgcatcaagagtactattttgtttatgtgattttttagtttttgaaagtgaaccaaatctattaatctcctcttccttctctgctaaatattctgacaccgtttctaccaaacactgaagctcatccattgtatcaatacggtcctccttgggctcctcaatagaggaaggggttatctcttctatagagcactcagacagatctccaagtgtttttgcatcacaattcatcctttgtaatggcaatgctgaatttgctacataatattcctcaggaaaatctccaatatggtggacattggatgaatgccatgttggtgactgtaaattttcctgcttatcagaaatgggggaacccagaagttcatcagaagtactactagtagaatcttcaagaatatctaatgaggtaaaattagtgacatgctggtttgagccagatgacttttcacagtgccttaaacaactggacagatcataatcatgactttccaacttaatgcgctgcatgccactcttaaccacaaatccatttttgtaggggtacaaaactgggtaccccatattttgtttcttttcagtatggcaaagggtacaattttcagtattagaatatgtacttttgtagttagtcttagtttcagatctctcaccatattgccttctttcactgtcttcaaaatgattgtataaggatttcttttttcttcttctatctagtgtatcatatttctgagcatacctggagaaaacagaagtttcaaccttaaactcagtagagaattctgtttgttggctctgaggtggtatctttttcctgttcttatactttggttgtttttgttggctgtagtatttatcagcttttgaaagggttctaatttcttttatctctgcttccttcaagtttatgttattattttctagaaactcttgtgatattttcccctctatctccttatgtatatcttcttgctcttcatagtcaacatcagagaaagctgaaataatcctaattttttcatctttagcctgtgagccttgtctgatgtgaagggataaaattggaggaacaataaagcaaagaaaaaggaagagacagggaaaaggaagaaagaagttataagatttaatacatgttcaatgagaagactagaacaataaaattgccaatgtgataaaaagcattcagactaaaaaaatatgaaaaggaaatccacatgttcttaaatattatatcaatgtagtcaaatagtttattccatatgagaaaaagaacagctataatatcaatttttaaatgcttcaacttgcaatcatttttcattggtgagctttttagaattcttttatttttctaagaaacaaatgaaaaaaatgaaacatgttgtaccaatatctagaatgtatttgcaatattaaagtataccagcaaaatatatcaagggatttcaagaaaacgaaatttgctgataaatttttagtctaaaaagaagccaagctgttaactttctgaaagttatatttgaggatgtgtagccaagaatatagtcaaacatatttcttttaataagaaaaaaatacatataaaaccattttttactatcagcagaagtcaaactttgttatactacaaaaaaataacaaattatttaaggccttataatttttttttgagacggagttttgctcttgttgcccaggctggagtgcaatggcacattctcagctcattgcaatgtccgcctcctgggttcaagcaattctcctgcctcagcctcccgagtagctgggtctacaggcacccacgactaggcccagctaatttttgtatttttagtagaggtgggttttcaccatgttggccaggctggtcttgaactcctgacctcaggtgatccacccgccctcagcctcccaaactactggaattacaggcatgagccaccatgcccagcctaaggcattataatttgttgtttgtgaaatctaaaggctatatgcattgaggatcacagtgaaaagaaaatctttccctatactgattatagcagcagaagctacatgcccaccttaaaacaatgaatactgaagatagcctgaactttctttcacttagattaaagactgccttcttctgtgtaccaaggtagggatggagaaagaacctaaaggctaggagcttatgagttcagtgtgttctttatagatataacatccaaaagcattcatttaggaaacagaagcaagatcaaagcagacacttagtcactaaaaatcttccagaaggccaggtgcagtggctctcacctgtaatccaagcactttcggaggccaaggcaggaggatcacttgaacccaggaattcaagaccggcctgagcaacaacgcaagaccctgtgtctaaactcaccatgtagcagtttggtgaggtgggcaagaaaaggacatcatcctatggtctggtgaattttgtattgattgactgagacagagtcttgctctgtcatccaggctggagtgcagtggtgcaatcttggcatactatagcttcgacctcccagactcaagcaatctctcccaactcagcctcccaagtagctaggaccataggcatgcgccaccacatccagctaattttgtttattttttgtagagatgaggtttcactatatttctcaggctggtctcaagctcttggactccagtgatcctcccgccttggcctcccaaagtgctgggattataggcatcagtcactgcacctagccagtctagtgaattttagaaactaaaaggataagctaaattggaatgatttcttgaaaactaacctccaatcaataaaataattgattcaggcacggatcaatggatgctaatatcattgagtaaaagactattggggaaacagagtattgatacagtctcaggtatcactccagatattattaattacaaaggagaagaggaaactttacactggagaaatacggcatataccaaattttttaaccatgagatcaaactaaacatcaccaataataagacaaagtaggggccgggcgcggtggctcacgcctgtaatcccagcactttgggaggccgaggtgggtgaatcacgaggtcaggagatcgagaccatcctggctaacacagtgaaaccccgtctctactaaaaatacaaaaaattagccgggcacggtggcgggtgcctgtaatcccagctactcgggaggctgaggcaggagaatggcgtgaacccgggaggcggagcttgccgtgagccgagatagcgccactgcagtccggcctgggcgaaagagcgagactccgtctcaaaaaaaaaaaaaaaaaaaagacaaagtatgtgcttcctgaatgcatgtgaaggaaacatccagcatttttgccaaaaacgtttaacctgattctaaacatgaagaaataatcagacaaaaccaaacgaagaggcattctcaaaacaactggcctgcactcttcaaaaaaaaaatgtgtcttaggccaggcacggtggctcacgcctgtaattccatttgggaagcagaggaaggcgtatcgtttgaggccaggagatggagaccagcttgaccaacatgatgaaaccccgtctctaccaaaaatacaaaaattagccgggcatggtggcgtgcacctgtagtctcagctactccggaggctgaggcacgagaatcacttgaaccggggatgctgaggttgtagtgagccgagatcacgccactgcactccagcctgggagacagagtgagactctgtctcaaaaaaaaaaaaaaaagcttcttaaaagaccaaaaaaccaaggtaatgaaatttttgctaaattaaaggaagctaaggaaacatgaaaaccaaatgcaatgcatcacggttctggattggatcctggaccagaaaggaacaaatatacatacagaacattatggagataactggagaaatttaaatatggtctaaacattaggtaataacattgcatcattaaacttcttgagtgtgatcatgatattgaggttatataagataaagttctttttcttaggagtaacatgctgaaatactttctgatgaagtaacacaatatctgcaacttatttttaagtggttcagagaaaatgtatgtgtatatgaatacatattagggagaatgagataaagtaaatgtggtaaaatgttaacacaactggtaaatctaggcaacatgaatatgggttttcattgaattatgtctccaaattttctttaagtctgaaattttttttaatcttagggcaggggagagcacatatgtatgtacttgcttttatactcataaatatatgacaacagtctatggaaggatacataagaaacaacagtaggaagggaattatgaaacaggaagaagatggggtggaggaaggtaagtgtgggtgggaaactctttatgctgtattgacattttttaaccacataattgttttatatatttaagaaataaaataaattaaaacaaagttccagtaaaaatactgaatctgctataagaaatcatactggttttcttctaaagttcccagggaaatatttaggcaagaaggactatccaatctgtgattttttctgtttttaatcttggcaaagggtataacaaactcactgagtcaggaagtggggcagatacaccccaagtgggatcgccctgatcagttgagaatcactgatcatgaagagaagtattccttatggcaatatataaacataaaattccttatggcaatgtataaacatgtggaagaaaaaaaagactaataatctacacaaaatgactgtagtttggccggtgatactgctacacttacgctacctcttcaggttaaagcatccaaattcttcttgccaattgcatcatgagacctggatattaggaagagaaagtactttgtgctcaatacccacctgatagcccgccgctctggataatcaaggtcataactttgcatagagtcattacaagagtcccgggaactgccttgaagtagcagctgctgtggcgatcgcaccggcacagggaactggtgcacagaagcgttgggctgggaagctgtatggtaaggaggtgggaagctgttgctggtctcactgcgatagtcactatctcggtcatcgacggcactatcagggtcttcaaaagctatggaataagcacattcaatcaaagcaccccagctttatttagttcttcagaattatttctgcttctaacttagtagtaacaagtctggaccttgagaacaaaagcaagctgagcttcacatgagcccagtgacgacctcagagccatgagcagaactgtctcaattaatacccacaagtttctcttccttatcatatgagatatatacttagtttaattttagtgcttattcttagaggagctctaggttgcattttcccactgtagaattctttggaattctgcttctccaactatcataaccataattaaaaactgcttttaaatgtcacaaatacagtctggtcccctgttattaaagaaaggggaaaggagcagaggtttaaaaaagttagctttttcatatcttggggaaaaaaaccccaaaacttttatttaacgttgtcttggtgttttcagacttttaaacatatggattgaaccaaataagcaggtctaacatcagaagctggtcctggaaatcaggaaggtcaaagccaaggcctggaaatcaagtcaaaggctctagatgcagctgagaacagcagcactcttactgtgctgctgcagtgttagcttttcctaacaattcctgtcaagcacctacaccctaggctcagaattcccatccagaggatgggctgagagaagaaaaaacttatgcactgccaatgggatcttgctgacaatgcagccaagtttatccaacagcagtgactacaatttcgtagaattatttgtccttcagaccagcacctgactggctacagtttttttgttaaagttaactaaaaagaccacacttacaaatcatcgctgtgcttggaaagggagctcaacctaagagtgctttgaagcctgttttacagagaggaagtcgtatctgacaccatacccttatgtgtatgattaacagggttccacgtgtcctttcttgacaagttcctatttggcttacaatgaggaaaaggaatgttcaccatcccaaaatggagatacttttagcacaaaatgaactcatgttagtaattttaaaagattatcttggggccaggcgcggtggctcccacctgtaatcccagcactttgggagtccaaggcaggtggatcacctgaggtcaggagttcaagaccagcctggccaacatggtggaaccccatctctataaaaatacaaaaattagccgggcatgatggcagatgcctgtaatcctagctactagggaggcttaggcggaagaatcgcttgaacccagagggtggaagttgcagtgagctaagatcatgccattgcattccagcctgggcgacagagcaaggctccgtctcaaaaaaaaaaaaagataatcttgtagcaatgtgggcagtggaaacctcctgaagaccgtaagattaggcttttacaattgctcaggcaggagataaggacctgcatctatacagcggaaacagaaaagagttaatgaactagaaaaagaaaattccagacagaattgtaaaacatggggccatattgaagataatagggaaatgaccccccttggcttcattagacaagttggtagataagaattccactaaaagagagcacaaacatgtgggttttataggtaaggaagaaaatctgagcattggactctcaataacatttgtgggtacagatgggagacaggggtaagatgatcttatgagcttttcctatttgagtttatggttacatgtgaacataaaaaaggagaggagagggattagaactccgggaggaaaaatatcaacatgagaaagaagctaatgttcaaatggtcaggaacaagtattagttaatacttgacatttggagcaagtagtccactgaccagggcaggagtagcaaagcttgaaaacaaaagcaaacaagagggatgcaaagcattctgcttacaaagcattctgatgatatattaagaaaaagagactttggaagcactgtttttagcccttgatgcatctgttgttctgaagacaagaaaaataggacccagagacaaaaccatatgccactcagacttaattctttctgaacccacagaaagagcaagtctgtagaagtcagtgctggactattcatgcatacagatgaaggggcagaggcaacaaaggagacaaaaccagaggtctactaaactctggcaggaaaagtattagcacataacccagagaaacaagattcagtctccaaggaggcaactgcgacagacaatcctatcacttttgaggccagagagggcagctcagccagagttagaagcccacaacccaaatccacaggttttactttctccctgcatgtgacctattactcctaaataatagtctgctttttgtttattttgctaggctaaacagagatactctacaactttactaaaggctaacaacatttctacactaaagaaataaagggcaaatattaagaaacaaagcatccatggaaagaagaggttgggagtagaagagaatatgaaaagcaggagagggcaagagagagaatatactaaggaataaagtgagacaaaggagagaaacagaaaaaagtagtgagaggcaatcacctccagttttcctaaaaagtaaacctcctggcaccaagcctgattagaaactaaaaagggaaattcaggaaaatatgtaacacttcaatttgaattaaataactgtgtttttaatgtgtcactgacgatctcttactgcctccataatctatcccacagcaccatgtcggctagacgagaaaagccctggctttgcagagagaaactgagtgcaggtttggttggctcagcctaagaaggaactagagagccagtttgagggtaacagttgaaaagcccctggtaaagtctatttgaaagatggaaaattaaaaggctgggaacacctactcactcaaatattcactgactgcctacatatccaaagctaaacaacacagaagactcagaatatagagtcagtctaataggagacagaatatatagacacaaatattgaattgctatgcaaggcagttagtacaaaccaagtgctatgaattaaaagtaaaatcacttcctgatagggtaactaaggaagctttaaggaggagatggctttgaagaattggttcatttttaataggtgaagattggaggcagaagggaaatatcttctagaatttggataaaagcagtggcatgatgaaaggcccagtggtaggaaaggctatatatttttgagaaaccattttgtagttcatttgataggtaaataaaaagacatagaggaaattatggaaaattaaaaacctgcaaaagtaggctgggaaggtcatctaacctggggcaaacaaagatgggcctccaagcacacagcaggcactcaaacaaaatccagtgaaatacagaaaaatgaggccctctagtatgtggtattcctggattgagtcttggattggtctttaaatccacagcacacctattaatagaacttcagcaaccaaagaaaggaaagaaaattcattcacatttttttcatggcttagttgctttttctacttgaaaaccttaacttacctgagctctgttaacccatttatgcctgaggttgcaatttatgcttgaggtcacctactgcttggcgatgaccttgagcagtaggatataaataactcccacatgcttagagttccaataatggaacactaggcataaatgggtcaagctgcttttgagtactttcctaatagcagaagtactcaggattcaaatcacagaaagcacagacttcatgagaaattccagtgacaggacaaactttggcccgtcttagtacctactggatacctaatcactgagactcaaccagatcctgtaagatgggtaacacaaccagtaatgtcagcctagggctacatgttttgccacaaagaactggctgcccactctctaagctctagaacaaaggtggccttagctgggctgcttcagggaaagccaagccatatcctcagcctcttgtttccttaacaaaagcaggtttttggctgaaatggcattcacaatttgctagaccaataaacccaagacagcagtctgttctgcatatcctcctagtcaagaaaatcagccaaatcagaatgcacaccaatcaccttgactctagttcatcctagaatgaaccttctccttctggtcactgcactccttagccaaagggaccaaaggagaaggccacactagggggctgatgctactacttgcctctggggaataaaaattaggagatcttgtcaggattatgactgggactttggtttgaaatttgtaacacacataaacacacacaaagtcgtcaagaaaccagcctgaaaggatataacattccaccacaggtcattgtctcccgatatttaagtaggagaggagagggaaatggaagtctatgcatgaatatccagcttcacagttcagagggagtatgtactttgtgggtaagatcaagaaaatgataaggaatttcaattcttacgtactctgttgttctccccagcccaaataggtccagtgacctaagaaaaccacaaagaagcagcagataatttttgaaaatacttttttgaaggaattcaaaagtcatttccccatctcagcaattattatgtgccttaccttacttaagcctacctcacttgtattctactaactttacataacatagagtttctgccttctaccaaatgtgagacaaatctacaaagtattcttgttctctgcctttcactatagagagagactaacaacaacccaaaaaacccacagaacaacaacaacaaaaaattacttcttccatattgttttaagcccccttctggtctaggtctctctcagaacaccatcatttaggagctcatgtctttcctttgtcaaaataagaaaaattagatctctgtctctaagaaacccttccttatctctgtgttcaccaaacctgagcccatcacaataaatctatgagaagctaagccctgataccatgggtaagggagtaattcccttgtctgggagcgaagatagtcaattttgctgttctctactgaaagttaaaaggtcaaagaatggcaatgtttatctcttaagaaattaatcttctaattaagctcccagactcccttacccatggtatcagggcttagcttctcatagatttattgtgataggctcaggtttggtgaacgcagagacaaggaagggtttcttagagacagagatctaatttttcttattttgacaaaggaaagacatatgagctcctaaatgatggtgttctgagagagacctagatcagaaaggggcttaaaacaatatgtaataaaccactctagcctattgggtccttaaagagagccacttcttctgaattacctataaatttttaataaaatccactaaaacacagaagctttgaaggacaggagaaaattgaaaatattttttattcatttttcaaaatcaaaaatccactattaattaagtcctatcccacacccaaattgaatttcaagaaactaattgtgataaagaaatcattaaaaataggcctttaatctcaagaaacaagaagtaaatagcttcataattaagaatatgggttttttattttttgagacagagtctcactctgtcacccaggttggagtgcggtgacacgatctcggctcactgcaacctctgtccccaggttcaagtgattctcatgcctcaggctcccaagaagctgggattacaggcgcctaccaacacgcctggctaatttttgtattttcagtagagacagggtttcaccatgttggccaggctggcctcgaactcctaacctccagtgatccacccgcctcagcctcccaaagtgctgggattacaggagtgagccaccatgctcagccaagaatatgggttttaaagtcaacattcagttcttctggctctgcgatttactagctatatgatcttgagaaagttattacagatatttcctcatctgtaatatgagaataacaataacacaagtgtcactgggttactgtaaagatcatacaggaaaaaatatgtaaaatgctaggcacagtccctggaagatggtgagcaactagcatttgttgttattttgtcacgttaccaggtttttgcttgccttacagagtcctaataaataagaagcagaaaaaaagacacaactcctagaattgcaccctctgacagtcccaaggtctgctaaggaatcttcaatgtggggtccacaaggcccacaaactggttctgagtgtgtgactcccttgaaagtctacagtaagactcgaaattctaggaacatcatatgatgccaacccaggctgttttcagtacttgagctaatcctcaatcctgggcatacgggactactaatcaatcacagactttaatttagtgataccctgacagccaattttcttcctaggcacttactttattccgaccacctatgtctcttcttctcacctctcagaaaggatatgttggcttagtgtgccattttaaaattgtaataatttatttcactttctaaccatggggggaggggaggcaaaaaaaaaaaaccctcctgtagaacagttgccatagcaactgctagagggtaattacttcatttcttttaaaaagaaaatggaaaaaaaaaatcacatagaacctcagaatatgtctatcaacttagattgctccaggcaagtgacaatgctgtttctcaccacaattgtgagcccaaagaagcctttctgggcaggacactgcccctcatctttgagcaccccacagcagtttcttatacataaaagttctcagtaaatatctactgtactaataaattgaatgaataatctgatcccatctactgggcccatctctaacgcatgaaaaaacaagtcatgttctctgacaagccagctccatattctcaccactttagctcagaaccgtcataagataaattacaccggtttaaataagcaagtttccttccctatcccaaaaatgcattaaaacacataactagccagcagaacaattactgaggatagttaggttttgctaggcattagtactgagaaaaggaaggggaaaatgtcccaggaaaaggaaattatgcatgcaaaggcatgttcagtgagctgaaaatagttccagaatatctagagtgagaggctacagagttatgaaagaacctaatgactatgggtcttaggtaatgtttagaaatcaagtaatattaaggatttggaattacctggagggcaacacagagctatcagagcttttaagaggggaaagacaggatcagatttggcattttagaaagagaacagtggaacagtgtggccaatggtggttggttgggtagaaaggactggtgattcatagggaggaggtgtcagggaggctcgtaaggagaatggtgcactcatctgttgatagcctggactagggaagtggcagagtgggtagagagaaggggatagattcataagatattctggagggaaaatcaatagcatttaatgagtaaataaaatgtggaaaggaggattaaataatattgcttaggtttttagcttgagctactggatgaatgtgacatcattcaccgagaaaaaaatacaacatgggggcaggctgaagaagatgattaattcagggttaggtatattgactctgagatatctatggaacatctcaaatgaacatggccagtagacagccagatatacgggtgtggagctcaggaaagagatgtggaacagacttggaagttttcagactatatgttccaataagggcagggatttttctgctttgttcttttgctgtatcctcagcacctgataatgcatggcacaatgtaaaagttcaaccaatatttacaaatgagtataaataaaaatgcaagtaaataaaaacactaaggcagagtgcaggccaagaaaaaaagactatatgaagtgggggaaccctaaggaacaatcacatttaaaaagcagacagaaattttaaaaagaagaagaaaaagaggaagagaaggaggaggaggaagaggaacaattgacaatccaaagcgtcagtgaggctgtggagcaactggaactcttgtacattgttagcgagaatgcacagtgaagtcgggcatggtggctcttgcctgtaatcccagcactttgggaggttgaggtgggcagatcacctgaggtcaggagttcgagactagcctggccaacatggtgaaacctgtctctactaaaaatacaaaaattagccaggcatggcgatgggcacctgtaatcccagctactcgggagactgaggcaggagaatcacttgaacccaggagctggttgttgcagtgagccgtgatcatgccaatgcactccagcctaggcaacagattaagactccaactcaaaaaaaaaaaagaaagaaagaaagaaagaaaaagaaatgaaactaactctaaaggaaagataatttatgataacttataacaagttcaaaaacaggcaaaaccaaaaagttagctgggcatggtggtgcaggcttgtggtcccagctacatgggaggctgaggcaggacaactcacagaattcaacgaaacattttacttatgtttacccgtctacggtagaggatattacaaaggacatagttgaacagccacatgaagaaatacacagaacaaggtctggaagagtcctgggcacaggagcttctgccctgtggatttgcgatgcaccaccctcccagcacacggatgtgtttgccaacacagaggctccaaaaatccacagttttgggatttttatggaggctttatcatatagacacaatctattataagtagtattagtggtattatttttttgtagaaacagggcctcactatgttgtccaggctggtctcaagcttctggagtcatcctactgcttcagcctcccaaagtgctgggattacagacaggagccactgtgcctgacctggcatgatcaattattaactcaatctccagttcctctccctttcctgaaggaaagggaatggggctaaaatttccaggcttcttgggaggccaaggtgggtggatcatttgaggtcaggagttcgagaccagcctggccaacatagtgaaacctcttctctactaaaaatacaaaaattagccaagcatggtggcaggcacctgtaatcccagctacttgggaggctaaggcaggagaatcacttgaacttgggaggtggaggttgcagtgagccaagatcacagccactgcactccagcctgggtgacagagtgaaactccatctcaaaaaaaaaaaaaaaaaaaaaaagttccaagcttccaaacatggcttggtctgtctgataactggttcctatgtggaagcccatcaagagtccctcattagaacaacagacattcctagtatccataaaattctaagagattaggagctctgtgtcaggaaccagggacaaagaccaaaatatatgtttcttattataaaatcacagtatcacagcccccagtggtaatggcattgtatttacagtgttaaaaattctctagaaatacgggagtatagcaagtacacctcatgtccaaaaccaccaaactcccaatactttgaaatcagaaaccacaggaccattcttaaaattcctctttatttcccatgtccaatcagtcaacaaacttagtagttaattctgctgaaatctccttccttttgtgctttccttgaagatttaactatccttatcaagaaacttattaccttatgaattattagagattacagaattattctgaattattacagatatttgactggactttttaaaaatttgtttttagaaaccaggtcttgccctgtcacccatgctggagtgcagtgacaatcatggctcattgctgcctcaaccaatcctcctaccctagcctcctgagaagctgggactacaggcacgtgccatcacactcgactaatttttgttttctgtagagatggggtctcaccatgttgcccaggctggtctcaaactcccaagctcaagcaatccacctgcctcaggctcccaaagtgctgggattacaggagtgaaccatgtgcctggccatcttttaattttaataattacttgaggctcttgtttagaatgtaaattttaaactctactcacagagattctaattcaaagggcttttcaacaagaaacttggtgactctcatgccaatgattcttgaattacattgcgaaaaacacagctatagaatttcctatatgaaaaagccacagtctcccagacagaagaataatactcctgtgctaatggaggaagaaggcagccagacccactatcctactgagcctgaagaaaagttcaatgtcatcatacagtgaaaaaattctagcagttctaagacgaaagtacatcctctttcctagaaggtaaacctctgcacttatccccatcccctaggctggctgactaggctacagcaacacactcacaggctgcttcttctgcacattttatcttgtttctagtggaaaatgtaagaaatcagaaatagtcacattaaaaagtaaggtctacaattatcaaacaaaacacccccaggcaactgttacaccacccattagtagtccagtactggctaatgtttccatgacattaaaatgatggaatacttaagccccagactccatgtgaacagccatctgtctaggcaatgacaggaactcacctatcaactactaaattgtagtaattaccaggtatctcataaggaccataaactcaaacactagaaattattctcttccctttttctagacagttgattcggtaagtactgtagaacttctctttctacggaagacagtagtaaagaacctataattaaggaaaacacttcaaatctaacataggagaataacaaaaaactattcaccaacgttacttgtgatatagatagaaaaatccaaaatgaaatacaagcaaatcaagcctagcattatagtaaaagaataattcaccataaccaagtaggttatattttagaaaggcaaagatgatttattaatagaaactgattaatgcattcattatattaataagtcaaagaaaaatatccatgaattggttaagtactattaatgcattttgaaatgttcaacatccactaatatttttaaatatgcaagctctactgaagtataagatagagaaaaatatacaaatcataaccgtactgctcaacgtttttgtttttttggtttttttgaaacagaatcttgctctgtcaaccaggctggagtgcagtgacatgatctcagctcactgtaacctctgcctcccgggttcaggcaattctcctgcctcagcctcccaagtagctggactacaggctacagtcgcatgccaccacgcctggctaatttttgtatttttagtagagatgggatttcaccatgttggccaggcttgtctcaaactcctgacctcaagtgatcccccggcctcagcctcccaaagttctgggattacaggcgtgaaacaccacgcccggcctgtactgctcaatgaatactgtgaacacactcaggtaaccagcacacagatcaagaaacagcattcccaggacccagcaaaactcttcctactccttttcagtagctaccagcttttgaactagctgttcacgctgcctatcacactctttccccagagagccacgttaattccctcacctatttcaactctattgaaatgtcaccttctcatgtggccaatactcagaattttatttaaaattgcaactcaactccaattctagcattaccaactgcctttcactcttttattggttcactctctaacatcctatattatttccttattatgttaattgtctatttcttcccacccaggatctttgttttgctctctgatatatcctaaacacctagaacaaaacctggaatgtaagtgtcaaaaaaatgtttgtagaagaaagtaacaaaaggaaaagaggagagggggtgaagaggtgggtggggggcacggtgttgttgagtgggccagtgaggctaaatgtgaaaataagtaccagcagcagaaatataaataggtaaaatatttttatacaatttgatagtgtctaacaaaattataaatgtatatattctttaacccaatgattccacttatagaaatgcatttattcaactaatatttattgggcaaaggtactatggatacacagataagcatattaataaatcaaaggaaaatacctatgaacaatgggtatactcatgaaatgtatggcctaaagaagggaacaaatattaatcaaataatcatacaaactgagaaagtgccatagaggaaaaatacatactgtgtaatagaggatgggagattcatttgaacatgtttacaaaaaaaagtgtataaagttgctcactatagtattgtgttttagcagcaaaaactggggaacaatccaaatgtctacaaattggggaaaaaattttaaattatagtatactcaaactatggaatatgcctggcatcaatatcatcaatcttcaatgtgcaactacaatttacaggaaatacaaaggacagaagagtgtgttaagctaaacttataggaatgttttgagcaaaatcgggaatgtaaaaaactctgtaagtcaaacaaaaccatatagtcaaatggcctgatttcttcaataaacaaattgtaaggaaaaaaaagcaagagacggagggggaacccatagaataaaaaataattgtaagacatgatcaggcatggtggctcacacctgtaatcccatcactttgggagactgaggcaggcagatcacctgaggtcaggagttcgagaccagcctggccaacatggtgaaatcccatctctactaaaaatacaaaaaaaattatccgggtgtggtggcatgtgcctgtagtcctagctactcaggaggctaaagcaggagaatctcttgatcccaggaggcagaggttgcagtgagccgagatcacagccactgcactccagcctgggtgacagagtgagactatcccaaaaacaaaacaaaacaaaacaaacaaaaaaaattgtaagacatatcaaaaagagaaaacaagaaaacaagcaaaaacaaactctagtgtttaaagatacatacttgggtgacaacatataaagaacaagaagagagtaattattataaaagttgggatagtaggtacttttagggaagagggggttgtgattgggaagaggcatatggaggctttctggggtggttggcaaaggtctatcttttacctaccttatactaatacatttaaacatttgttttataaagttgtctatatatctgtgttatattctaccattaaaaagatttttaatgcagcaaactgctcacatcactataatcactgctatctaattgtttcattcctctgcataaagtcatcaaaggttcccccttgccttcaagataaaatataaacagcttgctatggcattcaagccctttgtgatatgagttctctgtgtctctctggcctcatctgacccttccccactcttcttattccctccaccgaagccatcaagaattttcaacttgcagtaccccaaggtaccttaagtcatgctttttcatcttagtgtccttgtactatgaactcttttctccttcttcacttaactgtctgctactcatcctttaagactcaatttatgccaaggatctggggagaggtagaaatgaataggtaaactacagaagatttttagggcagcgtaactattctatactataagggtggatatgtgtcatcacacatttgtcaaaatccatagaatgtacaatacaaagagagaaccataacgtaaactacagactttgtttgagatatcatttcctctgggaagcagttcctaaccatcccaaatttgtattacattctctttctctgtattccttgaatatcaagtacttacgttcccattcacttatcaaatggtactacttatgtttcttcctctctggacttgagctccctgaggtcagggactttcattcctctctctctcttttttttttttttgagacagtctctcactcccaggctcgagtgcagtggtgtgatctcagctcactgcaacatctgcccctagcgttcaagcaattctcctacctctgcctctcgagtagctgcgattacaggaaagtgccaccatgcccagctaattttttttttttttttttgagatagagtcttgctctgtcaccaggctggagtgcagtggcgtgatctcggctcactgcaacctccgtctcccaggttcaagcaattcccctgcctcagcctcctgagtagctgggactacaggcgcatgccaccacgcccagctaattttttgtattttttagtagagacagggtttcaccatgttggtcaggatggtctcgatctcctgacctcgtgatccacccgcctcagcctcccaatgaaacctataacaagaagccatcagatgaccacgcttttatggtaataactgacctttatgcatatacaacacacactgtactcagcatagacacctaagtgttgctagcaaatgaaactttgatacattaatctgacatttttaacatggttaattgtgtataattgtaactgaacataaattataataagttgatgtaatgactgcaattaaccacctcaaatttctttttagaggaagccaggatagaaataaataaatgagtcagaagactacaattaacattatttttatcagccaaaccatattgtaatagtttctctcttttctttttagtttgccagcacctataattagcatcaatatcagctgcttccactgataccacatatctagtgtaaaactcatcacccacccttactgacagtcctagacccattgcactgccttaccactaaaataatactccctgtgcactcactctaaggagtccataactagtatattttcgtgtctctcagagtcttagtcctagactggaggtaccagaagctataccctgtctgatcctttacttcccactccccaatgggataaggtaataggaaaaagaatgttccagccagtaagagataccttgaccaggacatggggagtggggtgagatggagtatgttaccttttgaaccctttcttcctacttttcatttatcctactaggaataatctctcctttcaaactttacattgcaaataacttcttcaaaagtcatctcgaaactcatcttttctagaatgccttcctgaacaaactttataccattctcaaccatttgcttcttcttctgtcacctcagcactttcctctctacttccacaatattattattgaaaatgaaatcaaaggattacccaaaattaacatgtaagcagaaagacagaagttaaaccagaggaagaactttgaccaggacactaaacaaaaggcccagttatcaagacctctttttggggaatcagaaaatcagacggcccagatggtagaggagaaaaagacaggataagcaggcaagcagaaaggagactcagtgaatcatggcacaggaactgtttgcctatggctatcctcagtgtgccatctctgcaatataattttgtaggaagggtgactattcctaaaagctaaggaaagatgaagcactctcatactttgtaagtgggaatataaatagtacagcctccatagtgggcaattctgtaacatatttcaaaattcaaatgcattgttaaatgtacaatgctttggcccagcaatcgcacttttagctattcatccaacagatatattcacacatgtataaaattatgtatataaaatatcaatttcagtattgtaactgcaaatactggaagcaacttaaatgtacattaatagccattctaatcctagtatatacccaaaagaactgaaaacagctattcaaatacttgtacactgttgttcatagcagcactattcacaatagccaaaagtggtttaaaaaaaaacatatttcatcaactatgaatggataaacaaaatatggtatatctgtacaatgaattagtattcagccataagatgggataaaggactgatacatgccacaatggtgaatgcacctcaaaaacattatgctgctaaataaaccagtcacaaaaggcctaatactatatgattccatttatgtgaaatatcgagaatgggtaaatccatagagacagaaagtagatcagtggttgccagcggtgaggggtggagagaatggagagtgaccgtttaatgggtatgaggtctcctttgagggggataaaaatgttttggaactagacaggtaatggttctacaatttatgaatgtactaaatgtcactaaattatatatttaaaatggtttattttatgctacatgagtttcacctcaatttttaaaatgtccattattatgaacctgttccctacatgtagtcatacatattatatgataaaaagcaagacactaaacacagttcatagcatactaccattcatgggggtgggggaatatatatttatatgtttgtgaatgcataaactctttctagagaaatccacagtaaatggcagtagtggttacctctgggtagaaactgtatggctaaaggacagggtacagaaaaaaagctgtttttcatagcatacatttttacatcgaattttgtaccttatgcacatgtttcctttcaaaaaataaaataaaatggggaaaatatcctacttataagataaacaagaatcagctacctatggaactccagaatgattaggatgctttaatgcaagagccaatatagaaggctcagacaaaaaaaaaaagtggcaaaaaggtagaagaaggtggcaaaagaagtatatgacctggggacctatgccttctgggattttaaaaatgagaaggagaaatagaggacattgaagaagtggatgaatctgcagagtggaggccagctggtcatgcaatcctattttcctgcagggcatgtggtcctgggtaaataagtaaaaagtaatcataaggctcttctgcttccagtgttcacagaaacaggtcttccatcacagcaacaaaattttagccaccaaaatcttaagcggctcaaaactttcaattctacgacacatttaaacagagagaaggtgatagatgataatgaggactctacgtatctggagtaaaagaaagaaaaggctcccaaagaaatgaatctgccaaactgggcgagccctgtacatcttggctttttgaaggccaacaacaacaagaggattcatttcctctggcagattagcaagtacaactatgacatcactgtactctaagccagtgtgtcctgcatctttgtaatcctctcctcattcttttcatttatactactgtgaacaatctctcatttcaatgaacacatctcgattagttctttcaaaagtaatttctaaacatatgtttctggaaagccttcttgaacaaactttatgccattcttaaccatttatttattcctttgccacctcgggactttccttctttccatggtattactgtgtacccattgagggtactttccatggtattactgtgtacccattgagggtactttccatggtattactgtgtacacaatgtgaatatgtaattataaattacatattcaagttgctgtctttgtatatttacctcttcggacttgagtctaggttgtgattcagatcttttgattgtttttgcattctcccattaattctttcctagcctctgcaaatatactccctggtttacatagctactcactaagaacaagaaccccccgagaaaatataaaagcctttgcaaaggagaaaatgaaaagctctataatggataagctcctttgtacttcagggctctggatttcttttctgtaatgctgaagtctcaaagcttcacaggaaaaattaggaaaagtatgacagttctctgtctggcatctgcttcaatgtcatttctactagggatacccctgagcattctaatgcttataaattaccttacaatatagccaacaaagctttagctattgccaaactcatgtctcaatcgcctgaatatgagtctagtagtcacaattacagaagctttctagcaatctacaagctctggagaaagtaaatttccaacccaaagaaaaaggatgccatcttccagaaaatactgcaaattacactcttattcaatgatcattgttttttttcctctaaaggttaaattgtctttccctaaaacctggatgggatgaggtccctcaggggcaaacaaccaagcgtcactccctgagtacctaacatatcagacagcaaaactaagaaaccaaagactatgtccctacacttgcaattcaccagtcccatatgaaggaaaacactgtcactcagggagcatgataaatctaagaaaaacttctgagtacattactaaactatactaaaggataatgatgagtggtaggctaatgggtattagtttcattattatgctctaaaacttttgtattttacatttattcttttgtaattcagacaaaaagaacaatttggcctttgtgggagggaaaacaattatcattgaaagacaccgcataattaaatttttgactcattttttaaaaataaaaattaaaatgttgggggaatatacacgaaactgtgaagactagttatcccggagtggaatagagggggaaattgaagagtactttcactttctatattacacatttctgaatcatttgaagacttttatagtacccatgttacgtatttctattttttacaaagtttaaaataagaaagggactcagtatgttggaagaggaaaaaaataactcttcacaacaccacaaaaagtgaccacaacgaattcaaaattagtgaggaaactaacatattctatggacataaactgcagaagttcttgacccaggaataaatgtgtgaaagtcattctaggagggtgagtgcagacagaggaaacatttctattgtactcaaggccaggattttgggaaacagatctttgctatggaaagcaacagggaaaataaaataaaccatctattccctatgcctttttttttttttttttttgagacaggctctcactctgtcacccaggctggagtgcagtggcataatcttggctcattgcagtctcaacttcctgggctgaagtgatcctcccgcttcagcctcccatgtagctgggactacaggcacacaccaccacaccaggctaatttttgtattttttgtagagatcgggtttcatcatgttgctcaggctggtctcgaactcctgagctcaaacaacctgcccacttcagcctcccaaagtgctgggattacaggcacaagccattgcacctagcccctgtggcttttaaataaatccttagaacagagtgagaacccaaaaaagacactgatcaagaagtattcaaatctcaactataagttagctgtggacattttattgtagtatttggtactctaaaaccaattcaggccgggcacagtggctcactgtaatcccagcattttgggaggctgaggcaggcagatcatttgatgtcaggagttcaagaccagcctagtcaacattgtgaaacgctgtctctattaaaactacaaaaattagccaggtgtggttgcaggcgcctgtaatcccagctactcaggaggttgaggaaggggaatcacttaaacccaggaggcggaggtcacagtgagccgagatcacaccactacgctccaacctgggcaacaaagcgagactccatctcagaataaatgaatgagtaaataaaaccaattcaaaggatggaaagaataatcaaaagatctctctaatgtatatacctgtatattcgaacagcagtaaaacctcttgaatgattcacaagaaaatgctaacgatgattacctctggggagaagacccaagtggctggggaataggaacaggagggagactttttactatactccctttaatattttaaaactcctatacaaagtatattacctattcaataaatgaattaattttaattaaaacaaagggcagtagccacgtaagaaaagcacatatttctgaatggcaaattatatcccatgagatttttgccaccacagggtggtggtatagcggaaagaacacagacatttgagtcaagctgaccaaagttttaactctagtttacccatttcctagaaacaagtgatgcagaaaaagataactggttgggagacttgggagaaaaaaagactctgagctgctcttcacaataccatgcaaagtggccatcaagaattcataactttatccagccaaggtaaagaaaagaaaaaaaaagaattcaaaactaacaagaaaaccaatacattctacaactttaaatcacaaatgactttgagagtgcagaattttaacctagaggacactgaacaaaaagctccaaacccatgatatctattgaagtatgatttcacagtatgacaaaaaatgattgggaaagttatggagctggacatctcttttatgggggagcactgcaatttggatgcagccaaaggccagctggtgtagggactaaatagcccactcacagggccctgaatttaagtgaacagcatacatattatattatggcttcaagaagtggatacatttataattaaacccaaggtagcaatgtcccagaggaacctgggcatcaggagagagttcaataatctctcaggtctcccaggattatctttggcatttgtcccccaaatttcattgtggggcattctttatgaaggctgtcagaagtcctagcaggccatcctaatgtcttcaaagggcctgccacagaataagaacatgtcattataaggggatacagaggacagattttctgagttctgtcccttcaaaattcaattatggtgagagattctggttctctttaaggcattattaggaacatggattaatctactatatgctcttgaatctgtaagacatgcaaattcttgactgggtgtggtggctcacacctgtaatcacagcagtttgggaggctaaggcagaggatagcttgaggccaggagtttgagaccagcctgggcaacatagtgagacccccatttctacaaaaaaagaaaagaaaagaatgctagtactagttgagagtgcgaggccacaaagctctctaagagatatatctcctgataggcaggggttatcagtatggtggctactgtcatacggaaaataagtaatacagatccagatttctaaccaggcttcttttttacttggagctgtgcgaggtagttaggtctgatggtcaggaagcactagatcctctcaagatggtgttctctggcatgaaatggtggagtgatagtcccatactctacatgatcaagctttgacacagtaattgccacttgggtcagctccctctggctgtggtgggtccagaataaaagaaaggtatcctggaccaaaaacgagtggacaacatttcctgttctacttaaagtctataagacccaactacgaaagcaagtcctagcctccattgagaggcggccaacacagcccacaggcctaaagctagtcttgtttctggtaggtgtgaaaatgagactaagagaagcactggcagtacctgcctagcgttttttttgtggttgattttagttggggattataccatcatcacttgtagagcaggcaggaacctaatcgtccaagtggggaatacctagttacatatacagaatgacccatttctctgcctcccctaacaggtagaatattagaaataagacaggtaatagagtggcagtgaacagttttagatggagaccaagaataataagaggctataagaggagtatttgaatatggtgcacactaggaatatgaatatcaggtctaatggctgaaaactagtggaaagcattgaaaacctactgcttgccatctaagaatcaacaaatatcaacgcaatggacactaggaccaggacatttgacagtaagagttgaaaatgaggaaaggtaagtaattttattaaacatgcctcttttggatatgctggtaaaagaaattcttctgaagtttgtggtggtcaaataatttgtcacaacccagcaactaagcagtatattactgacaatgcttctgaatgtttggtcacttgttattcatgatatgactcacatccaactgttctgaactgattcattcttcaagaaaatttttaaacaatatgttgggttatgccgttttactaatttaaaagaatgattcgtactcaggacattttggtttatgatttgtatagatcactaattataggcaatactgtaagaaaaccagtgaaacaaacccttaatagataaccagaaaaatctctttgaaactccaaggtgggctatatctcaagcaaaagttcaagctatcttttagatcataatacatatagaaataacatagaccccagaagctttttgtttcagacacggtaagtagttaagggaggctttagggatatcattaataaaaggtacactgcaactctaaaagctacgtggaattttcagtgaaggaatcactggtattgttgaactaaactatgtcaatctcaacaataaattatcattcaactaagtctcaaattcaaactaaaaaagtgaatctacaataacttgcttctgtattgtcaggcttgggttattttaaaatatttatcccttttaaaattattataaaacaaatgcatgttctttggaggaaatctggaaagtacaataaagtataaagaaaaaataaaacaggccgggcgtggtggctcacgcctgtaatcccaacactttgggaggccgaggtgggtagatcacttgaggtcaggagttcgaggccagcctggccaacatggtgaaaccctgtctctactaaaaatacaaaaattagccacgtgtggtggtaggtgcctgtaatcccagctactcgagaggctgaggcaggagaattgcttgaacctaggaggcaaaggttgcagtgacccaagattctgccactgcactccagcctggacgacagagtgagactccatctcaaaaaaaaaaaacaaaaacaaaaaaaaacaaaaaaaacaaaatgaaacaaccaaaaaaaaaaacaaaaaaattatatttccttgtggtttttctacgtacatatgtatataatttatttcttagataactgagatcatcttaatcaggttaggatcctattttttagaacttatacacataaatatttcctctatcttaaaaatttatgtaaaagtatacaattccatcatatggaaataccataattatccattcttcctttctttgtaatttttcactattataaataaaacctatacataaatcttcctttgaacctctagttattttccttgaatacttcctagaagtaaaatcactgagttagaaaggttgtactaatttacacaccctagcagtttcaccacgttggccaggatggttttgatgtaagtagtcatctcaccaaaccttcgtcacatgctaaatcacttttgattcaattctcaattgtagccagtgatactgtcattaatacagtgggtgggcaaggcagacatgtataaaaattgaaaagagcagaaagttgttgaatttagtagtagtcagactggtatggcaacatggtgtgttgctacattctttgacaagatataggtagaaatattatccttattgaagagtgaagtgtaaataccttagaaactttaggtatgtttggaaaaggaacagaccagtttatccctctagctcaacttctgaccatttagccttgtggctaaatgtttatattatactgataccatttgttgcaagatttgtatcaaatatgcaaatcagattgcacagcctcagaacagctctataaattgaggagcaataagacctgcaaaagtaaacatgatgtactgaggctcaagcatgcaaaaagccacatgcgtctcctggcatctgctaccaactcccagctgaggccacatctgaagaacatatcctaaaagaaagtatatccactttctaatgtgaatatataaaatctaatctgctaaaaggaaggaaagtaatgggaacatgtggtggtagtaagaatgattttaacaaagatgcagaggcaatttaatggggggagaaatgtccttttttttttttttttttttgaaatggagtctcactctgtcatccaggctggagtgcagtggcgcaatctcggctcactaaaacctccacctcccaggttcaagccattctcctgtctcagcctcctgagtagctgagactacaggtgtacaccaccacacccagctaacttttgtatttttagtagagatggggtttcaccatgttggccaggatggtctcgatctcctgacctcgtgatccacctgcctcggcctcccagagtgctgggattacaggcatgagccaccgtgcctggccgaaaatgcctttttaacaaatggtcttaggacaactggaaatccacatgcaaaaagacgatcttcactcaaatcacaccacatacaaatgcaatgtgtgaaccttgattaacttctacaatggtgcaaaaaggacaagaaagtttgggggaaaactggggatatttgaatataggatagatactgatgacattataaaattttgttaaatttttggtgtgctggtggttttgtaatcttatgtgagtttatattctaaggttaaaaaaaaactttcaagaatcttaaagactgttgtcttattgttgataatagcactgggtatattaatcctaaaatttgtttgtgtacattacaggacacagcaaatgaataaataatttgatgttcttgggaacagaggttctcactggaagatatacatgtatatgtgtgtgtatatacacatgtgtgtatatatgtgtatatatatgtgcataatacacaaacacatacatacacacacacacacacacacacatatatatacatagagagagagagaatatatgaaaggagaccaggaaaaccttgtgatgagggtgttaattggtgataccagtatgaagaacatagtgtgttccctagttccatccaaagagccaagaagcaagagccctcctgtagcaacgagcaaaactagtgccaagatcttgatttttaaataccattccccactaaaaataaccagcctcattggagaaatgacttattctaggactgagaaggcaaagtacaagatgagcttggaatattttgtactaaggaaggaaggaagtggtcaaagaatgatagggccatgtcaaaaggacacaggatctagttaaaaggaacacccataggccaaattcaggacaatttgagcatcaaagaaaatggcagaacaggattacaaaacactgggttcaaaaaaaaaaatcatgtgtccatagtgatactcattttaaaagaggggtgggggtatgcgaagaaggaaagctcttctttacaaaagactgacaactgttcagtataataacagtgtgacacaataagaaataaatatttggtctctgcctgcagttcttggcacagagcttctaaaacccttttaactccttgagtgatagggataagactgtcttttgttattcatagtaagcccctttcaatcatacctgagttaatgctaatgtgataactcctggaggatggaggctagttgccaaaagaaccaactttgtgattagagggttagaactttcagtcccaccccacaaactccagggagaaaagaggggctgaaggttgagccaattaatcatcaatgatcaatgatttaaccaatcatacttacataatgatgtgtccgtgaaaaccccagccaaaggggtttagagagtttccacactggtgaacaaaaatgcacccacagggagagtagtgcacccaaaactccacagggacagaagttcctgtgctcagacccttctggacttcctccaatgtatcatttcatctggctatttgtttgtatcctttaaaatatccttttaatcaatcggtaataccaaattaactgttttcctgggttctgtgagccatcctagcaaattattgaacctgaggaggggcttgtgggaactccagtttatagccagttggtcagaagttcaggcagtaacctgggatttatgattggtctctaaagtgggaggcagtcttgtgggactgagcccttaacctgtagggtctgcactaactccacatctctagtgtcagaattaagtcatgagacactcagttgatgttagcagagaattgcttggtatggaaaacatacttggtgtcagaattgtgcaagtatagagaaaccattttttccttttaaaaaagaatgacagaattagaaaatcatcattttgcaaccacagtgtaataataaatttaggcaatgatcataatacatcctaaaactaatgcatggaagtttatttaaataaaagcagtatacacacagtctcaaagtatcactgccactacacacttagttacaaaggagaaaaatatctttgcaacaaagagatctggaaaacatcatctgaactaataattaacatcagcatcacaaataaagggacaaattgacatcagctgtgcagtaacctgaatctaattacgaggaaataatcagacaaatccagattttaggaaattttttccgagacagagtctcgctctgtcgcccaggctggagtacagtggtgcaatcttggctcaccgcaacctccgtctcacgggttcaagcaattcttctgcctcagcctcccgagtagctaggattacaggtgcccgccaccacacctggctaattttttgtatttttagtatagatggggtttcactgtgttagccaggatggtctcgatctcttgacctcatgatctgcctgcctcagcctcccaaagtgctgggattacaggcgtgagccactgtgcccaaccaggaaattttgttaagacaatttaactagatccttgtcagctgtcttgtagaatgtctatgtcaatgtgggacccagcaacctttgggagagcaattgttggtgaagagaggtcactccttcccctctccacctcctggggaggggaaaaacgaatgtttttctgctctgaatccaagtgaggaggagcttcataattcacaaaggttagggatgcctacaagaatgggagtggagccagacaggttggatgtctgcttggacaggagacttgctgatgtgaactgtgtacttttctaagcagccaaaaagaacagaggaggcagagctgggagacagagaagagaatggaactgcttgcctatatcctttgtttctcagggcaagaataattgagttcccatgggtcatgtgaattctgtggaatgtgggtgagtcccagttatcttgatatttccccattcaagaagcctctaagtaacaggataccagcagcaacaagctaagtacatcttttggtagtagtcaatagcaggacaaaagaagttgaaccagagcaatcactcacataagaccccagggagtccccaaaagtaacctttggagactcacacctgcaccccattgagaaagccagcactcacctacacctcagagggcaggaacaaccaagcaatatcagccagagaggcaacaaccaccaacaaagagatcaatatgtctcctaggaaaactaatgttatcactcttagaagacatattcatccttcagtctcaacctaagtcttgcccctgtcccatgaagactgctctgaatactgacacagcatgtgaataagatactgcagtgtttctgcacatgtaacccagaacttaaagcataataatttttaaaaagacactgcagtgaagtgactgcccatggcatggatgtgtctttgtgaactggcattcatcaagatagtccaggtctcctccagtccttagtcactcggacacagagaacacttctgagagagacatttcttattcctgcccaagtggttccaataggaccagaggctcactttcccacttctagaaagcccaagactcattttggagcaagtgcaacttggagcataggaatctctttgtgatggtccatctgcctaagacacaacacctagccatcccctctttgactcctgctgcttcaccagtgccctaacacagaaagcagacacaaggtcccaatgtatctcccctggtcactttctttctttctctcctcattctcttgcatttctctcctctcattcaagtcaaaagaagctcttcttagaaattgggagattcaggtgaaactctgctccctctcataatatttgtccagaacactttgcatactctcctaaaatcttaggctttgggaagttaaaaccacaaagatcacttcttctgctctctgccttacctttctttcaagaaatgggcacaagtcagcctaaatgctagaaatggtaataaaatgggggataaaaaacagatggacataataaatcacaataattaccctacaacattttaaaataaatatatcagttaccaaatgagacaaaaacttcacaggataaaagtgaatgcagaatgttgttactgaatgctaaaagagaaaggcttgacctgagacaaaggggaaaagcagatagtttgcctcaatacttttaaagaatcccatcacctttaagagtatatccaaataactggggctagagtaactccttttatttttttactttttaaacttatttatttttaaatagagacagggtctcgctatgttgcccaggctggtttcaaactgctggcctcaagtgattctcctgccttggcctcccaaagtgctgggattacaggcatgagccaccacttccagccacagtaactcttgtatcaaagggagagtttctttagagcagtagcccagtgatttctgaaaatactttggaaacatcttataaatggccgcagaggattgatcctaacacactgggtagtggaggggccatccacatgaaggaatctgaggactaggaagtaatagagtcatatgatgtgctacagctggaaaagtcctagagatcatctagaacaccacctccatttattacttcaagaaactgaagttaacagtgggatgacttccaaagtcacagagagagagcagcaaacccaggttaagaacaaggactcaactgggcttggtggctcaacgcctataatcccagcacttttggagaccaagccaggcagatcacttgaggtcaggagttcaagaccagcctggccaacaaaaatacaaaaattagccgggtgtgatgacacatgactgtggtcccagctactcggaggctgaggcaggagaatcacttgaaccagggagacggaggttgccgtgagccaagatcgtgtcactgcactccagtctgggtgacagagtgagagagactccatcgcaaaaaaaggaaaaagaatgaacaagaactcaattacttttcttaataataactttgtttttaattgtagagatgggggtctcactatgttgcttggactagtcttgaacttcagccttaagccatcctcccgctgcagcctcccaaaatgctgaaattacaagcatgagccactgtgcctggccaataataacttttaactattaaaaaaaatttaaggccacaatcccatatcctagagacaaatttggttaatattttgatcattcttttcctagtaatttttcttataattgtatagatgcatttacatagtgtatacatctgctcaggctgccataacaaaataccataggctggggagcttaaacaacaacaatttattttctcacagtctgaggctggaaagcccaaggtcaatgttcccataaggtttggtttctggtgaacagtctcttcctggcttgcagatggtcacctttttgctgtgtcctcacatggtggagagagcaagctctggtgtctcttcttcttaaatgggccccagccctgtcagattagggctccatccttatgacctcatttaacttttatcacttcctcacaggtcctatgtccaaatacagtcaaactggggactagggcttcaacatatgaatttggaggggacacaatcaagttcatacaattctgccccagccccccataattcatgtctttatccacacaagatacattcattccatcccaacagccccaagtcttaactcattcaatttccacttcaaagtctaaagtcccaagtcttatctaattatcatctaaataagacgagtgatcttgagtaaagagtcatcctaaagcgaaatgcatttccagctataaacctgcgaaaccagacaagttatgtgcttccaaaatacaatcgtagggcagacataggctagacattcccattccaaaagagagaaacagggaagaaaggaaggggtgacaggtcctaagcaagtccaaagcctaccaaggtgaattccattagatctaagactcaagaataattctctttggcttgatatatctgcctccttggcttttcaggagctgcctcactgtgataagcctgccctcttacataatgaagtaaatgaccttgcccccaggtctgtggtgaggggggcagccctgatgacctctgtcacctttgagggtaattctttcctttccctggaaaatagcacagattcacagtcaaatagctctatggtccagtcttctagaacctaagaagtccaacagtctttcttcattcatttctgtcctcttgcattttactacaagcagtaagggaaagccacatcacatcttcaaaacattgcttagaaatttcttctgctaaatatgcaatttaattgctctcaggttctaccttctacaaaacactagaacacaattcagccaagttctttgccaccttataacaaggatcatccttcttccagttatttccttattattattattaactgcttctatctgagatctcacaaaaattgcctttaatatctacactcataccaacattctgatcatgattaattacacattctctaagatggaagttttctctgtagctctcctcttttctttctaagccctcaccagaatcacctttcatgtccatatttctaacaataaccccttcatggaaatctcagttttttctagcatgcacctcaaaactcttccagcctctacccatcacccagttccaaagctacttgcaaattttttggtatttgtttcagcaacaatccacctcttagtaccaaaatctgcagtagtcttcttggattgccttaacgaaatcacttagactgggtgtcttaagtaacagaaatttatttctcacagttctggaggctagaaagtccaagatcaaggggctggctagctgattcaattcctggtgagggctttcttcctggcttacagatggctaccttcttactgtgtcctcacttggtagggatggagctctgctatctcttcttcttatgagggcaccagccctatcagattatgacctcacttaacctttatcacctcctcacaggccctgtctccaaatataataatattgagtgttgaggcttcaatatataaatggggggtagacacaattaagttctcagcaataagtcttaaattgcttatgtatatatatacataaacacacacacacactgagggttttaagttgacccttaaataacataagcttgaactgcatgagtcctcttatggatctttttcaatgagacagatagaaaatgcaggatgtgaaacctgcatatacagagggccaagttttcatataggtgggttcctcagggccaagtgaggaatttgagtatgcacggattttggtacgtgcaggggtcctggaagcaatcccccaagtatactgagggataactgtaatacttttttttttttttaccaagttccatgaaaatgttcctattattcaaagcatgatttttaataaatgcataatattctatcttaaggactattattttttactgctgtttaactattaagtcattttcaaattttgctacttaaataattctgcagtgaacatctttgcacatatatctttgtctgctgtgatgactgaggataaatttccagaaattcagctgctgagtcaaagcctattcctattcaaagacttggtacatattgctaaactgcttcccagaaacctgtaagaaggtatacccccatatgaatagagattataattagaataaactatttttgtaaataaaaaaagatcaatatcataaatgaccaaaaaggcaaagttttgtttttgtattggtttggtttggttttttttgagacagggtctcactctgttacccaggctggggtgcagtggcatgatcacggctcactgcagcctcaatctccccaggctcaggtgatcctcctggctcagtctcccaagtagctgggactacaggtatgcaccactatgcctgactaatttttgtatttttttatagagatgatgttttgccatgttgcccggattggtctagaactcctgggctcaagtgatccacccgtctccaccttgcagagtcctgggattacaggtgtgagccacagtgcgtggccagatttttttttattatattaaagaagactaggccaagtgcggtggttcatgtctgtaatcccagcacttttggaggctgaggtgggcggatcactggaggtcaggagttcaagaacagcctggccaacatagtgaaaccctgtctctactaaaaatacaaaaaaattagctgggagtggtagcatggcctgtagttctagctactcaggaggctgaggcaggagaattggttgaacccaggaggcaaagcttacagccagccaagatcatgccactgcactccagcctggatgatggagcaagactccttctcaagaaaggaaagaaagaaaaaagagaaaagtgaaaagagaaaaggaaaagaaaggaaaaggaaaaggaaaggaaaggaagggaaaggaaagaaggaaggagagagaaagaaaagaacaaagaaaagaaaaggaatgaaggaaagaaggtaggttaaagagacaggacaataaatgaaatgtatggttattgattagatcatggcgggggaaggctatgaaagtatatcaaagagatatctgcactcctatgtttgttgcagcaatgttcgcaataggcaagatttgaaagcagcctaagcttccatcaacagatgaatggaaaaggaaaatgtagtacataaacacaatgtagtactatttatccataaaaaaaaagaatgagatcctgtcatttgcaacaatatggatgaaactggaggacattatgttgtgtgaaataagccaggcacagaaagacaaacttcacatgttctcactcgtttgtgggagctaaaaattaaaacaattgaattcatggagacagagaatagaaggatgattaacagaggctgggaaggggagttaggggtaagaggagattagggacggttaatgcgtacaaaaatagttatctagaatgagtaagatctagtatttgctagcacaatagggtgactatggtcaacaataatttattacacatttttaaataactaaaagagtataactggaatatttgtaacacaaagaaatgataaatgcttgaggtgatggataccccatttaccttgatgtgattattacatattgtatgcccgtatcaaaatactcatgtattccataaatacctactatgtacccataaaaattaaaaaataaataaaattttttaaaatataaaaaaagctttcaaaatatttttggggacaattagggagttcttaatatagactgtattatagacaatattactgtatcagtcttaaatttcttgattgtgatcatggtatttcagttatgttgactttcctagctcttagcagaaacacgctgatgtgttatagcatgtgcagcttatattcaaatgattcagaaaatacttgtatttttgtgtatgtatgtatggagacagagataaagaaacatgagagaaaaataagagggggatgagggaaagagcaaatctggcaaaatgcttgtcactgaacctagtaaagggtaatgagcactcttggtactgttctttcaacttttctataggtttaacatttctcaaaataaaaatatacgagggagcaggcaaaagacaagaatggcttattcacagaaaaataaaatagcctgtaaacatatgaaaaatgtatgggaataaagttgcttgattatttaaggttttttatttcctcctgccctcttggcatttgcgctttaatcgcttcaattatatttcatcaatgagaccaggaaggagtaggaagtaaaatctcaatctttacattttgcttctcattagcagtcgtggaaaaaggtttaaaagattaaatcaatcacaatgaactcattacaatgagttttgaaaaggacctgtaaacctgaaaacctggttttggattcagattcttctgacctcctatgaccttaaatgttcggtcctaaacagcaaaaaacaaaagttagtaataaatcatatgaaaaataggttttctttaaataaagaaaaaaaagttcacctctaccattggcctttacttttatcaggaaagtgggcctatagaatgtaccaaattgaaggcaaccaacagattcacaaaccatggacaaaggttttccttttcagaaacaatatgaaggaatcaatataacacagtggttcacacagaggtaggagctactaagtcagattttctgtgtttgaatatttacttcaccagttactagctatgtgatttgtggcgaattactcaatctatttatgcttcagtttcctgctctcaaaaatgggaacaacagtaaaatctgtcttagggttgttgtgaagtttaaataaattagaatacttaaagtctcagaatggcatctggcatactgtaagacctcaatagtgttagctgctatggtttgtttgtttgtttgtttgtttgttttgaaacagggtcttgctctgttgcccaggctgcagtgcagtggcacaatcatagctcactacagcctcgatttcccaggctcaagccatcctcccacctcagcctcccaagtatctgggactacaggcacatgccatcacacttggttttttttttttttttttttttttttgtagaaatgaggtatctgtttgttgcccaaactggtctcagactcctgggctcaagaaatcctcctgcctcagccttccaaagtgctgggaaccatgcccagcctacagttcttattattactaatattacaacaacaaatgctacaatcattaccatcatcttcaacttgtagttgatggagtttggcatgagattcagaaaaaacagagcaacacaaaagtatcaaaatcccccccccccgcatccccctacacacacacacacacacacatatcacaggttgaaaaagcgaaatagatcagactctaagtcagtcctttagtgtctcaagctgttttgagggaaactggggagagggtaacaatataccaaaaacgtatggctcatttcaataattaatctgtgtgatcttgacaaatcaatctcaggagaaataagtcaatcatttatcaaattttattgaggtatactatgcataggtgttgagccaaatgcaaagaatataaaatggaacaatgtctatgtcttttaaaactttgtgttcatgtcaaagaaatatatatatgtcatatgatggatgtgcacacagtaaaatggaagcacacaggagagacctaagttagacttgggagaaggagaaaacagcacaaagattacccagaagtgatgatatttaaactgagccttaaagaataataacaggtaaacagggatagagggggttaaatcattcctccaggggtagaagctaacaaatgtagaaaaaaagatgagccctactccccccatacaaaaccgaaaaacgtctccctaaagctaatagatagacagccatcagagaaaggcgcctgaacagatgtgcttcaggaatatcttctgcttacacacatgacatctccaccctccccagctcagaataacccatgttcagagaagcgacagaaagctacaattaaaagagattcatagacaagtttctcacttacaacactgggcggcagcagtgggcaatggcttcctctggctttcttcttgactagaatactagaagcagaaaggagaaaataaataaataaatacaatcagaagcccaagtaaagacagggaaaaaaatcacaactacctataaaaaggtttagtgtttggaaacaaaatttttattgaacagaaacagaacatcctgctcctattttctctgtgtgatgttgacatataggccagactattggttatggccctggccaagtgagacaggctaaataaagcaggataatgaagaactgtcctgaccaagggcacctgggcacccacctagctctgccaggcagctggagaaggtttggccttagaatccttagaatatttcacagccctctgagttttcctggggctaatgtatagaagatttccccattcaggtgatgcaagtgaaaacctgtctggggctgttttctcatttttaagtaatagtgcttctttgctcataaggtcacatgggaaataagtggaactgcttacctaagcatgtggtgcaatatctggtatttataagagttcctctcccactagcactgtaacctccgccatcccacccaccacaaccaccacaaaaacaagtacacggtactgaagacataagacaatgttccataaaaggaaaagaattatgtccaaatcttgaggatgggcccgatttagaaggcaaaacagaaagagaaaggcacaaacaaattaacaggggtacacagagtctggaagacagtgagaatagtctggttcagggtccattggataattagaaaaatgtaactcagccaggcaacttgcaaacatgagatttggagttctcatcctgacgtggtcacttattcataagctatgagatctgaggcaagtcaatgcttctctaaaactgccaatgaatgagttacttattaactcaacaaatattgattgagtatccactacgtgcaaggccttgttctaggcactggcaaaacagaatttgtaaatcatggtaagaattcgaacttttctagtgtacttagaagccctttagggttttaagcatgagagaattatgatttgattatacttttaaaagatcaatctggctgctgtatgagatgaactgtagggaacatgagggtaaataattattgcaataatccagacaaaagttgatggtgttgtacgtaacactcttatgagtatcagtggtgaagagcatttcaaatggttgggatccaaaatacaaaacactttttgtatataaaatatactttataagcaatagaatatggtacaaatgtcagaggtagatactgttattactaatttccatggagaataagaaaagtcaagtacaatgtaaacaatatgatagcactagcaaaattgccaatcacaaaaatgttcaaaacatcttttttttttttttttttttttttttttttgatacagattctcactctttctcccaggctggagtgcagtggagctatttcggctcactgcaaccttcgcctcctgggttcaaacaattcttgtgcttcagcctcccgagtagctgggattacaggcgtgagccaccaaacatggctaatatttatattttttataaatatttatataaatatttttataaatatttatataaatattttataaatatttatataaatatttttataaatatttatataaatatttttataaatatttatattttttataaatataaaaaatgggggtttcaccacgttggccaggctggttttgaactcctgacctcaggtgatccacccgcctcagcctcccaaagtgctgggattacaggtgtgagccactgcacccagccaggttcaaaacatcttgaaggtcaaagatccactccaaagtaacaaaaggacttggttataaataatagccactacaaataattatgatttttgtagacagtacatagacataaccatgaggaatcccaaaattttaagtattaagaagaatgcagacctaagagatcagagtagatattttcagaagctatatttaatgaatctctcccaggcccaaaacagaaagcttaagtccaactagagtataattaataatgttaagacagctaagaaaaaagctacaaaatctgtctacaaaaaacagacagggatagtagaagaaaggaaaattacaggccaatttcatttatgaatatagagacaaaaatcctaattaatagattactaggccaaatctatcatattaaataagtgtgtgtaatattcatatgtgaatatgtatgtatatgtgtgcacacatatgtgtgttagcatataaatgtacatatagcctgtccaggtgggtattaaatgctaggccagttcaatatctgaaaatctactcatataattcaccatattaaacagatcaaaagagaaaaactatgtgatcaaacagatgcagaaaaagatgtgataaaaccccatactttttcatgacaaaaatgcttaaaaaataagaaagaaaatagaatttccttaatctgataaagagtatctaccaaaatccatggcaaacagcatactttaaaacttataaagcagtccccttacagtcagaagacagacaaggctctccactcttacaatgttaaaaattatactagatgtcttaggcattgaatgttttaaataaaaggtcatgagaaacaagaaaagtctgagaaaatactacaaccaagagaagcctaaggagacatgacaactaagtgtaatgcaatatcctggatgagatcctgaaataacaaaaaagactcaaggtaaaaactgaggaaatctgaataaactatggaattttagctttattttttagttaataaaataaataaaaaatactctttagttaataataatgtaccaatattagttcattaactgtaacaaatgtatcacactaacaaaactgcctttgcaaaaatcataactaaggaaagtatgacagtgaaagaaatcagacctaaccagttccatcttgcttctaaccattaagctgtccttgttcattcctgggcataggctgaactaacttcgggaaggaattcagttcatggttttgactctgaaacaaaattgataatagctattttccaaaaagacccccttcttgcccggggaccagtctgcctttgcaggactaacaaattagctacaagattagaaatcactttaggggtcatgcagcctctggctccaagagtctgaacctccccaaattgcttctgggaataacatcactattataaaacctaagatccgtgcttgagatattttgcagaccctgcactagatcaatcagctgacaccacccatctggcccaaccagttctgccatcccacccaggaacagaagatagcaagaaaaactcacttctacctgctatgattccatctccgacctaaccaatcagcattccccacttcccaaacccctacctgtcaaattatctttaaaaactctgatgcccgaatgctccaggagactgatttgagtaataataaaactgcagtctcctgcacagctggctctgagtgaattactctttctcctctgcagttcccctgtcttcataaatcagctctgaataggcagcacacaaggtgaacccgttgggcagttacactaatgtaagatgttaataataagggaaactataagatggggtgggggaggggataaatatctgctcaatatttctataaatctaaaacgtctaaaaaatgaagtctgttaataaaaatatatgcgtaaacaggcccagcacaatggctcacgcctgtaatcccagcactttgggagtccaaggcaggcggatcactggagtgccactgcactccagcctgggtgaaagagtaagaatctgtctaagaaaaaatatatataatatatatataatatatatattatattatacataatatatattatattatatataatatatattatattatatatacatatattaatatataatataatataatatatacatatattaatatataatataatatattatattatatacatatattaatatatattatattatatatgtatattatatattatatacgtatattatatataatatatataaataatgtataaacaattcaacacttagaaaaagcgtaaggactaggagaataaaaactgtaatttaaagatgcaaaacctagtcgcacagaaaatctaagggaatctttaaagtatcagaactattaataataagagttgatgagtaagatcaatactttaaaaagatgagcagcaaagcatttacttataatagtaatgtgataaccaactagaaaatgtaatttttagaatgtaccatttgcaacaattagggaaaaaaatctaacaaaagtagtataatacctacatggagaaaaaatatacacccctctgctatagtctgaatgtttgtatcccaccacccctgcccccaccaaaaattcacctgtgtgatggtactaggaggtagggcctttgggagatgattaggtcataagggtggagacttcatgaatggcataagcacccttacaaaagaggctccagagagcatgcttccatcacatgagaacacagcagggtgctgtctatgaaccaggaaatgggccctcaccagacaatgaatgtgccagtgccttgattttagacttcccatcctccagaactataagaaataagtctctgttgtttataagctatccagtttgcattgttatagcaatccaaatagactaagaaatcccctatagcacttctcaccttctaatactcaactatatttattatatttcttgcttactgtctgattctgcctatgtgatccatgagggtagggatcttcaaccactgatgtatattaaacacagaatagtgcatggtacctgatgcgtaataactgatttggtgaataaatgaataaatctcaccaataaacaggaaaatacaaattaaaacaatttctatacttgttagattaacaaaaatttaaaatctgataacatcaagtatcagtaaggaaacagtgaaacaggaaaagggtaaatgtaaattggcacaatcacttcagaaagcaatttagtaatatctactaaggttgaacagagcatatcctacaaccaagcaactatccttccagatatacacccagagactctgtcaaatacaagcatagagaaacaggtccagaaatgttcactgcagcacgcatttataatagtgaaaacctaattgcccatgagtaggaaaagtaatacagtgtggtacaatccaactctgtaaagtggtaggtgcccaaatcagtcttgattagcacttctaggcccacgaggtgtatgggaaacgttacacactgtagaataaaaaagttagactctatattgtatttttaaaatgattttgcagcaagtatgatgaaatcttaataattagtgaatcttaggggtaggtatacacatgggtttccttttattattcctgtatttgtatgtatacttaaatttttttcatgataaaaatagaaaaagagaagagaaaaaagccaacttgaagaaactcccattaaccaaagatgagatcattttagtatcaaaaagaatgtccagcctgggcaacatagcaagaccccacctccacaaaaaaattaaaaactagctaggtgcggtgatgtgtgcctgtagtctctgctacttgggaagctgaactgggaggatcacttgaacctagatattccaggatgtagtgagctatgattgtgccattgcactccagcctggacaacagagcaagaccctgtctccaaaaaagaatgattgcaatgggctgaaatacattatcaaatatacccaaatttataaatacatagtaatattccatttaaaaaagaaaataacttactggtcaccttgagaagttgctgaggcaacagttcattattctaaaaatataaaagagaatgtttttcttatacagactatatttctgtgaactgaatagctggtaacagaaaaaaaattttttttttcttttgagacagagtctcgctctgttgcccaggctggagggcagtggtgcaatctcagctcactgcaagctccgcctcctgggttcacgccaatctcctgcctcagcctcccaagtagctgggactacaggcacctgccaacacgcccggctaattttttgtatttttagtagagacggggtttcactgtgttagccaggatggtctcgatctcctgacctcgtgatccgcccgtctcggcctcccaaagtgctgggattgagaaaattttttttatagacaaatcatagctaataaatgctgaagggataatataattagactatcagaccagccacagtggcttccgcctgaaatcccagcactttgggaggccgaggtgggcagatcacttgaggccaggagtttgagaccagcctgggcaacaaggtgaaaccctgtcactataaaaaaaatacaaaaattagccaggcatggtagtgcacgcctgtaatctcagctactcaggaggctgaggaactcaggaggcggagactgcagcaccactgcacgccagcctgggtgacaaagtaagactgtctcaaataaaaataaataaataaaagaaagaaagaaaatcatttttcagactctaataaaatagtcattattatttgcagctaaaaccattagatgaaaggctgatgggaaaacatcataatgaatgaaatgggctgacaatacttgaatccactgttgaattttaacatcacctctatcacaaaaatgaactataacctaatcttcaaactaatagatgcacttttcagtttaaaggaaataagagagataaaggaacatggtaaataaaacctggggacacaatcagcaaaatccagaatgtgcagaagtctacaaaacagatgagggaaagtgaatgattttacagctaagatgattcaaggagctgagcttggtgtcccatgcttgtaaactcagcactttgggaggccaaggcgggcagatcgcttgagcccagaagtttgcgaccagcctgggcaaatggtgaaacaccatctctacaaaaaatacaaaaataaaataaagtaaaatgatttaagagacatgacagccaaatgggcacatcttatctggctcttgaaatgaaaaaatcaactatgaaaacacatcttctagataataaagaaaattgaaaagactaggtattggatgacactaagaaattattaagttcagtgtgataatggcattgtggtttttttttaaaaaaaagtattatctgttagagatctatattgatatatttatgggtgagacaagataatacctaggattgttttttgtttttgatagggaatctcgctctgtcactcagcctggagtgcagtgatgtgatctcggctcactgtagcctctgcctcctaggttcaagtgattctcctgcctcagcctcccaagtaggtgggaatacaggttcccaccaccacgccaagctaatttttgtatttttagtagagacgggttttcaccatgttggtcaggctggtcttgaaatcctgacctcaagtggtctgaccacctcggcccccccagagtgctgggattactggcatgagccaacacacccggctggattggttttaaaatactccagcaaaaaatggaagagtaggccgggcgcggtgactcacgcctgtaatcccagcactttgggaggccgaggcgggcggatcacgaggtcagaggatcgagaccgtcctggctaacacggtgaaaccctgtctctactaaaagatacaaaaaaattagccgggtgcggtggcgggtgccagtagtcccagctactccggaggctgaggcaggagaatggcatgaacccgggaggtggagcttgcagtgagcagagatcgcgccactgcactccagcctgggcaacagagtgagattccttctcaaaaaaaaaaaaaaaaaaaaaaaggaagagtaactctacattttttcatgcttcaaaatttccataataaaaaagtttttaaatggaatagcaaccaaaatgagagaccacttcatacatgctaagaatcgaagaatggatataataaaaaagataataacaagtgttgacaagaatatgaagaaattgaaacccttatacactgctggtaggagtataaaatgtcatagccactttggaaaataggctggcagtctatcagttaaatgcagagttaccatgtgatctagcaattccactcccaagtcatacgcaagagaagtgaaaacatatgtccacacaacattttgtatataaacattcgaagcagcattatccataacagctaacaagcagagaaacaacccaactgtccatcaactaatgaatgaatttaaaatgtactacatccatacaatggaatgttatttggcaataaaaaggaatttatttacatggtaaaacaagaatgaaaccttgaaaacattatgctaagtgaaagaaaacaaaggaccacatgttatataatttcatttatatgaaatgcacagaataggtccatagagacagaaggttgattagtggttgtatagggctgaggaggatagggaagaatggagactgatgactaagggcacagggtttctttacggggcaatgaaaatattcaaaattgtggtgatatccatgggcacaactatgaagctagtaaaagccactgaattgtaagctttaaatgagtgaactgtatggtatatataaattatatttcaacaaagctgctaaaaagataaacagcacagtggaagaaagacgaaagataaaaacttagtgaatgccataccctagaataaaaacagaaggcaaaaatctgatttggagttgtggtgatatccatagggcacaactatgaagatactgaaagccaccgaattgtaagctttagatgagtgaactgtacagtatataaaaattatatttcaataaaactgctaaaaagataaacagcacagtggaagagaggatgaaagatgaaaatgtagtgagtgccataccctagaataaaaacagaaagcaacaaagatactcctcgagaagagcaactccaagacacataattgtcagattcaccaaagttgaaatgaaggaaataatgttaagggcagccagagagaaaggtcgggttacccacaaagggaagcccatcagactaacagtggatctctcggcagaaactctgcaagccagaagagagtgggggccaatattcaacattcttaaagaaaagaattttcaaccagaatttcatatccagccaaactaagcttcataagtgaaggagaaataaaatactttacagacaagcaaatgctgagagattttgtcaccaccaggcatgccctacaagagctcctgaaggaagcactaaacatggaaaggaacaaccggtaccagccactgcaaaaacatgctaaattgtaaggaccatcgatgctaggaagaaactgcatcaactaacgagcaaactaaccagctaacatcataatgacaggatcaaattcacaagtaacaatattaaccttaaatgtaaatgggctaaatgctccaattaaaagacacagactggcaaattggataaagagtcaagactcatcaatgtgctgtactcaggaagcccgtcgcatgtgcagagacacacatagactcaaaataaagggatggaggaagatctaccaagcaaaaggaaaacaaaaaaaggcaggggttgcaatcctagtctctgataaaacagactttaaaccaacaaagatcaaaagagacaaagaaggccattacataatgggaaagggatcaattcaacaagaagagctaactatcttaaatatacatgcacccaatacaggagcacccagattcataaagcaagtccttagagacctacaaagagacttagactcctacacaataataatgggagactttaacacccactgtcaacaatagacagctcaacgagacagaaagttaacaaggatatccaggaattgaactcagctctgcaccaagcagatctaatagacatctacagaactctccaccccaaatcaacagaatatacattctcctcagcaccacaccgcacttactctaaaattgaccacatagttggaagtaaagcattcctcagcaaatgtaaaagaacagaaattataacaaactgtctctcagaccacagtgcaatcaaactagaactcaggagtaataaactcattcaaaaccgctcaactacatggaaactcaacaacctgctcctgaatgactactgggtacataatgaaatgaaggcagaaataaagatgttctttgaaaccaacgagaacaaagacacaacgaaccagaatctctgggacacattcaaagcaatgtgtagagggaaatttatagcactaaatggccacaagagaaagcaggaaagatctaaaattcacaccctaacatcacaattaaaaggactagagaagcaagagcaaacacattcaaaagctagcagaaggcaagaaataactaagaacagagcagaactgaaggacatagagacacaaaaaacccttcaaaaaaatcaatgaatccaggagctggttttttgaaaaaatcaacaaaattgatagactgctagcaagactaataaagaagaaaagagagaagaatcaaatagacacagtaaaaaatgataaaggagatatcaccactgatcccacagaaatacaaactaccatcagagaatactataaacacctctacgcaaataaactagaaaatctagaagaaaaggataaattcctcgacacatacaccattccaagaatgaaccaggaagaagttgaatctctgaatagaccaataacaggctttgaaattgaggcaataattaatagcttaccaaccaaaaaaagtccaggaccagacagattcacagccgaattctaccagaggtacaaggaggagctggtaccattccttctgaaactattccaatcaatagaaaaagagggaatcctccctaactcattttatgaggccagcatcatcctgataccaaagcctggcagagacacaacaaaaagagagaattttagaccaatatccctgatgaacattgacgcaaaaatccttaataaaatactgacaaactgaatccagcagcacatcaaaaagcttatccaccatgattaagtgggcttcatccctgggatgcaagactggttcaacatacacaaatcaataaatctaattcagcatataaacagaaccaaagacaaaaaccacatgattatctcaatagatgcagaaaaggtctttgacaaaattgaacagcccttcatgctaaaaactctcaataaattaggtactgatgggacgtatctcaaaataataagagctatctatgacaaacccacagccaatatcatactgaatgggcaaaaactggaagcattccctttgaaaactggcacaagacagggatgccctctctcaccactcctattcaacatagcgttggaagttctggccagggcaatcaggcaggacaaagaaataaagggtattcaattagaaaaagaggaaatcaaattgtccctgtttgcagatgacatgattgtatatctagaaaaccccactgtctcagcccaaaatctccttaagctgataagcaacttcagcaaagtctcaggatacaaaatcaatgtgcaaaaatcacaagcattcctgtacaccaataacagacaaacagagagccaaatcatgagtgaactcccattcacagttgcttcaaagagaataaaatacctaggaatccaacttacaagggatgtgaaggacctcttcaaggagaactacaaaccactgctcaacaaaataaaaaaggatataaacaaatggaagaacattccatgctcatgaataggaagaatcaatatcatgaaaatggccatactgcccaaggtaatttatagattcaatgccatccccccatcaagctaccaatgactttcttcacagaattggaaaaaactactttaaagttcatatggaaccaaaaaagagcccacattgccaagtcaatcctaagccaaaagaacaaagctggaggcatcatgctacctgacttcaaactatattacaaggctacggtaattaaaacagcatggtactggtaccaaaacagagatatagatcaatggaacaaaacagagccctcagaagtaataccacacatctacaaccatctgatctttgacaaacctgacaaacacaagaaatgggaaaaggattccctattcaacaaatggtgctgggaaaactggctagccatatgtagaaagctgaaactggatcccttccttacaccttatacaaaaattaattcaagatggattaaagacttaaatgttagacctaaaatcataaaaaccctagaagaaaacctaggcgataccattcaggacataggcatgggcaaggacttcatgactaaaacaccaaaagcaatagcaacaaaagccaaaattgacaaatgggatctaattaaactaaagagcttctgcacagcaaaagaaactaccatcagagtcaacaggcaacctacagaatgggagaaaatttttgcaatctactcctctgacaaagggctaatatccagaatctacaatgaactcaaacaaatttacaagaaaaaaaaaacaaccccatcaacaagtgggcaaaggacatgaacaggcacttctcaaaagaagacatttatgcagccaacagacacatgaaaaaatgctcatcatcactggccatcagagaaatgcaaatcaaaaccacaatgacataccatctcacaccagttagaatggcgatcattaaaaagtcaggaaacaacaggtgctggagaggatgtggagaaataggaacacttttacactgttggtgggactggaaactggttcaaccattgtggaatacagtgtggcgattcctcagggatctagaactagaaataccatctgactcagccatcccattactgggtatagacccaaaggattataaatcatgctgctataaagacacatgcatgcgtatgtttattgcggcactattcacaatagcaaagacctggaaccaacccaaatgtccaacaatgatagactggattaagaaaatgtggcacatatacaccatggaatactatacagccataaaaaatgatgagttcatgtcctttgtagggacatggatgaagctggaaaccatcattctcagcaaactatcaccaaggacaaaaaaccaaacatcgcatgttctcactcacaggtgggaattgaacaatgagaacacttggacacaggaaggggaacatcacacactggggcctgttgtggggtggggggagggggggagggatagcattaggagatatacctaatgtaaatgacgagttaatgggtgcagcacaccaacatggcacatgtatacatatgtaacaaacctgcacattgtgcacatgtaccctaaaacttaaagtataaaaataataaaattaaaaaaaaaaaacagaaagcaaaaatctgatatgcagttgggaaccacagaccaagaaccattattattagaacttataaaattccacaatttttgtataagttatatttggtttttaaattgttttaatcccttcttctgattctgtataatgacacagagcaaagcctataaaacgaaaagtacaacatgcttctttactaggaaaacaaagatgatggcagtctgaaaggctgaataccactccacagccaggcttgggaagaacgaaaacacaaagtaaagtacatgcaaagatagcacaaatgctcagagttactaagtggagaaagaggactggagctttcaacaatgaagaaaagttaggatgttggtgtggacatgagaagagttatacagcttaataacagaaagcctaccaagaataaaggaggtaacggaaaaccctgaaaagagtagatgttgcttgtcccaaatgccatttcttcatctttcatttaactcactgtgggttgaactatgtcctaaaagatatgttagacttctaaccctaagtatctgtgaatatgaccttatttggaaacaaggtctctgcagatataatcaaattaattcaatgactgttgttcttacaagaaaaatggaaatttagacacagacacacagagacaggagaatgcattgtgaagacacagacagacacacagggaggcacattacaacagaggcagagattagaatgatacatctacaagctaaggaacagcaaggactgccagcaaccatcagaggcagaagagtacaggatgcttcctccttcagagcctctagacggagctgaactgatcctgctgacagcctaatttcagacttccagtctacagaactgtgtgaaaacaaattttggttgctgtaagccacctagtttgtggtactttgtgatggcagctgtaggaaacaaatacagtcatcaaaccactgcattttggctttctgtactagtctatggatgtatactcgtcatcaatcaccaaatccaatagctctatttcataattcacttgatttaacatgtgatactgtcaagaatttctgccttgaatctctttttttctttgttccattaatctttcctggttatcttattctctctctttaaggttgccctttctcagtctcctttgtttctcagaattctatgtctaaggtttcccaagattttgttcctgttctttaatactgtctccatacgctctacctgagcaagtttttccattcctatgacttcaattgttactaatatattaatgaagctctatgcctacagctccctacccattcaaacctcaacttcaaattatctcatgaaattgtttatcaacaatttctgctgaaatatcctctggcactcaaagtatatcttataatcagacccattttttagtagcccacatgtccaaaataaacaaatttatcatcttttccctccatcagcaataacaaaaacattctccaatcctgatgccccaggttgagctgaatgcattctcttatacacaccagcctcatctctggaggtaagttaggaccagcaagaacaaacaatgcaatagtctaaacatcctcaaaaacaggacacaaataagaataatatccaaaaaactgagagacagtagaagcaaaagaaatgcctccaactcacaggtgtaacaaaagaggacagattccctggtacaagctccctctctaagagtctacagccagactagtaccacagtatgggagagtgggaagaacagaataaattggagatggaaccttctagtgacatttcaggcaatcttctagctgccttttttcttcaatgcaatttaagtgatttcattctcaggacaacatgctcttgggcccctccctgggcaacctataaagagcattggagattttcccccatctctctatactgcaaataaggctgctcctacctcattgtcagctcccaaggcattgatttgctcccatttgtaggtccaatatctggcttcctcctctgggatatctaccataaaaaaaagaagaaaaagaaaagaaatcacatcagcaggtaataaatcatcagcagataacactttactctgtctaatgactgaagtcagaaggtggtagtgatgcacaagttttaactgatggtttggttcttgtcatgaacattatctttactcttcacaaaaaccaatacaatgtactgttattcccattgttattttgtagatgaagaagctgaagctcagagagctaaaataatctggtcagggtcacagtttataaagagatgagccatgattcaaaccatggtttgtatgattccaaaaactacattctttctatgtaaccatactaccttcccctcagcaagaccaaaaccatccaaaggattagcttaaaagaaaagttatatgctgagatattgagatgctcaaaattcaaaggttttctcccaaaaaaattaaaagtagaattaccatgtgacatagttctcccactttggattatatatacgaaagaggtgaaagcaggatctcaaagagatatgtgcacacccaagttcctagtagcattattcacaatagccaagagttgaagcaacccaagtgtccactaatggatgaaaggattaacaaaatgagagatttacatacaacggagcattattcagccttaaaaggaagaaaatcctgccacatgccataacatggataaactttgaggacattacactaaatgaaatgagtccatcacaaaaaagacaaatactgtatgatttcacttctctaaggtaactaaagtagtcaaattcacagaaaagaaagaatggtcgttgccagtggctgtggggagggggaaatgagaagttgtttgatggagacagagttttagttttgcaaggtgaaaaagttctggatatctgttgcacaacaatgtgaatgtacttaacactagtgaactgtacacttaaaaatggttaagatgctaaattttcagttatgtctcttaccacaattaaaaattttttaaaagaagctattaaaaaatactcacaggttttatgcctggaaaatattagatgctcaaatatttgttaagtgagtctctaagtgaaaatatttgaattcttaaaaaataatggtataatggtatatcctcattcctaaacattttacattgactataacaacttctccccaaaactcaccttttaaaaacatcaagtatgaccatctaaccagcactgaagagaaacactcaggcaatatatggatcatatcaacttcagagacatttcaacagatacactttctagtagccacatgaataaagcaaatatagccctttcctttctccttggttccacctgtccaaaacttcagctccttcccttcaactagctctttaacaactggtagcaatatttcaaagtcttatttaaaaacacttacacacaccttcaaatagtctacaacgtaatttgtatagtgctttctcatccatatggtacacccataaaatggtatactatgcacctgttacaaagaaggagagtgggaagtgcaaggtggcagaggagctgctgctgctgcaggtctatatgctctgatgtgggatgattcaccaagatatactaagtgcaaaacagcaaggcacagggaatgtgttagaatatgctactatttgcgttttaaaaagaagatggtggtgtgtgtgtgtgtgtgtgtgtgtgtgtgtgtgtgtgtgcttatattcagaaactgactctggaaagatacacaagaaagtattaatagtggtagcctataggaagaaaatggatttctgaagggacttttcactggataactttttaaaccattattaatttattcctgcctcattccacaaaaatagttttaagaagaaaaaaatacagagagatacaagcatgtttattgcagtgctatttataacagtacaaacttcaaacaatcaaaatacccaacaggaagtggttaaatgtattatacaaatagttaaaattaaaagcccaggctctagagtcagaccatggccaaaatacttaaatactctctgccatagtttgcttatctctaaagtggggaataatagttgggcctgcctcaaaggactgaaatgaggattactgagctaacatatgtaaatacttagtgacatgcccaccaacacacaataattcaccataaatgttactttgttattactgattttttttttttttttgagacagagtcttgctctatcacctaggctggagagcagtggtggaatctcagctcactgcaacctccatgcctcctgggttcaagtgattctcctgcctcagcctcctaagtagctgagattacaggcgcacgacaccttgcccagctaattttttgtatttttagtagaaatggggtttcaccatgttggtcaggctggtcttgaactcctgacctcatgatccacccacctcagcctcccaaaatgctgggattacaggtgtgagccaccatgccaggccctgatttttaaataaaatcaactactaaaagtagaagaataatgtctattttatataacatttgtaactatgtaattagtgagtgaaatcagtcaaaaagtaatacaacattaaaaaaacaacgatttaaagtctctggaaatggttctaagtgcatacagcaaaagaaaaaacatttattcaagaatatctactaaaatttggtgaaaatggtcaatatctgtggtatttgaaccaagacccactccctccaattgattttcccttcacttgcagcttggtctacagtcccacaagaaagacttcctttctatttttctgaaataatagttgttctgagtttagttctttctgagctagctggaaaatcatgtcatttttgcttaaatcaccataggatacaagatacaaatacactgagatcataaaatgacagcaataacaatagaatatgcaaatatcaataatatgaacagtaaaaaattaaaataaaactaatagaaatcaactaaactaaaacaagatactgttgcgggaagtcagggaccctgaacagagggacaggctgaagccatggcagaagaacataaattgtgaagatttcatggacatttattagttccccaaattaatacttttataatttcttaagcctgtctttactgcaatctctgaacataaattgtgaagatttcatggacacttatcacttccccaatcaatactcgagatttcctatgcctgtctttactttaatctcttaatcccgtcatctttgtaagctgaggttgaatgtggcctcaggaccctgtgaggattgtgttaactgcacaaattgtttaaataatatgaaatctgggcaccttgaaaaaagaacaggataacagcgatgttcagggaaaaagagagataaccttgaagtctggctgcctgtgggccgggcggaacagagccatatttctcttctttcaaaagcaaacaggagaaatattgctgaattctttttctcagcaaggaacatccctgagaaagagaatgtgtccctaaggggaggcctctgaaatggctgctttggggacgtctgtcttttacggttgtagataagggatgaaataagccctggtctcctgtagtgctcccaggcttattaggacaaggaaattcctgcctaataaattttggtcagaccagttgtctgctctcaaagcctgtctcctgataaaatgttatcaatgacaatgcatgcccgaaacttcattagcaattttaatttcgccccagtcctgtgatctcgctctgcctccatttaccttgtgatattttattaccttgtgaagcatgtgatctctgtgacccacaccctattcgtacactccctcctcttttgagaatcaccaataaaaacttgctggttttgtggcttggggggcatcacagaacctgccgacatgtgacgtctcccctggacacccagctttaaaatttccctcttttgtactctttccctttatttcttagaccggccaacacttaggaaaaatggaaaaggacccacgtgaaatatcgggggctgaatttcccctgataagatatcatacaaaataatcaaataaagattaaccattgggaaacacaaaagactgccaaggatgtgcagaaacaggcactccccagatataatttataagagtataaattggtataaccttttggacaaggaacttagtagattccataaaaagtaatgatgtacttatactttgatccagcaattctactttaagaaatttattctagactcaaaatgggcaaagatatacagagttattagtttgcggtatataacatcaaaaaaaaaaaaaaatgaaaaaacccacctgtcaatcaataaaggattacttaaataaattatggtaggccaggcatggtggctcacgcttgtaattccagcactttaggaagcagaggtgggcggatcgtttgaggtcaggagttcaagaccagcctgaccaacatggtgaaaccctgtctctactaaaaattacaaaaaattagccaggtgtggtagcacaagcctgtaatctcagtgactcaggaggctgagacatgagaattacttgaacccaggaggcagaggttgcagtgagccaagatcatgccactgccctaaagcctgggcagagcaagactccatctcaaaaaaaggaaaaaaaaaaaaaagataaattatggtagaggcatctgttcagatgaataagacagatcttaaagtataacatggagcgatgttcaggataaatgtctaagcagtttgtaaaacactatatatcagcaaataaatattacatagggtatgatccaaattttgccaaaataagtttttggaaaataaatatcatgtgtctaaaccaaaatacaagaatgttaacagtggtttcacactggagaatgcagagaagattaaaggaactgggaaaataaacttttaactttatccatgtacatttccttactatttgaatttttatcatgagcatgtattgtgatttaatttacattttaaattattattctatttatcagtgctatttaatacttaaattaacaaatcagaaggtatatatagtcacttcaagacaataaatgtttattttcaaaataataaatctaacaagcaaatatttcataagtcattataataaatagtcacagaaaattaaatgagttgaagagaatgctttttagtgtagattctttaatgagcactattctatattctactttgcaccattccctgggtgaagtgttatgagaaagagagtgaatgaagacaaaatatcctcaaaggagatggctgaggtgacaaaatatacattaatgaaacaactagcaaacaattccaaacaatatggtaaaaattattaaatagttttaaaattttactcaccaaaaggcaactcaaatcttgtatcaagcaaaattttatgaggagttgggtttctagttccacagatctcatcgtctttcattaacgtctctgcctctaatgtggaccattccccaggcccttcctaggaaacaaagatctaagattaaagtttaatctttcttggctccctcttagttcaagagtcaggtttttttctctgaagttccttgtttgagcttctgagggccattcacatcctgataaggcaaacacaccactatcaccacctgcctccactgcatgtggcttctgttttccctctttggtggggagagcagctttcactgtgctcagctctgcaggtctaacgaggacagaatgtctggagtaccatactctaaaactaagtacctctgtggatcaatatttaacctgcacagttcttaatgactgtgtcactgtttctagtcagtaaaaagctactaacattgctggctaaataggattgaactggggcagcaatgaaaatgaactgcccatctgcctggggagtagagacttagctagaactaaaagaaatacagaaaatacaggcaatttcaacttccccactcccagagaaaactcatggtccatgttaacaccaaacaggaatataacagattttgtccaggtccaaagtggggaaatgatgctgagttatggtctagtctaggaaagtgaggcaagagttcaatcctagaaataacgtatagagacagtgtgaatacaaattgccaagcctggtagttccttaaactctgtcaggcttacatgcagaagaagggcactgaaaactagttccttggagattggtaactcaaagaaacaaagcagagaatagccagccagctggctaaggaagtttaatgggactcctcccagggcagtgacttagaagagaacacagaaaccacaagtaccctaagtaaacacacacaccgacacacacatacctcagaaggggctatctacctgataaggctgaagaggtgctctggagcctgtgagttgtcacaggacacagggtaggccagacataaataaaatcatctgaaccttcaggtgaagttaggaacaggcaggttgcatgccctctaattagaaagggggaagaataatccaagatgcatggatgaatattagctaaagtggagctagcatggggagaagcatgggctgggaaccatacttccaaacagaaaatgcaatgactgacctcatccgactgacgaatagtcttcagcgcaatccacacagtccccaccatggtgtcccagatcagtcctttgttccatacctccacacttagacccaggtccaggcgactaatctcactaagggaaagaggaaagccctttgaggaaagctagacaatatgaaagaaacaactacatctcctgttttgctaaactttgaatgctttctcaccaggatcctgtcttcaggaaaaatcaaaatttcccagaatgccacgaccatttttaggctccaagaaacctataataggtatccatagaaaactgcctttgttacagttaaataagttccagagacctgctgctataccacatagtgcctccagttagcaataaggtattgtgcacctcaaaatttaagagggtagatttcatattaaatgctcttaacacacacatacaacaaaaaaaaggagacacaagtaaacttttagaggtgataaatatatttactaccttgattatggtgatggtaacacaagtatataaatgtctaaattgtatacattaattatgtacagtttcttatatcccaattaaacctcagtggggagggggggcgggaaaagaaagaaaaatgcctttgtctatccattctttccgctttggagatacaatcataattagactaatgcagtttcacacaatatgaggccaagtaataaggacattattgccaggcctgcctgccaatttccacccataggcaacagttttatatgttttattgttaactaacactgcttcaacttaaactacacatcgtatacaggaaacttttaggaaaggtaagtctactttacaagatttatcaggctgggcatggtggctcaagcctgtaatcccagcactttgggaggtgcacagatcacctgaggtcaggagtttgagaccagcttggccaacgttgcaaaaccctgtctctactaaaaatacaaaaattagctgggcatggtggtgcacacctgtaatcccagctacttgggaggctgaggcacaagaatcacttgaacccaggaggcagagccaagatcacgccactgcactccagcctgagtgacagagccagactccatccccaccaaaaaagccggggcggggcgggggggatttatgaaagggagtccaggtagaagtagggtccctgagaacatataagtttgataggaacatgtggtcacaggcaagtgaggggctctagagtgtgctagttcacaccactcagtccctggagactcattaatcattattaagctaggcactgtcacttataagcaaaattattaccatgggataatgataaatacaatgattttcctataataataaccaggggaaaaaattcgaaaagaaatcattccataaagagccagataagcactatttaaaagcagtatcatacatggttgaatatctgcttggaaggactaactcaaacataatcccagtattaaactagaatacgcaaatagtacctgtgttaatgctaaaaacgttctccagaaagctcttattgaaacacaaggttacttgaggggtaatccaagaaagatgagaaaagaccaattccagcagagaaagcagaaaggcattctcaggaaaacaacagctatttatcacaagtagaagcttcaagtctgtactttagagaaagcttgggttccctgttgtgctataaaataaatgttctcagattcacaagtttgagatatagaatgacagccacagaattcatgtcaggtgttgaaaatgaataaagcaaagaaaatttgtcccttttatataaatataatacagcatagaatgtactgagttaatttattcatttaattagcatttcctgagcacttacaagacatatgacttagtgctttggagtagaaacataatataggactcagtttttgtgtccaaaaacttctaagctatctggagagctgttcagagccacaaagtagatgaataagcctagccactaagttacagtgttcacagtggagaaactaagctttttgtcacataatttaattcagcctaattaaccaattagtcttggaaaagatatgtgacatcctcaaatccattggacttatccatcatttgaatatggaatcgaaaaattgcttgggccaggtgcaatggctcatgcctgtaatctcagtatgttgggaggctgaggtgggaagatcactggagcccaggagtttgagaccagcctggacaacatggcaaaacctagtgtctcccagaaaaattttttttaattagctagacatggtggcatgcatctgtagtcccagttactcaggaggctgaggcaggaaaatcatttgagcccaggagatcaaggctgcagtgagccaagatgctgccactgcactccagcctgggcaacagagtgagaccctgtcccacaaaataaagaaaaaaagaaatttgcttggggatacatatataatattcccaaatcaactcccaaatagcatctcaagccaacagacagaagaaatagccagaggtcttcaacagcttgacttgaacagataaagaagaaaatctgctcttcagagaactctctagggagaaggcccaaacaatgagtatatattctataagaagcttctcatctcacctacatttgctcagcaggtccagctaagagaggtctgagagctctgtttatgcttcatacccaggaccctagggaagtttcttttctgttaattcaatcaacaatatacataaacacgtgtatagcagactctgggctacacaaatgcacacaaatagtgaagatgcccaccttacccttaagaaatgaacaatctaatcctaaaaacaagatatgaaaatattaaaaacaaataatataagaaataccaaaacgaatattagatactgccacataatacatcatggagaaggaaaaaggagaacgggagataggaaaccagcactggagattccggtgacaaaaggacagggtagtagactaagttctgcaaggagtgaaccaaaaaaaataagtaaataactaaaataggacaggataggaggaataaggagtaggaagagcagaaaagtagagaaagtagctaataaaacccacgtgtaaaagaagagggcaaaattcacacagcatctcaacgtgggagagacaggaagaaaattcacacatatcacagcagggtcaaaaggggaagtgctatgggaaattggaaaataaacacataagaataatgctggctatgctgatgagaggctgcagaagatcactgtgcctcatatgatgggaagagttataactggaaattatggttatagccaactggaagtgctaggtttataaaccatagccaggactatggctaacatactggtatggaaagagacttgcataaaccatttgtagctgactctgtacactgcatgtgtaaagaaggaaacaggtgctctcggtctcatatcactgtcactgagagagggaataaatgaggcttatataatcttgagagagaagcaaccagtgagaaagaaacatgacaccattggcctccttctctttgaagcccagttctccctcagcttccaagacaccattatctcctggctctcctacctctctgttcaatcctttttagttccctctgtcccctcattaaatgctgccactctccagcttctactccagtcccttttctcaccatacacattctctccctaagctttctcatcttcacctatggcttcaactgaccaaaatatttctccaaagcagacttcttccctgagtgccagctttaggtttctaactatcttctgtacctctcatccttcctatctgtcctataagaatctcaaatataagattgtccataactgatattaatccctatcctactgaatggcataccacccaacccatcttccaagaaaatgttttggttctacttcctgaataccttctattcatccttttctacgtcttctgctattgtcctagcccaaaaccttataatctttgcctttaactatcacaataatggtcctataggaagcaatataagctgggtgcagtggctaacacctgtaatcccacagctttgggaggccaaggcgggaagattgcttgagcccaggagtttgagatcagcctgggcaacatagtgaaaccccatctttacaaaaaataaaaacattagccaaggtgtgatggtacatgcttgtagtttccattactcaggaggctaaggcaagaagatcgctcaagcccaggagttagaggctgcagtaaactatgatcataccaccacactctaggatgggtgagagagtgagatcctgcctcaaaaaaaaaaaaaaaaaaaaagcagcaatataccaagagcccagaggattggaaatgtctccccttaaaaataataaccatccctatgtccctctgagctgcactataaaacatgcaaatcgatttcagttcagtttcaaatttcacagcaaatttcagtacgttttctcattcagccccttcatgcccacctccaactcccagaaaaaacaagcataatcttctgagaaaggaagacctttacagataaggaaactagtgccctatgaagctaaatgatttgcccagtccttcaatatattctatacttttctccccttttgtagaacaggaacaaaaaaatcctgaaactaaagggacaaaagaaagaaataacaagtttttaaagccaaagtttaattaaaatcataatatactaaactttgtcatacacgagaaattctactaatatttattcattttaattaattgaatataggacattttactccataaagcaaaaggattataagcacagaaatcttcagcctctaaaacagatgactgaggtacacatgaagatacagtctctcacatgcatggccacattccttcaaagagccttctcagaatcaaagaaagatgaagttatgtttaatgtcatgctaagtctgttgtactgtattctaattctgaccactgagaaaatctgcctatgtagtttttcaccaacacaaatcaattgggagtttacctgcattatcattcatctctaagaacaaattacgaatccatgagaaaacaaaactgcagttgtgcttcatgtaccatgaacctcacttatttctataactccacagttttcaaaacagtatttaacagtgccagtacattttataaatctcaaaaatacacaaaatcttctaattgtttcatccaatgcaattcccttaaaaagattataaaatatgtaggcacactgctgctgcaaaatacttacaacatgaaatcctgttcccaggaaggctgatcaccacgaactgctacagttgtgctcttcacattctgtactttcagggtcacatatgtgttaaatttatctttgaaaaaatacaaaatggagacataatacttagtgctcagattgttacccatctcacaaagcccttggaattaagcaatatagaaattaaagtattacatgtgcaggaaaaaattaagctatattgtacaacatagcctcattcaagacatagcagagttgccgaaattataaaactacgtgctatcttcaagagcataatctaaaatactatttttttaattttaagaaattttatatatgacccaacagatatgcatacacacacactcaaactgaaacagattcatgaatgccaagatatgatacattgatatttcctgttctaatttatttaatctattacaatgttaatcctaacctactatgttaattatatagcccacttgccatctggggggaaaaatccaaatctaattgacctactaggaaagataaggtacgtaaatttaataaaatgtagaaagagatacataccagaaggaaaaaagaaaaagtgataaagaactgcagagctgagctgttaacagggacaaaaattaaggaaaaatcttcacaaagaaaatagatttcaagctcgatctactcagtttggcctaaagcacaagttacataaaaagaaatcttttttttttttttttttttttgagacagagtcttgctgtgtcacccagaccagggtgcagtggcatgatcttggctcactgcaacctctacctaccaggttcaagcaattctcatgcctcagctacccaagtagctgggattataggtgtgcgccaccatgcccagctaacttttgtatttttagtagagatggggtttcaccacgttggccaggcggtctcaaatgcctgacctcaagtgatctacccatcttggcctccaaaagtgctgggattacaagcatgagccaccaggcccagccaaaaaaagaaatattatcacagagttgagaaaaggaaattctctaacctgagagttgagtactaaacaagttgattactaaacaaaggtggtggcctgaaacttcaaactcaggtgtctcacctaattcttattacagcacatttggcactcacctcactacatccacatcagccatgattaggggcactgaattgagggtttgcttttctatgtaagaaattaatcctaatgttatacaatgaaaaaatagcaaactatcactttgactcatcaaattggcaaacattgcttaacatgattacctaatgttacagaagatatgagaaaatggaacccgtcatacactttcagctgaaggtaagtctttcttttaaatatcatttaaaatggtgtggttttatacttatcaacatggaaaatttataattatattaaagatatatgaggataaaagcccatacaaggggaatctccatccatatccagtagtagtagtagtgcagtaggccactgagctatgttttatattacattattttgtactccaccccaacatccaatcacacatagctgaccagaccaagagtaaataacccaagagcagccaatccatgagctggccaaaagctgaaacaaacctgattccctctcaaaagattttaaatagggtaaaaagataaatattgacaattggtggttggtgctgaagctaaaaggaaggggtataaattccactgaggcagctattatgggtacaagatgggtaagcatagaaaaccagctgggagagaaacaacagagcagattctcagaaaaaaagagccagcagagacaaaaagataataacctttaaaacaagaaactgctcagaaactgctttcattactgttgcacccaaggtccagtttttcaggttttcctgggttctcaagcgtattcatatatttccagtaaccctccagctcccctccctccttccccagcagtaaccagaggaagtcttcctaatgtgacaatcaaaattgaggaaatgcacattaaaataaggaaataccatttttaatcttcagatggacagagattttaaagtttcatatcaaatgttgataaggatttgggaaaataaatgttcataaacttttggtctcggtatatatagtaaaaacttgcaagagaacaatttggcaggagttaccaaatttttaaaaatatatatacacttttgacccagcaattctacttctgaatctagtacatagacacatttgcaaaagcaagcaatgagaagtgcacaagaacatttattatttgtaatagcaaaaacttgggaacctaaatattaatcaagtattaatcaatcagggacctattaatcagggtacaaatctacaacaaaattctgtacagcaccttaaaagaacgaaccagacacacacatacacacacacacacacacacacacacacacacacacacacacacactttcatgatgtgttgctgggggaaaagcaggttgcataagatatgtttcacatggtctatttgaatattttaaattttaagaaattttatatatgacccaatagatacatatacacacactctcaagctgaaacaggttcatgaactgcaagacatgatacactgatatttcaatatttatccactacacactggggcctgtcgtggggtgggggacggggggagggatagcattaggagaaatacctaatgtaaatgacgagttaatgggtgcagcaaaccaacatggcacatgtatacctatgtaacaaacctgcacgttgtgcacatgtaccctagaacttaaagtaaaaaaaaaaaaattgtttccactaattgtcaatatttatccttttacactatttcagacttttttctgagaaaaagtcggaaaaggtatatcaaaacctctaaatatatagttattattgagaagtagaattgggttagccaagaggtaagaaaactaatttttcactagattaatgatttcatgaattaatttagtgaagtaatgaatcaaattactgaatttgatcaatgaattaataatttttttaaattgctttgaaataacagcaaatacaagaggaaaagacataatagaaagctggccttacctggtgaaccctggaatttggcccttttaactgcaagagaaaaaagaggataccatgaagaatgtttccaagttcattttacttaagcaacatttattaggcactacataccaatgttagaactaggtttagattgttaaatctaaacctggagaaaaaaagctgagacttctgatcaaaacttgaaaggcaaagagtcagacgagaccttaaaagtcaatctgatctcatatccaatgcaaaaatctctgttccaggctcctgacaacaaggtggagagatctaagttactcctgtggcaggcagccagtttcatgtgagatatcttctgaaagtttaagttacaaatgttccttatttaaaacctagcatagaaatcccctctattctgttcacaccaaaagaagagcataacaggccagatctagataataacctttaaaacaagaatgagaaataacttctttctgaaaataagcagatagtaagaggagctcctgtcaatgtaatcacaaagcgctgtttccaaaggcagtagagaactacacaggaaagaatcccacactggagtgcacatgccaactcctgggaaaggtcaaagaccatacatgcaggaaaactgctaaatctcagaaagcaccaagtagctatcaaagaagattagagctacgtgccacaggagaaaaaaaaaggtgaagaaaaccctaaaacacaaaacctggaaaggatgcttaagagtatacgtctgccattctccttatcctgcattactactgaaagcttcaccttaactaacatccaagtcctgcttaatacttctaagagatgggtcattctgtacctttcacacgtcctctccattttcagacaggattttactaaaatctattctttttattgaaacaaagtctgtctctcactggagactaccttttgtagtcccatttcagttcaaatcctcttcccaactggtgttctttttcacaaatgtgtagaaagtacatacacatctctctgaatagcctggctaaagctaccttaaaaagattaagctctgcaattactaattggtcaataagcataaatttgccattatgctagtcaacgatatagtgataataatggttctgtaatgtgacactctattgagtgccacttgattgcatgtgaaggatgcaaagtattgttcctggctgtgtctgtaagggtgttgccaaaggagattaatgtttcagtcagtggactgggagagacagacccaccctcaacctgggtgggtaccatttaatcagctgacagcacaactaggataaaagcaggcagaggaacgcggaaggagaagacagacctgagtcctctggcctccatctttctcccatgctggatgattcctgcccttgaacatccaagttcttcagcttttggactcttggtcttacacctgtgctttgccaggggctctcgggcctttgaccacagactgaaggctgcactgtcggcttccctacttctgaggttttgggactcggactggcttcccagctccgcagtttgcagatggcctagtgtgggacttcaccttgtgatgatatgagtcaattctcctaataaactctcatatatagatatgtgtgtgtgtgcatatatgtatatgtgcactcacacacacacatacacacacacacacacaccctatcagttctgtccctttagagaaccttgactaatacaggttctttctgggggcagggggaaccttgcaatctaccaaggcagtggaatttcaagcttgagcatacattagaatcacctgagggctgttaaagcacagaatgctgggccacatcaccttagtttctagactcagtgcagtgcagcagggcctgtgaaactgtatttctaacaagttcccatgtgatgttactggcatttactggctaaagaacagggatgctggtaaacattctacagtatgcaggacagttctccagagcaaaacctagcctatcctaccaccagtgccacccatcactgcatgcctcctggaggtctagggactagcttatcaagcctgctcccaccactaaaagccacacatgctgctgagtggtgcaaggactggcgcaccactgctgccaccactgtcaactcctcacacgtcaccgcggggatccaaggacccacccacttggtcagccactggcactgccagcacccaagcataccacctggaggcccaagggagcccaaagactggcattcctagaatgccactgctactactgattccagaggaccagcccatctggcatatcagtccccagcaaagtcttgtcacagcctccgccaacaattatagcctacaccactgagaagccaagaaactagtccgagtaaaggtgaagaaatcatacggagactacactactgcacccacccagaatcaaagccaaaacacctttccccagcaacaatatagatacatctacagaaaaaaagtctttccctaaaaaagccactccataacattaaaagaaggaattgttataacacatacacaaatatcaatataagaagaaaagaaacattcagccgggcatggtggctcacacctgtaatcccagcactttgggaggccaaagtgggtggatc

SEQ ID NO: 36536 - DNA, 11858 bp, Homo sapiens
tttttttttttttttaaagctgttcctgctgattgctttttaagctaggctcaagtgtggggccacggaatccttcaggtgcccttcaaatcagacattacatttcagctctcagggctagaatgcttccccctcttatcttgggcaggtctttgaagaagccagtttagccttggtaattttgaatttggccatagtatacggaggagagctaggtagctatcaaaacgcttagacaaacgtatggtaaaatgcagcccagcctgaacctccgcaaaacccccaaacctggagcagcaagtgggcaaaggagtgtgtgtttggggcagggtactgagtcccatatgtaatcaagagacctggagggcccaaggaagtcagtgacacccccacaagctacatatcctccaatggattgtggtggtcatctccggctaccgaagccaccttgcttattcccataggcttacaaacattatgatgcttcacacgagttgtgggtgaagtgaaggaattggaaagtcccggtctaaggccctgcaaaactgctgtctggtaaaaacaagtgactatggcaaggccctgaatgtactacgtatagacttaagtcagtatttgtgcctaacagcaaagcatgccacaagaggctcctcaaaagccgggtaattgatgccattgttttcttgacctagttgaagagtcaaagaagagaaggtgatgcagaaacttctttccagtgaagtgacagatccaagcaaggaacacctgcctgtgaggggagcggtaggggagggggtagattcggcagcactcgggtagtggcagggaccacatattgtcggtgttaaccactgttatcactggcccaggtcgagtgaggacgagtcatttccccactaagcacttggggagtggcagggaccacatattgtcagtgttaaccactgttatgactggcccaggtcgggtgacgacgagccatttccgcactattgtcccttcttcctcactgcacccccagccctgcaccctcagctccaaatacacattctcgttcactcaacgtttgttgacacctagcgtgggccctgtgggatggggtaaaagttcggtgttgggaggagccccggtgacagatttttggttttggtggtggcttttgggcaaggacaggtcaattcataaaagatgacgccccaggtctggatcgaattctcctgggagccagaccaaagcaccttcctggactgcaaagtgtggaagccgccgcgggccgggcgcggggaggtgtcatgcgccggaacctgcgcttggggccaagctctggagctgacgcgcaggggcaaggcgccccgcgtcccggactggcggctccgcgcatgctcctcccaccggcgtcgcaggcctcgagaggctccggaagtactgggtgcagcctgatggcgcaggaggtagacacggcacagggcgccgagatgcggcggggcgcgggcgcggctcggggacgcgcttcctggtgctgggccctggcgctgctttggctcgcggtggttccgggctggtcccgggtctcgggcatcccctcccggcgccactggccggtgccctacaagtgagtgcggcggcgcgcgcactgtcggggttggggtcggcgttgacgatgggggatggggtgctggggcggggacccctgctcaccgtggtttgtgtcgggtcacgagatggtgcggggacagcgccgggtgacgctcggagcgcacttgagagcaaagttgaggactggggagtcgcagccgctcgttacgtgcagccctgggacctttcgtcccctctggtcacttgcggcagactcaggacagtcctgaatcgtggaagaagaaaaggagagtaatgttatttaatggagggacttctgggtacaagtagctgatttcttgagtagtttaaaaacactgtctatcgcatttatttatatcatgcactgtcgttagttattaccgcggaacatttggtacaatttactgggcgaccaactcgctctggtttgaacctgatcagaacctgatccgaagtccttattgggacttcccagttttgccctcaaaagtcgcgcatcccgggaatccccgtctcctgcagtcctggttagaccgggaagattgtcaccgcttttgtccagtcttcagcctggaggtaggacgccggtcctaagtcggggacagagcccgcacacctgggaggtcgattccagcctttgacagagaagacacagcctccggcggtcagagatagctaaacacagagaaagaaaacatggtgtcaacatcaggcaggagaaagaccagcagtttttgaaaacagctatttttctttaaaccaaaagcatcattggacataattttaacttactagcataagtaatcaacagctaaaactgcacacaacaaacctgaaaaaaacagctattttgtatgacagtatgagtgggaaggagttctgcctgctgcgggtcaaatctggctctgtcatcaccagggatcttgggaaagttactcagaatctctgtgcccacatgccctgagtcaaaaaataggaatagtggtagcacgtacctcataggtttgctggaaggattaaatctagtaaaatgccagctgttgtcaaacctagatagtgtattctgctcactgaaatgtttacaacacttttttgttttgtgtgatatactacgtggaaagagaagtttgtggttgaagctagttttctggaaaatgttaataataaaatgtttgtaagaagtcaaaattactcaatagaacaagaattgtaaatccaaacgatttgatttaacattagggcaaggtgttgactatggctttttagtggattttttttttaagtctcagatattaagtacgtgctcccatctaattccctcaattgaatataatatttaagtttattaagttcacacttaaattacctttgaactaaaatagattttgctgtgtcagtgaaatctccatgtgattatgtatttgtttaaaccaggtaagtgcctataaaacactgtacccaagtagcagaaacttttgggagcgtcgttaatagtttcgattagcataaagattttaacttcttaagttaaaatagaaatttttgttgatttgttaagatttgttagatctggctacaaccttggggatctaggattcttagatagaagctgttgtcgccaccacttctttctttcccagtgccagattataggtgaccagtgtgtctgttgagctgaattcagctgcagtgcccctcgagtcctattgctgtggccttctccggtcttcttttcttgcctgcattgttgaggtcaccttctaactgatctctcatgttttatttggcctctctccataccctcttttaattcgtgaaataaggtttactttatagcaaattcagtcctgtcagatctgctacttaacatcctttaagtttagccctccccaattataaggcagggaattccatgcacattctcctagtgacaaaatgacagcccctgccagtctcttccgtctccattcctgcgtcgaggcctgaaatccagtcttccgtacctaccggagaccaaatgtgccaggcttgtcttacaatacttaacatttcctctgcctttctgtcttaaccttctaatcaactacattaaaaacctaggcccggccttcatctctttctttgccctccccaccccattcatcccatacctggttaacaatgatttgtccttcctgtgtgcccataggactcattcctttagtctagcacataccacactcattacttgttcagtgtctttccagctcccacccacagttccatgagaaagggaacagtgttttaatttttgtttccctccttcttactatagttcactatatatgtagtggagcctcaataaatattggttgaatgaatgttaattcgtaagtaaatataaaatgtattctgttactcataattatctgaataatcttaatgtatggactgtttgtaaaattgaacacattggaaaaatgttcatttattctgtaaacatttgcaaatgtctactatgatctggagctataaaaattttaagacaaaattcctgtcttcaaaattttcacagtgggatcagggaacagggaagcccgtatttatcagagtgcttttagtttatcatttgctattaaaaacattattggaagtttgttcacaagataacaaaatgtgtgtttatatttattaactatggtccgacctttgaatggtcccctaaaaatgttactggattctaaaagacgtgagaagaatcagattcattttagaatctaagtagatggtttctttttctttattaggcgctttgacttccgtccaaaacctgatccttattgtcaagctaagtatactttctgtccaactggctcacctatcccagttatggagggtgatgatgacattgaagtttttcgattacaagccccagtatgggaatttaaatatggagacctcctgggacacttggtaaggatgcatcttggtcttataactttggttaattcaatgatttggttattaagttgatttttaaggagtaatcactatttagatggctgactttagatcatgttggtgtttgtcttagtacatttaaaatgagtagtcaaaaatagttactatcagattttgtaatcttgacaacaacaaatgtaatcaccattatccattgtaatattatgaatctgaaaccagctcctgtacctagctcctggaaggtgagaagaggcccagaagtggcagggcaggcaggtaacacctcttgatttccatactctgttgtagtcacttttccaggttaacccatcaccatgtgaggtctgtagagctgcttccagagactggcatgggggctcctcacacttattctaagctctaaggaaattatcagcttgtccacataacatgcaggcctcctatttgagatgagccaaataggggtgtagtggccaaagctggggtggatgagggcctggagtttggggccacagagtggatatgacagtagcagcatggaagaacagctgaacagttgttctacttgatatgcatttgtgatgtgccacattttctcctatcaggttacctggacccatggttgtgtcacagttgcttttatacatgtactgtctttacacagaaaattatgcatgatgccattggattcagaagtacattaactggcaagaactacacaatggaatggtatgaacttttccaacttggcaactgtacatttccccatctccgacctgaaatggatgcccctttctggtgtaatcaaggcgctgcctgcttttttgagggaattgatgatgttcactggaaggaaaatgggacattagttcaagtagcaactatatcaggtaagttgtgaaaatatagcaatatttgatcattgcatcaaaaaccaaatgaaagaaattgttatacttccattgaaacatttcagtaatgttttacttagaggtcatttgtaaaatgtacttttggaaccattaaactttgggaatttttttcatctcttatttgtattttttatttattttatttgaataggtttgtggggaactggttatgttaagttacatgaataagttctttagtggtgatttctgagatttttgcgcacccatcacccgagcagtgtacactgtacccaatgtatagtcttttatccctcacccctctccgacccttttccccgacttcccaaagttaatcattcttatgcctttgcatcctcatagcttagctcccacttacaagtgagaatacacaatgtttggttttctattcctgaagagttacttcacttggatggaattggagaccattattccaggttgctgcaaatgccattatttcattcctttttatggctgagtagtattattccttggtatatatacaccacattttctttatccactcattgattgatgggcatttgagctggttccatatttttgcagttgcaaattgtgctgctataaacatgcatgggaaagtattttttgcgtataatgagttctcttcctttgggtagatacccagtactgggattgctggatcaaatggcagttctacttttagttctttaaggaatctccacactgttttccatagtggttgtactaatttacattcctagcagcagagaagaagtgttccctttcccccacatcccgccaatatctatttttttttattttttgattatggccattcttgcaggagtgaggcggtattacattgtggttttgatttgcatttccctgatcattgcatttccctgagcattttcatgtttcttggccatttgtatatcttctgagaattgtctatttgtgtccttagccacccccaccccgcctttttgttgttgttgtttgtttgtttgaggtggagttttattcttgtcgctcaggctggagtgcaatgacacaatctcagcttgctgcaacctccacctcttgggttcaagcgattctccagccttagcgtcccaagtagctgggattacaggcgcccgccaccatgccaagctaatttttgtatttttagtagagatggggtttcgccatgttggccagctggtctcaaactcctgacctcaggtcatctgcccaccttggcctcccaaagtgctgggattaaaggtgtgagccaccactcccggccgttaacccactttttgatgggattgtttttttcttgctgatttgagttccttgtagattctggatattagtcctttgtcagatgtatagattgcaaagattttctcccactctgtgggttgtctatttactctgctgattgttcctttggctgtgcagaagctttttagtttaattaagtctcatctatttatatttgtttttgttgcatttgcttttggtggaaccactaaactctgacccaaactattactcatgcagaacttcacctgttggtgatgagtagcttatctctgatctttgaatgtttccctaaaaatgctcttttcccatcataaaaatgaataaaatgataaaacattttgtacaattaaattggtctttctaaacgaaatagtaagagaaatccataaaatgcctgattaaaggatatgttaactatatctgaaaaaaattttagtgatgatatttttatgttgaaaaataatagctactaatatagactggttctggcactgttctgagtactgtacatacatcacatcattcatcatcacaacttctggaggtagtaactattattttgcctattttacagatggagaaactgaggcacagagaggttaaagttacacagcttagtaagtgggactccaaccctggcagttacgccccattgcccattctcctaactactttgatacattgcctcccaaaatgtatatgatcttatatttgagaccctcttgagcagtttaaatattttatctttgagatttttttcttcttttggatgtattggaaagttgctgaaagttggaattgtgttgcaagtgctgcattgttggttagtaatgaaaagagttcagcaatcctttcattggtaactccttatgtgacttgggtcacattttatatcttattggcccgttgcctcatgtgcaaaatggagacaatataccatagcatttgagaagtaaggagcttgtccatatgatttatgaagcattacattataaattgctgttccccagaacagtagaaacatctgaaatgaaagcactgttgtgacaataattattcagtgaaccccaggacttgaggaagtaatcatgcttcctatttgtatagctctttacaaatgatttggaggtatgttaactcacggttcagtggagaggataagatactcattctctgcaaataaggaattgaggctcagccaggtaacatgacttacttgcctctcaaggtcaaagagctggatgtagcagaatcaggaataaaactgaggtcttttaaatgtaacaaggatctgttagccgaatgcaccatgttgttttctaatatttcctgctactttctaatcaatgtgccttaaaccataccaacaatacaaaagtccatcattagcggttctttctttcattccaggccagttcacacctttccccatttccacctacatcgttatctgaaaatccttccttctgacataaagtcaatgatcatatgaataagtgatcactattttttgtaaaatagttcaaaatatgccagtacttaaatcttttaagtcatttatttgccttgtgaataatcctgtgattgacaaaatagtgttttgaagcattcttgtctcataaggatagtggtggcatttgaaagttgaagaatgctaagaacagtatccccagttctaatacaacaggctttattctgttctacaattttaattccataaaattgataaaggcagtcactctattcattttacagaacatgaagtatttattttatggactcaagttggagtaaccaaagaggtttgcacacagtgacaggatgcagtgtttggggcccagttctattaggcattataaatgcccaagatgagagttgtaaccatgcagagtagtgttttctgaatatttggaaagattcttctggtctagtacaagatggtagaagagagggttagccatcctggagtatgaactcggcctaaaacatttccagtttagttgatttgttggaaggacttaacgtggcaggtggagaggtcatcagcagcatcccagcaactccaagtacagggaagaaagaaacgtaccaaacacacaaggtggatggggtatggtgcttgttctcataacagtaatagccagccttctagagcagtggctcctcaggcagccattcatactttatgtgtagcatgctttgcaacagtgaagctccacatttcccacacctccattttccttacactgtctttgcccattctgcttttcctctttcgcaattctttttgtgctttccttttctcttttgcctctgaatccaagatttggtgagttgggtagagaaagagagcttctgcatttgtataatttcgctttgactatagcttaaatgattatagaattagtatgtaagatgacttctccttatacacctattatatctaatgtttataattcagaaatatcttgtgccttgaagaatggaataaaattggctgagcttggattcctgttgtgaaatgcaggtgtggaaattcaaaaccattgtttactcaggcatccagtcttaatcaagttagaacattttacttaaaattaatatgattaggccagccatggtagctcaaacctataatcccagtgctttagaatgctgaagcaggaggatcacttgaggttgggaatttgagaccagcctgggcaatacagcaagaccccgtgttgcccaggctggtctcaaattaaaaaaaagaaaaattaaaaaattagttgggtttggtggccagcgcctgtagtcccagctactcaggaggccgaggtgggaggatcacttaagcccaggaggtcaaggctgcagtgagctgtgatgttaccaccgcactctagcctcggcaacagagggagacctgtcttaaaaaaaaaaaaaaaaaaaattaacatgattagctttgttcactaggtgactttgttttgtttttttaaactaggaaacatgttcaaccaaatggcaaagtgggtgaaacaggacaatgaaacaggaatttattatgagacatggaatgtaaaagccagcccagaaaagggggcagagacatggtttgattcctacgactgttccaaatttgtgttaaggacctttaacaagttggctgaatttggagcagagttcaagaacatagaaaccaactatacaagaatatttctttacagtggagaacctacttatctgggaaatgaaacatctgtttttgggccaacaggaaacaagactcttggtttagccataaaaagattttattaccccttcaaaccacatttgccaactaaagaatttctgttgagtctcttgcaaatttttgatgcagtgattgtgcacaaacagttctatttgttttataattttgaatattggtttttacctatgaaattcccttttattaaaataacatatgaagaaatccctttacctatcagaaacaaaacactctctggtttataaaacaccttaattctactgctcttttttctccaatcaccagcatctgtttttcagggggtgattttacttttgtgaattccttagcctttcttccttggtgcataaagttaaaatgcacatcagcagaattgctgcatattaacatctcaggactcttctcttgtaaagaagctgaaattcgtactatattggccaaagtgagcgagttaggtgatcttggtttcaatttccgagcctttgttaatatggagaattatggttcatatcagttatgtaggacctttggacccagggtcctacagatagatatggtgtgcccagattttaaaaataccttcaaaaataaaaaatacattcagtgacattttcatggtgggagctcttctttctgatatggcagttacactttttcacttaagtgctttagtttagactaactttacaacttctataacttttggaaccaagtttagtatagtctgattacattccattcacctaactttagacattcgtttagacaccataactggagtgattgtgcttctagatgtggcaaatccagtgttaacacatatttctggctgagattttggaactagctagtaactggcttgtgttctttaagcatactaacatcactaaatcttaggatttaggattgctgtaaagatgtaagttgtgtatgtttggcaggtcacattgaatggcagtgataatgattaatcaaagaacaaatgtcatccttgatcttgcctaatgtagtttatgtgccaaactttccagggttttgtagtcacctagattttaagctgatagcatagtgcttcagcggttcttctaaccggggtatgcaggaacatggctgcagacacgtttgggtaaacaggcaccttctgacttcttcattgtttcctgtagttctccctcttcccacaaagctgtcagcgcagtggaagaggttgcacttctccgagagaggacaggtttctgttaagatcaccaagtagctgtgctttaattagagccagacaagctttcaaggtcctttaagtatttgatgatcaactgaacacgtttctattcaaggagaaaacaccattcagtaagaagatggagtagatatcagataaaacaattcacgtttaatatgtaaatgtaccaattatgtgattcagtttcaactttcaagtacttcctgagaggttagtacattattattgagctctcacagaaagcttaatcatagatataattaacctgatccaaatgagtaaagtggaccttagaaaggctaagtgatctttctctggctatccagctagtagtaatgaagtcaggtcttgaaccccggttctgctgactgaattggatgcactatagtacaggcttttagcaccgaagtgtggtcctcagaccagtgcctgccaaccagatgttactggtctgtgaggaaataagtacagatactgacaggaagcttttataaacaatttattggagtgtttttgtttctgttgggtctaattaaaaaaattggagcttgta

SEQ ID NO: 36537 - DNA, 24244 bp, Homo sapiens
aagtgctgggatgacaggtgtgagccaccgcccccggcccctcgcccgccttttgaaggagcctttcgtcctcaagggcgaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgagcgtggggccgcgcggggggcgcggcgggtgctgccctcgcgtccgcgccgtgcggcggctcatcctggcctcggtcacctgggcgagtccgggagcggcgagccgaggcggtgacaccttccctgggccccagccgccgcgccggggccccgggggcgggaggctgcttgctgctgttttaaaaccacagcctgggccaggcgcggtggcgcaagcctgtaatccgagcactttgggagcccgaggcgggaccatcgcctgagcccaggagttcgaaaccaatttgggcaacatcgtgggaccccgtctctgcaaaaaattaaaaatcatccgggcctggtggcgcgcgcctggggtcccagctactcaggaggctgaggtgggaggatcgcttgagcccaagaggctgaggctgcagtgagctatgatcacaccacttaactcgagcctgggagacagtccgagacccgtctgtttacaaaataaataaaggcaaagcctggctaggctgttaccctctcctgcctgaccccccatagtgccccttggctgtaggggcttcgccctgaacgtctcaatcttcgctctccacttcccatcctgctgatttgctgacaaaaccaaagcttggaatttccgcttggttccttctgggtgggtggcttttggtcatttcttttgatcactatgcggtgtcactatgtggtagtagcgaggtcagactgtagcgagtgtttaaagtttgcttcctttgttttctgggcttgtggggctttttgtggtacctgccctagcctagtcagtcattccccatgctgcccccttaggctagagatgccctaccgccctcaggcctcgctgaatgtgccattgtacttgaaggcacctgttacttttttaatttttttatttttttgagacggaatttctctcttgtcgcccgggctggagtgcaatggcacgatctcggctcactgcaacctctgcctcccgggttcaagcaattctcctgtctcagtctcctgagtggctgggattacaagtgcccgccaccacgcccggccaatttttgtattttttagtagagacggggtttcaggctggtcctgaactgacctcaggtgatccgcccacctcagcctcccaaaatgctgggattacaggcgtgagcccccacgcggggctggcacctgttacaattgaatacaacgcgagagagaagatgataattaccttgccacctggggccactttaaaggcttacctggggtgttctggtgtctacagctgctgggctgacacgtattgcctagtgcagtggtctccaaactgcacattggaaccatctggaaatctttggctcccatccccagacccttttttatttttttgatggagtctccctctgtcgcccaggctggagtgcagtggtgcaatcttggctcgctgcaacctccacctccctggttcaagcgattctcctgcctcagcctcctgagtagctgggattacaggcacccaccaccatgcccggctaatttttgtatttttagtagggacagggtttcgccatgttggccaggctggtctcgaactcctggcctcaggtgatccacccgccgcagcctcccagagtgctgggattacaggcgtgagccaccgcgcccagacgcatccccagaccttctgatttaattgctgcagagtatgatcggctgcccaggtgattctcatgttcagcaacgtttcggaaccaatgaactgtgtttcccaagtttacctgatcatggaagactcatctgaggaattgtttaaaagtaacagatccccccgtctttggggtgaggtttggaatcttaacactgcccaagggaagcccaagcaggtttggcttccaatatctgtcagcagcagcagtagatacagacagtattcaagaggatggctttccaggtgcagactcaacatcagaaccacctggcccacacccagatttggactcattggctcacacctgtagtcccagtgctttgggaagccaaggtgggaggattgcttgaggccaggagctcaagaccagcctggacacaagaccagcctggacaacatagcgagaccccatctctaagagaaaaataaagtttaaaatggtaaattgtactgatggagcagtgcaaaaaaaagaattttttttttttttttttctgaacacggtggctcatgcctataatctcagcactttgggaggccgaggcgggtggatcacctgaggtcaggagttcgagaccagcctggccaacatggtaaaaccccgtctctactaaaagtacaaaaaattagccaggcctagtggctaatgcctgtaatcccggctacatgggaggctgaggcaggagaatcgtttgaatccaggaggcggaggttgcagtgagcccagattgcgccactgcactccagcctgggcaacaagagcaaaactccatctcaaatatatatatatatatatatatatatatatatattttttttttttttttggagactcactgctagccagttaactgaactcacatccctggttggacctgaagcatttgggggcaggagctcccctgcagctttttgcttttggcgtttgctgctagtgggaggatcagtgcacatctaccttagggtacctgtaaaattacaactgcggaaaatatccatagtggtgttgcactgtatggtagccactagtaacttgcacctgttgaacacttaaccgttcctactctacactgagatgtgctataaccttaaaatacacactggatttcaaagacatagtacagaaaaagaggctgggcacagtggctcatgcctgaaatcacagtactttgggaggctgaggtgggaagatcgcttgagctcaagagtttgagacaaacctgggcaacatagcgagaccttgcctctacaaaaaaatacaaaaattagcctggcatggtggcacacgcctataggcctacctatttgggaggttgaggcagaaggactgcttgaacctgggaggttgaggccacagagagctgtgatcacaccaccctccagcctgggcaacagagcaagacactgtctcaaaaaaacaaagagtaccactatcacatgaaaacattttttattgatgacatgttaaaatattttggatatattgggttacacagaatatatcattacaattaatttttcctgtctcttttttctttttttctttttaaacggcgccttgctttgtcacccagactggagtgcaatgcactgcaacctctgcctcccaggctcaagtgattctaccatctcagcctctggaattatgggactacaggtgcacaccaccatgactggctaattattgtgtttttgtttgtttgtttgtacagatgagaaatctcatctctacaatcatgaggtttccatgttgcccaggctggtctcgaactcctgagctctagcaatctgtctgcctcggcctcccaaagtgctgggattacaggcatgagccaccgtgcccagccctttctatttctttttactttttgacatggctactagaaacttttaaattacagggtcttgccctgtggtagctcacgcctgtaatcccaatactttgggaggctgaggcaagtggatcccttgagcttaggaattttgagaccagcctgggcaacgtagtgaaaccccatctctaccaaaaatacgaaaaattagcttggcatagtggcgcacacctgtggacccagctacttgggaggctgaggtgggaggattgctgtagcctgggaggcggaggttgcagtgagccaagattgtgccactgcacttcagcctgggcgacagagcgagagcctgtctcaaaaaaaaaaatatgtggctcgcgttatgtttttatgggacagcgcagctctgtaggattccttatgacgcattcactatctcggtcatgagaatctttaaagcagtaaatgctttgcttttgtccgtcttgctataatcaaaactgactcaggacctgcattaaggctctttttttttttaacctcatctcttaactttttgatgcaactcatcttagtgaaattgtggtctcctcctacagcaaccctccctcaaaaaaagaccgaacacgcaattctcatctatctaactctgttaacaatcatatgaggaggaaataatcacatgataatgagtggcatgaaaccctgtgtctctaaattaagcaactcactgtacttgatgagtacatcagtcttcctgccccaagcttttgtgtgtcagactggaattaaatggaagcttacactgcagctgaattcctagaagccctggacttgtcaggggaaaagcccatggggggaaagcccatctctaggctgggcaatgaacttggagactgctcgatcacacacactcataagtaacaaaaccattaatttcttttcttttttttggtggagggacagagtctcactcttgcccaggctggagtgcagtggcatgatctcagcccactgcaatctccacctcccgggttcaagtgattctcctgcctcagcctcccgagtatgtgggactacaggcacccaccaccacacccagctaattttgtgtatttttagtagagtcggggtttcacaatgttggccaggctggtcttggactcctgacctcaacaaaaccagtgaatttctgaagtctcagcatctaggacttagaagaaggagaagcctagcatttcctgattctataaataacaacactgatagtctctagtagatgtttaacagcagttcgaaggggaggggttctgatttgtagtactggccaatttccacggtgtcagtacttgctctgtgaccaacgatgactcacaaacattgttgtaaacatttgacctacattaattcttttaccctcacaagaatcctgtgaagatctactatcattcccagattatagatgggaaaaactgaggcacaatgaggttaagcaccttggccaaagttatgcctcgtgaatggtggagctgagccatgaaccaagacctctgcctccagtctgtcctaacccctataagctaatgcctgtagatggttttttttttttttttttttttgagacagagccttgccctgtcgcccaggctggagtgcggtggcatcacagctcactgcagcctccgtctcccaggctcaagtgatcctcccacctcagcctcccaaatagccgggatttttattggacagcacagctctgtaggattccttatgacgtattcactgtctcagtcacgagaatctttaaagcagtaaatgctttgcttttgtccatcttgctataatcaaaactgaccatgcccggctaattttttattttttgtagagatccctatgttgcccaggcttgtctcgagctcttgggcacaaatgatcttccccccttgacctcccaaagttctgggattacaggcgtgagccactgtacccagcccctttggatttttaattgttcaaactggtagtcatagtcccacttcagaggagagaaccatatatgtgaccagaattcttgggggaaaagtaagaaactactcttaaaagttccttaaagggtagaattctcttttctagaaagagtagcctagggttgtccaatcttttggctttcgtgggccacactggaaggagaaattatcttgggccacacattaaatatgctaacactaacaatagctgatgagctaaaaaacaaactttttttgatcacacaaaaaaaaatctcataacgttttaagaaagtttacgaatttgtgttgggcctcattcaaagccatcctgggccgcatgcggcctgtgtgctatgggttagacaagcttagagtagagcatagtgggtgagagaagaggcttcagatgcttctggcttgagttcaaatcctgactctgccactcactagctgtgtgacctttggcaagtgacttaacctctctgtgtttccatttcctcctctgtaaaatggaaataataataatgatacctgtctcataaagtggtcaggattaaatgagttaatacatataaagagcttagatcagtgcctggtgcctataaacactccagtggtaactgttataatttgtattatctcttggtgattcccataggtcacaggcattgaaagtgctcaaagggccaggtgcagtggctcacgcctgtaatcccagcactttgggaggtcgaggtgggtggatcacctgaggtcaggagttcgagaccagcctggccaacatggtgaaaccccgtctctactaaaaatacaaaattagccaggcgtgttggcgcatgcctgtaatcccagctacttgggaagctgaggcaggagaattgcctgaacccgggaggcggaggttgcagtgagccaagatcacaccattgcactccagcttaggcaacaagagcgaaacatcgtctcaaaaaaaaaaaaagagaaaatgctcaaatgtaataaagacagtattcatcgagcgttttctctgtgccatcagtgtgctgagtgctttacctgcaccatctcatttatttcccgcaaaccctcctgtggtttaggtgctaccatccccatttggcagaagtggaaatggagtcccctagaaggtacgtagcttgtagaaagtcatgtaattagtcaacatcgtacttccagccactggccagcagaagcttccccatcaattcaaatccattgaatcctaatggcaatttaagaggcctgttttattttataggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggtgtgtctcccactgtgtcttctgtctaacactgacaccttgctctttactgactttgcacacttgattaatgattgacgtggcctgagtcctgacatcaccaatgcccagaatgattgttttagtccaagaaaacggtgcagccagatctcttttcagcttaggatctaacagagtgtatccaggcagctgtggttcctcagcttgaaagcatggcaggctgaaagccctgaaagatgagaaaacaaatgtcttaaatcctgatagaaattcaagtggaaatatcacctttccacattttgggtttgcattattgtcccaaatacacgaggtaaatcttttcagacagtgtaaaaactttaggccgggcacagtagctcacgtgtgtaatcccagcactttgggaggctggggcgggcagataccttgagcccaggagtttgagaccagcctgggcaatgtggtgaaaccccatctctataaaaaaaaaaaaaaagaaaaaaaaagaaaagaattagagaccattagagaccaaaacccaaacaagaaggaaacagagacagcagcacaggactccatcgggagcgaaaggaagggaagacattgtttactgctgcatactagtcttcaggctgttaatctgcaaagctccaagttaaacattgactctttagtcctggtaacagctctgcaccacacagtcaaacccgacatagccctccagatggcctatgtgctaagggaccgagggcgaccagtagagataagctgccaactcttggctcagagctcttgccagggaaaacaagaactccagaaactctttcttcaggtgtgttcttccccctgccttctcaagagaagggtcttgtggggtccccagagaggagaccgagctaatgagccataaaagtcaggaggaagggccaggtgcggtggctcatgcctgtaatcccagcactttgggaggccgaggtcggtgtatcatgaggtcaagagattgagaccatcctggctaacatggtgaaaccctgtctactaaaaatacaaaaattagtggggtgtggtggtgggtgcctgtagtcccagctactagggaggctgaggcaggagaatctcttgaacctgggaggcggaggttgtagtgagccgagatagtgccactgcactccagcctggtgacagagcaagactccgtctcaaaaaaaaagatcaagtggaacaggggatttgcagttggctggagggggcagtcctgttagcatgtacctgtctcagcagagagacggttgcctcctgtgcaggcatagccttgtcccggtgagctctgggaatgtcatgctcggtgtgtttactgggcagatgaggaagggcacaagccccgcttttgtcccttggtggaaaggagcaccccacaactcagccttccgtggtggatctgggcgggggccgtgtgagttccccagggctttcctcatgagctttcacgacgtctgtgttctttgtagatggaacacagtcatctatttgcagccccttggctcatctccagactgaaattacccttaatttgaagtagataagtgataggaaacaggccagatgtggtggttcatgcctgtaatctcaacacttttggaggccgaggcagaaggatcacttgagcccaggagtttgaggctgaagtgaactgtgatcacgccactgcactccagctagggcaacagagcaagaccccaactctaaaagagagagaaagaaggagagataggaaacgaaaagtagaccatactggattgttccaagtataactcaggagagtcgtaggagcggccttctctaacaccaaatgcagagtgtgtttgtacattgaacacctgggaacgtgacaggtggcgggagagaggctgcagctcatgccacatcctcacgcctcctcctgtggccttctccttgtctcccaacatagtttgccctaggcctttggaggacgccagctatttctagagcttccaccacttgtcagaccgtggggttggggatgtctacagactggttggtttctgagttgccctgatccccaagatggctcccactactgactgttatcctcaggagtgtgaaatgctaaaagctttgggcatctccttttaaaatgcctgggcccagccaggcgcagtggcttacgcctgtagtcccagcacttttggaggccaaggcaggaggatcacttgagctcaggattcaagaccagcctgggcaatatagtgagaccccatcttgattggatgggtggtggatggatggatggatggatggatggatggatggatggatagatagatagatagatagatagatagatagatagatagatggaaagaaagaaagaatagataaatgataggataggagaaagaaagggaaagaaagaaaagagaagagaaaagaaagaaaagggataggatagatgacagatgataggatagattagataggtgatagataatcgataaatagaaaacagatgatagatataggatagattagatagatagatagatagatagatagatagatagacagataatagatagattagattagatggatggacaccagcccccaatgagaggaggatccaactagaatcttttggggtctttgccttttattccttatatgaggaggtcattatcagcaattcttcagtctcatccctagcaaattgctttccagaaactctaaatcaattatttggcacctttatacatataaggaggaaacagaaccttttcaaagagaaatgtcacttgctgaccctgaccgagtcttctctagaatgtttgatttataatttcagttaggaaagaaaaccagccagatttgagccccatgaggcctcatgtttttattcctctgagataatctggttggcagggaatgtttttagcacttgttggctctttccctcagtaagtcaagtttgattgagaaaccattgtttcagtttgcagacccccccctttttttaactgcagtcaaattcacttatagaaactaaccattttaagtcgggcacagtggctcatgcttgtaatcccagcactttgggaggctgaggcaggtagatcacttgaggccaggagttggagaccagcctagccaacatggtgaaatcctatctctactaaagatacaaaaattagccaggtgtggtgatgtacacctgtagtcccagctactcaggagggtgaggctggagaatcgcttgaacccaggaggcggagattgcagtaagccaagatcgtgccactgccctgcagcctgggcgacagagcaaggctctgtctcaaataaataaataaataagaaagaaattaaccattttaaaatgaaaaattcagcacatttagtgcattcacagtgttatgcaagcatcacctctatctagttcaaaacatttccatcaccccaaagggaagcctcgtatgttacacaaccactccccattccccacttctctcactccctggcaacccgtaagtgctttgtctctatggacttgactgttctggaaatttcacatcaatgtaatggtatcctgtgtggcctttgtgtctggcttctttcactcagcatcatgtttttggggttcatccatgttgtagcctgtatcagtgctttattcctttattttattttttgagatgaaatctcactctgtcacccaggctggagtgcactggcgtgatctcggctcactgcaacctccacctcccaggttccagtgattctcctggctcagccccctgagtagctgggattacaggtgcccgccaccacacccggctccttttgtgtgtgcgtgtgtctgtgtgtgtttgtgtgtgtgtgtgtgtgtgtgtgtgtgtgtttttagtacaaagtttcaccatgttggccaggctaatctggaattcttgacctcaggtgatcctcctgcctcagcctcccaaagtgctggaattacaggtgtgagccaccatgcctggacccttcattcctttttattcatggctgaatcacattccatcatgtgactagactaggacagacatttgggctgtttccaccattttttttttttttttgagacagagtctcgtgtcatccaggctggagtgcagtggcgcgatgtcggctcgctgcaacctccgactcccgggttcaagcaattctcctgcctcagcctcccaagtagctgggactacaggtgcccgccatcacacccggctaatttttgtatttttagtagagacgggggtttcactgtgttgaccaggctggtcttgaactcctgacctcgtgatccgcccgcctcagcctcccaaagtgctgggattacaggcttgagccaccgcgcccgacctgtttccaccttttggctcttgtgaaaagtgttgctctgaatatttatgtacaaggacttgtttgagtcactgttttccattgggttataaactttgatgggagagagcgggagagcacgcggtcagtgtttgagttgtcctcttcagtcagcgtctgcctttcttggctctccgtgagtcctctgagcgtggcttgcccgtgctgtctcccctctgcaggaggaaaactccctcttcgtcatgaccaacgtgatcctcaccatgaaccagacacagggcctgtgccccgaggtaggaggcccccgggaagagccccaggccccacacccctctccacgcctgtccacctgtgtgtggggccgggccacgtggactttcttttcgctccttctttttccagattccagatgcgaccactgtgtgtaaatcagatgccagctgtactgccggctctgccggcacccacagcaacggtacgagcttgtggcctcctggggagggcggcccctgagcagatcgcccccactgtggagcgtctctgatagagaaatcttcccaattccttcacatgaccctgggtgagccaggtgccgaggctggggtcctggagcccctctacattcactgctgtcattggagccccacaagccatcccagctcttgccctactgtttttttttttgttgttgttgttgttttttcttgtttttttttttgttttgtttttttgtttttttgagccagagtctcgctctgtcacccaaactggagtgcaatggcatgatctcggctcactgcaacctccacctcccagtttcaaacaattctcctgcctcagcctcccgagtagctgggattacaggcatgcaccaccacgcccagctaatttttgtacttttggtagagatgggttttaccatgttggccaggctggtctcgaactcctgacctcaggtgatccacccgcctcagcctcccaaagtgctaggattacaggcatgacccactgtgcctggcctcttgtcccattctttagcttggcatcaccctggctgagatgtggctggcacacaggtaactgtcttcctccgattctaactcctggacagtgacactgtctaaatcccagatttgcacagctcaagactggctgcatgggaggctggatggggctctcactccctactccaaaaaggtagaaaataggagacccctgtggacatgggacccccctgccacccttgtgcttgtaggagtctcaacaggcaggtgcgtagctttcaacgggtctgtcaagacgtgtgaggtggcggcctggtgcccggtggaggatgacacacacgtgccacagtgagtccagccctagggaaggaagtgcctttttgttttgttttgttttagacacagtttcactctgtatcccaggttggagtgcagtggtgcgatcttggctcaccacaacctccacctcccgtgttcaagtgattttctgtgcctcagcctcccgagtagctgagattataggcacccaccaccacgcccaactaattttttgtatttttagtagagacggggttttgccatgttggccacgctggtctccaactcctgacctcaagtgatccacctgccttggcctcccaaagtgctaggattacaggcgggagccaccacacccagccagaagccaccacacccagccggaagcaccttcaactctgcgtgtcagccttgaacagaggtggtcaaggagttacacctgtgtgttgtggctttttgtgtgtttctggtgtctgtatgaagtcaggctgccctaggatggctgctctcaaccacaaggcagcgaccatcagtggcaagatgggccacaagtagtctgtcactcacgagaagggtgcaggtgactgacttccttgtatgttaggactctgtcagttgcaaataactgacaggaaacagttctcagtgccttaagcacatgtgcacaaacacatacacacatacacatgcgtgcacagcgggggggcagtgtattgtccggctgaccaaaaagatccagcgtggccaggagaatctcgtgccaggctgaggcagaagaatctcttgaacctgggaggaggaggttgctgagctgagatggtgccactgcactccctcctgggcgacagaggccactgcactcctgcctgggcgacagagtgagagacaaaggacaacaccctagtctcccttcctggctctgcatcccgccgtgccagcttcactcgcaggacccacagcatagcccgggaggcagcgctgcacttacagccccccaagtctgagtctccctttccagctgtccctggagattctagacctgtccatcatcgtatcaatggccatatctctcaacccatctctgtggctggggaatgggttttgcttatcagcttgggcctgggtcacatgcccacctctgcagctggggctagagtcagacccacccaagtgacataggcaagcattggggagatatggcttccaaaggacatttggggttctgttaccagaaaagctgggagcagatgctgggaagaaaacaacggatgtttgctacagtgtattttaaactaaactagacaggttcatcctggcgcggtggctcatgctgtaatcctaacactttgggaggctgaggcagtcggatcatctgaggccaggagttcaagaccagcctggccaacatggagaaaccccgtctccactaaaaatacaaaaattagggttagggtggcgcttgtctgtaatcccagctacttgggaggctgaggtaggagaattgcttgaacccgggaagtggaggttgcagtgagctgagatcgctcttctgcactctagcttgggcgacagagagagactctgtctcaaaaaataaaaatttaaaaaaataaataaataaaaatttaaaaatcaactaaactagccaggttcaaggttgctctagaataacattcttcgtggttgtaattggctgtgcttcatggggtggagtccgggcagcgctctgagaagtgcgtgcagcctagggcctttctcaccgagagctcagaccgaggtctccatgagccccggggagcaggaagccactgaacctcatcctgggtgtgttgagacagaaggaaaggctgagaactgcagatttagagattgctaaggcaaaggaaggagatagaaaaagaaaaggaatcctagcatcttagagctggagaggatctcacagagctgtgctctccaacacaggagactctggccacgcgtggctattgaaaattgaaatatggctgggtccgaaaggagatgggctgtccataggaagtgcacttatcatcaaattggattttttttttttttttttgagacgaagtctcgctctgtcgcccaggctggagtacagtggcgtgatcttggctcaccacaacctctgcctcccgggttcaagtgattctcctgcctcagcctcctgagtagctgggattataggcaccccccaccacaccttgctaatttttgtatttttagtagagatgcaggtttcaccatgttggccaggctggtctcgaactcctgacctcaggttatccacctgcctcagcctcccaaagtgctgggattataggtgtgagccactgcacccagcccgattctgtttattatttatttattttttatttatttgtatttatttatttatttgagatggagtctcgctctgtcgcccaggctggagtgcagtggcgccatctctgttcactgcaagctccgcctcctgcgctcacgccattctcctgcctcagcctccccagtagctgggactacaggcgcccaccaccacacccagctaatttttttgtatttttagtagagagggggtttcactgtgttagccaggatggtctcgatctcctgacctcgtgatccacctgccttggcctcccaaagtgctgggattgcacgcgtgagtcaccacgcccggccctgaatatttattatgaaaaaaagaatgtataatatctcattgatttttgtatgttggttacatgttgaagtaatattttgggttactgtataaaattttacttgtttcttttactttgtagtgtggctattaggaaactttaagttggagtgtggcttgtagttgtgtctcataagatactttttttttgacacaggatcttgctctgtcacccagtgcagtgataacgatcatggctcactgcagcttcgaactcctggactcaagtgatcttcccgcctcatcctcctgtgtagctgggaccacaggggcgcaccaccatgcccagccaacttattttttgtagagacagggtctcaccatgttgcccaggctggtcttgaactcctgggctcaagcaacccacctgccttagcctcccaaagtgctgggattacagcgtgagccaccacacctggcctcacaatatacttttattggacatcactgttgcagatctaatgcggtgtaaaatgatttttaagtgcacactgatataagaaataacattggccaggcacagtggctcatgcctataatcccagcactttgggaggcagagacgggtggatcacttgaggccaggagttcaaaaccagcctggccaacatggtgaaaccccctctctactaaaaatataaaaattagccaggcgtggtggtgcgcacctgtaatcccactactcaggaggctgaggcacgagaattgcttgaacccgggagatagaagttgcagtgagccaagatcatgccactgcgctccagcccgggtgacagaataagaccctgtctcaaaaacagaacaaagactaaaacgttttggaactagacagaggtgatgattgcacaacattatgaatgtactaaatgccacagaattgtccagtttaaaatggttaattttatgttatgtgaatttcatctcaatttctctaaaaaggtgagttgatcttaaagtattacatgtgaggtacacaggtgtgtgtgtgggtgttacggtacaggaaatgacaaaaacttgaacacccctgttgtaagccatccctcttgagggagtggggactttgaagacctgagagaagtccaggcacagtggcccatgcctgtaatcccagcactttgggagaccgaggtgggtggatcatctgaggtcaggagtttgagaccagcctgaccaacatggtgaaaccccatctctactaaaaatatgaaaaaattagccaggcgtggtggtgcacgcctgtaaccccagctactcgggaggctgaggcaggagaatcacttgaacccagaggttgcagtgagccgagatcgcggcattgcactccagcctgagcaacaggagcaagactccatctcaaaaaaaaaaaaaacctgagagaagccccttggtcccagcctttctctgacagcagtggtgacaggctcagctctcctccgagtgcagccctgtcactgaccttgctcctgtctcagggctgggaagactgttgatgttgtcattccaaagatcccacctggatcaggggaacatcccccacagaagggttagccatacagtgccagattctccaggagaaattcaccaaagaaatggagtccccttggggacagattcaacttgtattgtcagccaggagctgacgtggcacttctgagaagaggccggcgcacctgctggcgggtgctttgtgcacttttcagacaggtcaggatccagcctgtaggcaaatttacttttgctttgacctgtaaaaccggatctgcccagccttcattctctccctggagaacgcctgcggccccaaagccaggcctactgatttccagtgaggccacaaatcccctccctggttagcaattcagttttcaccgccttgggggagagggcctgcccttccttgaggggaagaacctggaaggctcggctcagtgtcttctcttggaagagaagagtgtgcatgcagaagggtgtagaaaatgctagacgtgtttcatcttcttgacaaaatgacattgtaagatgtgtgtatatgtttttaaaaatattacataggggctgaacatggtggcccactcctgtagtccagcacagggaggcggaggtaggaagattgcttgaggtcaggagttcaagaccagcctgggcaatgtaggaagacttcatgtctacaaaaaaaaaaaaaaaaaatttcattagccaggcatggtgatgcatgcctatagttccagctacttgagaggctgaggtgggagaaccccctgagcctgggaggtcgaggctacaagaagctgtgttcatgcaactgtactccagcctgggcaacagagcaagaccctgtctcaaaaatatatataggctgggcgtgatggcttatgcctgtaatcccagcactttgggaggctgaagcaggcggatcacttgaggccaggagttggagaccagcctgaccaacatggtggaaccctgtctctactaaaaatacaaaaaaagttaaccaggcatagtggctcacacctgtgtaatcccagctacacgggaggctgaggtggcagtgagctgagatcgcgccattgcactcaagcctgcactcgaggtgacagagtgactccatctcaaaaaaaaaaaaaaaaaaatatatatatatatatatatacacacacacacacacagacacacacacacaatacatatatatatgtgtgtatatatatatatataacatggttatgtgagtatttgtatgtattttattaacagtaatgttatcattgtttttcagacctgcttttttaaaggctgcagaaaacttcactcttttggttaagaacaacatctggtatcccaaatttaatttcagcaagtaagtggtggccaggtgtgtgagttcaccagggtcttggagaaacttctggctcttctctcttctctgaggttttcgtcgctctgattttctgcttcctctcgactttaggaggaatatccttcccaacatcaccactacttacctcaagtcgtgcatttatgatgctaaaacagatcccttctgccccatattccgtcttggcaaaatagtggagaacgcaggacacagtttccaggacatggccgtggaggtgggtgcgggccctggctctcctgacccagccctggaggcgtctcgtgccaggtgctgaggaaagccttgccgtgtctctgctgctcatccccagggaggcatcatgggcatccaggtcaactgggactgcaacctggacagagccgcctccctctgcttgcccaggtactccttccgccgcctcgatacacgggacgttgagcacaacgtatctcctggctacaatttcaggtgggcgtgagcttgggcccctcgctcatgttgtagggggtgctggtggctgcgtacgtgccagtgggccgcccactgaagaccagcactcaggcagcaccccaagggcaggctgccggtcccccgtccaaggcggcgggaaggccatgctgggaaaatgcccttagtggtgtcctgctccggggccatcccggcccccgagacccctccttgccctttcctgccgcaagaaacatgttgagatggttcttagagcagccaggagaagctgggggcttaagctttccagcacctgcctcagccatgacctccattcactgcctcaaggagcggatgatcttgtgatcctccagtccaaaggcctctggggcctggcccaggaattggtttctcaaaggttgaacctgtgccagaatctccagagtgcaggggacacaggtctgaggcccctgaaaggccttgctgggttccctgctgcaaatgctggcatctcggtgtcctggggcagatgtaagcgagtcccacaaacagtggcttgcaactacaggacttgattctctcacagttctcacagttctagaggccacaacctaaaatccaggcatcagcagggctgtgctcgctctgaaggctctggagagagtccttacttgtctctcctggcttctggtagcccacggtgttccttggcttgtggatgcatcactccagtctctgcctctcctgtcatgaggccttctgccttgtatgtgtctctgtgtcttttcttcttgtaaggatatcagtcactgaatttagggcccaccctactctagtatgacctcatcttaacaaattacgtctgccaatatcccatttccaaataaggtcacactcccaagcttcaggtagatgtgaatttttggggacacactgttcaacccactacagctgatgatctcatgatcagaatctatagccaggtaaatttccacgtaccctttgttgcatttttcacagtccttaaaaaggaagcgctccaggccgggcgcagtgactcacacctgtaatcctagcactttgggaggccaaggcgggcagatcacctgaggccagcatggcgaaaccccatctctactaaaaaaaatacaaaaattagctgggcatggtggcgcatgcctgtaatcccagcaacttgggaggctgaggcaggagaatcgcttgagccagggaggcagaggttgcagtgagccgagatcgcactgctgcactccagcctgggcgacaaagcaagtctccgtctcagggggaaaaaaaagaggccctgcaaggaccatccctgggcgcggtcagcggtgctttgggctgcacttgcctccccctagtggtgacgtgtggaatccgatccatacgggatcctaagacctctgtaattgtgggatctgctgtccttttgaaccttctggctcactgagtaaagcagatatttgaatttttcttttctagcagttagatttgtgttattccatctctactgtcacacacttcttgtggaaacctcaagcttaggtcagagccctaaaacggaaagaactcaggacgcctatcccccaacctcgggcagcaccaggccctgcctgtgtctcccaggcctggcccatggcgtggaagttgtgggccagatagagcatggagctagggtgcgggccgaggctcctgatggatccctggagaacatggggcagcagatggtatgtcttgacggttcttcaccaaccatccatcccctgctcatgcgtgtgcgctctctcgcgtgctcgctctctctctctctcatatatgtatatgtatatatgtgtatatatatatatagccattatatatatagccattatatatatatatttttttttttttcttcttttttaagggagtgacttgctctgtcacccaggttggagtgcagtggtgcgatttcagctcactgcagcctttgcctcccgggttcaagacattctcctgcctcagccgcctgagtagctgggattacaggcgcccgccaccacacccagctaattttttgtatttttattagagacggggtttctccacattggccagggtggtctcgagctcctcacctcaagtgatccacctgcctcggcctcccaaagtgccggaattacaggtgtgagccaccgcacccagccatatatttttaaatggtcttactgagatgcaattcacatgccataccgttcacacatttgaagtgcagaattcatagttttcactatattcacagataagtgcaggcttcaccacagtcgattttagaacatttccgtcatctcaaaaagaaaccctgcacccttctgtcatcccccggcccctggcaacagtggtctactttctgtctctgcagatgtgcctcttctgagcatttcatataatcaatatgtggccttttgcgtctggctccttccccttagcctgatgttttcaagcttcatccatgtcgtagcctgtgtcagtacctcgtctctttttatggccaaatcatattctgctgtgttgacagacgacgttttgttcatctctttatctgtgtgacgaacgagtggttctttttgttgttgttgttgttgttgaagactgtgtgcacagaatcaatgtttctttgaaaaaataaataaatttaaaaagccctaggtcaagagattgagaccatcatggccaacttggtgaaaccccgtctctactaaaaaatccaaaaattagctgggcatggtggtgtgcgcctgtagtcccagctactcgggaggctgaggcagaagaattgcttgaactggggaggtggaggttgcagtgagccaagattggtgcccctacactccagcctggcaacagagggagactccatctcaaaaaaaaaaaaaaaaaaagtccctgcactgatgctgtgttggggctggcttagtcccctcctgcaatgctggctggtcacattcttactgttagatgttggaggtcagggtcccttgagggaggcaggcaggatgtaccaggtgggatgttgagagcaaactgttcaggttcaggagaggacactggtgctggaggaggaggtctccctgtgcccctgtacctcgtgggccccgcatcctcctgcttgcacagcccgcctcagccaggagaggccccgagccgctccagcgtccattcagccggcagagtggaccattcacctgtgccagctccactctaacgttctctcacagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaaggtagctcgccgccactggctcccctccgtcactccctgcagggacaaggggcctctccctgcccctgcagaaacactttttttctttttcggtgtcttggcaggcagggaaatttgacatcatccccactatgatcaacatcggctctggcctggcactgctaggcatggtgagtggtttaggccctgccttcaccctcacggtgaggtgagaccctgggctggggtcctggtcctggccctaggccctagacctcagatgtgtttctaaacttgaccctcctaccttctttcccttggcccccagccctcctcccaccttcccttctccaagaccacccccctcaggtcccagccttctcccaagagatgggagtgcctttccattccggtaaagattccaggcttctcaggaaggggcacgcaaagaataagatgggttgatgggttgcaagcatcctggctcactctcaccctatgctaaactcaggcgaccgtgctgtgtgacatcatagtcctctactgcatgaagaaaagactctactatcgggagaagaaatataaatatgtggaagattacgagcaggtaggcccctcctggcccccagcaggcacaggcctctcatctcttgggtgtgggagccctgggcgtgggcctgtctggggaggcccttctgcagaggctggcaccagtgtggcgtggtgtccccgttaacccgggcagtcctgccactctcagcagctgctccatccctaggcccctgtactagattgactctttaaacccagcctcgtttcaatgagcgacatctcaggttggtgatgataatgcatgctctgagaatgcctgtgggcacacactacttcagtgcaccttgcggaacaggaagggttgggttccaggcctgggaccaacttgagaacccctggcggtgaagtcccaggagcgcacctccctcccgcctgccacaaggggtcccaggggcaccttgatctgcttgtgtccttctttgcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttctt

SEQ ID NO: 36538 - DNA, 38173 bp, Homo sapiens
gccgggccgagccgagcgccgagcagggagcgggcggccgcgctccgggccggggtcccgggggagcaggtgagcgacccgcgccgcgcggcccccacggcccttggcgaaggcgcctcccggccgcgctgcgccggcgcccccgccttccctgcctggcagtctctgctcgcctctgttggcatcctcctcctcctcctcccccctgcctggcatccccctcctccccctgcctggcatcccttctcctccctgcctggcatcccttctccccctgcctggcttccccctcctccccctgcctggcttcccttctcccactgccaggcatcccccctccttctcctgcctggcaccttctcctcacctggcacttcccctcctccctacctggcatccccttctcccttcctggcatcttcctcccctcctcctttccaggtatctccccccactcctgactctttccgtccccccgcctggcacctccctccacccccaccccaacctcgtacctcttcctcctaccccttccttgcacctcttccctgactggcagactcccattcagcccctctgtgacaccacctcctccccatcgctgcctggcatcttcccctccttccctctccagtaccttcctatcctccctccacctgcatctcccctccttccctcgtctggcaccctcctgcctggcaccttcccctcctccccctgtctggcaccacctcctcccattgcctgtcacctcccccctgccgagcactttctcaacctgctcctgcctggcatgctctgcttcctactccccctgtctggcaccttccctccttcccctgcctggcatcctctccctccttcccctacctagcaccttcccatcattcccctgcctggcaccttctctgtctccacttggccaccgtcttccctggatacccctctcctattcaggttgtccctctgtcccccaccttcttgcagggcacctcccccccgaccctggactggtagcccctcccctaccgcatcttcctctcctcatcctcccctcccactctgtctcccggaccccaccagctctcccatccccagcactccctgtctccagcctcctccttcctcatcccctttcctcccaaccctgctcaggattgatccatgggcagcagcctcttttgctcacatggcttaaccagaccctgagccactcccaagccccacctctgtcacccacaccccgctcctacagcactgctctcttcttagctcccatgccccaccgtctgctcagggacttcatttcataagttgggtcctgacccaacgagctggaggccttcctgctcttccagcaaggaaggaagcagggcaggacaggacagagcaggcactagcagggaccaggagggaggcgcctaggccagctggtagtcatggagcaggctgactacctgcctgccacctctggagtccctccatgcccctgggctccagggccatcccagttaccatcctgacctgccctctggcctttgcctccaatgcccagctctctccctccaaccattgccacacccccaaaactggcctctccagtcagggcttgggctctgcctggggtccctgctctgtctttcaagttctttgtcccgcaggaccctggggccggtctctgtctgcttcccacacatactgctcccacctgcgccctgccttgtgccaccccagccccagctggcccatgctggttgcctccatcctaggcccttttttctgcacagtgtcctggcttcctcagacctccactccggggagtttggcttcttcgcagcttcccgaggcctccttgaatctacgctggggctcagggtctgacctctcctttcagatcctcagaatggcccttggtgctgcaggcgcggtgggctccgggcccaggcaccgagggggcactggatgactctccaggtgcaggaccctgccatctatgactccaggtcttcagcacccacccaccgtggtacaggtaggtgcttcctcccctgccagcccaggagcagaagctctggggccccatggcgagtcggccagccctcggctcctgctcccaccacatggccccctcccggcatttctgcccccagctggactccttagtgcccatggcagggcctctctgtccctctccccacccctgctgacacctgtcattaatgtccttccctccatcccacactccctttcctgcgtgtcctctcacctcctggtgtccttaggtcctgcctctcaaagcctttctgagccagggacaagctacctgaaaccaagttttgggttcatgtgagcatggtctgggctctggcatgctctacttcctccccacctagacagccagacaacaccccatctcctctcactgcgtacatgaagaagcgtgcacatacgtgcacatgctcacatgcacacacaccacatgctctctgcgagctggaaggaacctgctgattccttggcacaacttgtgctcagaaacctctaaaaaccctcagggccccaggcagggttccgcttgtggcaggagggaggtggcagccgtctactgcacagcccgcagtgggagccaaccctgccctgccccaggcggacctctagctctgatgcactctgggccattgcttgcttgtagggccttcctaagcctcctcctcaaggagtgagaggaagatggtctgcatttgtccgcatcagtccccacttgtccagaaggacacactgaggctctgggcagaaaagccacctgccccagagccccagctggcatggtaaggggtcggaactgaagtctggtctgagctctgcctgcccagccccacccatcatcacgctggctggcctcaccggtgggaggcacctggcaacagggtgggtactggcagggcctcaaggtatgtggagcccagtccctgtcctcagggcctgcggccttggagagcagccttgacaattgggcacaaagggccacagaccacacaggcctcagagcactgaggagggagacatcaggaaagtcctggaaaggtgcaattggaaatggcccagaggagcctgaggctcggggaggcctggggctgtgggcagaatgaaagtgctttctctgcttctccttcctcagaagtgggcagaggaactcatcctcctgccaggctgctctgaaggccagggacagccccgttccccttcaaactgccccagtgcccctcctcctccagtgaggtgcaggcccagggcaaaatggggcagggcaccggcttttggggaagctggcctggcccagaggatccaagccacacagggcagcagcaggcaccagtcacctggtacccatcaccaaggaaacacacctggtggcggcatgcccagccccacacctgaagccccagtccacctgcaggaaagtcaaggcctccaagcaaacgtcccacccttatccccaacacctccccagcacctgaggtgaactggggactggttgctcagtttgtggtggttggtgttttagctgaaattcataaagaaaaggtgagaactagtatattaaaccaagcactctacagttctggggtgtctgaggttagaggccaggttgaacggggggcaggctgatgggaggcagctaagcttcctggaggggtgcacctgaagtggtcccccacgtggagagtcctcctaatatttgacatgcccttcgttaggccctaaggggctccccagcagcagtcggagggagccttgggctgttccagacctttcctgaagggtcactgcaggatgggcacaggggaaggagggcagaggaggcctgtgaagattggagctggagccctggggcagtaggtccatcctagtgacacctggccccagagtgaccctggccatgagtcagaagccccagctccaagagtgacaaggtggtggaagtttggcatcttatcttggagttgcattcacatgcaatcggcggtgtgcgttgcaggctcttggcagccaggcaggcacttgggcatttggatgctgacaggccctggtgctggtgcctaggcgtccgtcctcaccccaaaactggcggtgtgactgcaagtgagtgctcatgattagtgaaaattaagtggtggagataatgagctagaggtgtcactgggaggaggctgagccacccatcggggatgagtggacttccctcagctgtggctggactcctaaccatctggaattgctgtaccagaggggccaagctgaggccaccgcctgcctctgacgggtacttggctgagggacatcttgtagggaccattgctgtgtccccctgtgctccttgctaatgaggggtgtgggaatccttggtgactcataaaggaccgtagaggagggctgatcacttcagccaggcccacattttgggatagcgcgttcggtttcttgactttccaagctgtgacaccgattcttggcactctacacttacttccagggatttgagaacgtgcctcatgagcgtgcgccccacacaggcctcctactgcaacttacaaacttggaccatctcccatgtgaacctttttcccagactgaagatcgttctgggaaaatgccctagagtgagggacactgtgccataagggagggagaggaagacacagggaggtgttcttatgctccgcctcatcctgaaaagggtttcaggtagtttgcaaagatacatatagtgaggaaactgagacagagatagagtagagaaaacatggtgttgcctaggatgtggctactgcaccaaatgcaaaccacgaggcccagagaccccgatgccagcagagaagcaagcagttacatgatttacactgtgcatgagataaaaatcaaacaacttgctcaaatcacgtgatttctggtcccgagccactgggaggtctctcctgtatgaggaaatgaaggggataccatgtgacaaagttatgcaatgttctcaacaatgtcacaactgcttcctagggctaaggcaaggaccaacacaatactccccagccataaacctactggtaatattgcttaacccaaacttaaaatttggagcaactagaggaatgcattgctaccttcaggaaataccctctttctcttttgtaagagacagagtctcacgctgttgctcaggctggagtgcagtggtgtgatcatggctcactgcagcctccaactcctgggctcaggcgatcctgctttagcctcctgagtaactgggactacaagcgtaagccacaatgccccctagcttttgtttgttttgtttttattttagtagagatgaggtctcactatatttcctaggctggtctcaaattcctgggctcaagcaatcctcccacttcagcctcccaaagtgttgggaggcatgagccatcgagcctggccaggaaatactctctatattgatatttacaacaatgtttctgataaatatcaggcagcaggaaggtttatttaaaattggaaattaagtacagagtcacattctccaggtaggggtaatatccttataggaaataaagagctccttaagcacacaggccccacaggtgagtttgggtatgaggagggaccagtcctggtctttccccacaggtcctgaacccatggaaaaacaggcacaggcatcagttaacttaagtgcaaggaaattcaagctgaagagaggcttgaacctgaggcccaagtgtagaaggcaggtcctactccctaacctgggtttgcttacctgggcatgggaacagaaggagatgatctgtgtcctaaaacagactcgtctagaagaggaatgctggccacagggtaagcagccttgccttcagcaccttcaccccacccgcctgggaaagggattgtgcggctggtgcaggccctcaccacctcatcagacaaagcctcctcccacagggaggaagggtggggagagggccagggtcattccagtatctcctctcctgggaatacagtacatgtttccttgtgaacacatgaagacaagggagtagggcccctctgcagtggggtggatgggccacattgctaaacagtgatattgaggctcaggtccagacctgaagtgaccaagtccaccccctttcttacctctccattggaacaactgccacatccttttatttgattttatttcctagataagtgtcaattccatctgcttctgatttcccacgtcactgccctggtccacacactgtgatcttctgcccccatctgagtgccgcatactcagccttgtccctgcatcagaccccggcccagcacagtaacgagaatgggcttcctaaacacaaatctgatttgttccgccttccacttcctagtggcttcattctcgtgccctcactcagggccctcacacatgctgttccctgcacctccgacacccttcccagctcccttcacctggctaactgcactcatccttgaagcctccacgtcagttccacctcttccagggaggctttctcccacccggcttgggcgtgaaggcccacccactctcttctgtcttgcagcacctaccaaagaggctaatactgagttgcagggctccttaaaggcatggctgcatctgtcttgttccacacagtacagagaagtatttcttgaatgaatgagcaaatgtgtgaggcagtggacagagagggggtggctctacggctgattctaaaatgagccccagatccctcttggtgctgtcagcctcaccctctctacaccaccacgatgcaagagtgggcctttcttgcctgccaaccttgtcctgctgtcgcctgagctgccctgtgccccgcgtctccctcctgtaactccgtggttggaggagtgctccatgctcattccctcttcagttattcctatggtgagggagaatgtcactccctctgaccttgggtttgccttttggagttgcagggagaaacccctttctccctccaagccatctgaccacctttcaacatttggaggcagctttcgcacaggctctgtctccgctcggaacatccagctctggctctttcaaatattcccagccttcgtgccccctggggagcgctgaagatcccccaaggccatggcccacacttggagccacctgtgcctgtgctagaaggtgagctctccctttccagccaggcagatggggaaggggtactcagttttctgagtgacatgtctcatctgtagaatgggacatcatgcccttctataaagaagcaatggtgatggcggaccttctgcacaatgcctgcgttcaccgagcgcccctcgccactgcaagtgttcacatgggatgctgagcgctgtccctgctccaggtgtcatctgtggaccccagagcaccatctaatgccaccgatgcctcccttggttgcaggtcccagcctgccattcatgctgcccgcatacgccactggccaccacccagacacgcagaagtccattcttcctgttccatatctgtcagccccaacatggagctatcttagctttagcccatctttccagcccacagctcccatccagcctgatgcagtctgcaggtgtgaaaggcctgtcttctttgcctttcataaagtttttaattggaaaaaagaaaaagtgagccagcagggcgcaggagagagccctgtggtccctggagatggctcagggtgggccggcagctgaatccacagcaggggactcgagggtgtgtaggcttgaaggaggtgctggtgggtcggaaggtgtcccccgtgggggcctaagtagatgcaagagaagctgagctccagcttcaggtctacagcacccactccactctgcccagcaggaagcagcactgtgcttttgccttttcctgcctcagtttcccttctaactcccccttcaccatcacctcacttgcatcttacccaggcctcttccttcaaaagaaaagtctgtctttgagacactttagatccattcagtgggcagggatgtctccccctgccacctgccatcacagcccccacctcagattcaagaacagctgccacaaacacagtgacctgcaggaagtgaaagagtgaagtgactgggggcagagtaatagcagccagtaaagactgagggatcattgtgggctttgagaactatttcaagaattttaggccagtcgcagtggttcatgcctgtaatctcggcactttgggaggccaaggcaggaagatcgcctgaagccaggagttcaagaccagcctgggcaacaaagcgagacctcatctctacattaaaaaaaaaagagagagaattttgtgtggtttaatttatcctaaccacaacactataaggtaagtgctgttataatcatcatcctctccagataaggaaactgaggcacagggcatgaaggaactttcccagtggtcagggcaagagtcccaactggggtctctccaccatatttagccctcagaaatttgctgtgcccaaacctcaggggccctcacagagacaagacagccacccctttattcagggtctcaacccagcccctcctcttttgcccccagcactgaggctcaaggtcaaaggccatttatcatctcacacacagcctgttccactcattgactttcactgctgtgtccctagggtcatttgagtttgtaacccctaaaatagggaatggggaggagatgtggcaaatcggagggctctcgcccctctgaaaaggggcagcccctcctcagctccacccgattgtctctaaatggactggtggtctggtcttgccaaatttctcattttttaagagattctggaaatctggctttgatgtgaaatctctcagtctttaaggttggtgcctaattaaagtgtttaggacacagtgagggctgagcaaaacctatctgccctgcccagttcgtaacactcaccttgagctttccttgcctgccacttgtcccctgtcctcccttctatcccccagcccagaaaacaaaccagcatttctccctgagaactcagggcccccagtttgagaaacactgcattaagaattgctgtcactttatttgtttatttatttatgagacaggatctcagctctgtcgcctaggctggagtacagtggtgcgatcatggctcactgcagcctcaacatcctgggctcaggcagttctcccacctcagtgccccaagtagctggaactacaggtgtgcaccaccatacccggctaatatatttaaattttcgtagagaggagtcttgctatcttgcccaggctggtctcaaactcttgagctcaagcaatccgcccacctcagcttcccagagtgctggaattacaggcttgggccactgcacctggcctgctgtcacttcagttggcttcttgtcaacaatgaaattataaacaaaatgcagagtcttttcaaaaacttgaggaccctccccctagaacagatctgaatcccagtttgagaagcagtgctcataaatcctcatgatggctgctaatgggaagggcaggggctgttgtagaatccctctcaacttgtctgtgtcttaaacccggagtaccaacccctgaggacttcgcagtacattcgataacgaatgggggagcagtcagatagtgactcagaaagaacacggaccttatgatcagaaaacaggagtttgagcctcactttcaacattaactcgctctccagctctgaatcagtctttaaagaactctctacgccttgtgttcctgtctttaaaatggatacagtaatagtcatcccttcagtttcctggagtgtggagagaaccaaattggataatgcatgttgaactgttttgtaggctaagctccatgaagctctatgtgttaatttggaggtgtttgacaaagtgtttccctatatctttagggtatgatacataaacgtgggctggatgcagtggtgtgcgggtaaatgtttaacaactggctcttggcaggacggggagtgggagcagaactccggtttgtatcgttcgccaattcctgtggtataaataccaccagctgggtgcagtggctgggcctgtaatcccagcgctttgggaggccactgcgggaggctcgcttcacgccaaaagttcaagaccagcctgggcaacaaagcaacaccccatttctacaaaaaattttaacagttagccagacatggtggcatgcacctatagtctcagctactcaggaggctgaggcaggaagatggcttgagcccaggaggtccatgctgtaataagccatgatcacaccactgtactccagcctaggcgatagccagaccctatctcaaaaaacaaacaaacaaaaaaaacctcccatattggctgatgttaagccgctgacatgacacactagcacattgccggctggatgttacgataattgggcaaatttgctaagaattgaagaaagacgaagccccaaagggtgtacattagtctggagagagagagccttgtcttgcttcctgtccctttctcaatacattcagcaaagatatagatgcagatcgatggtcacactcactggatttgtaaataacacacagccagaaaagatggtgaatattttggataacagaattaatattcaaaagctgtcaacattcaccttctagaaattatgggctaattcttagaagatgaatattaacaggagtaaatgttctgtgtccattcttgagacaaaaagacaactttacaagtaggggatagggagacatgttttgcgtagagtagaaaaaaaaaaatggccgggtgcggtggctcacgcctgcaatcccagcactttgggaggctgaggtgggtggatcatttgaggtcaggaatttgagaccagcctggccaacatggtgaaacactgtctctactaaaaatataaaaattagctgggcctggtggcacgtgcctgtaatcccagctactcaggaggcggaggcatgagaatcgcttgaaaccaggaggtggagattgccgtgagccgagatcacgccactgcactccagcctgggcaacagagtgagactccgtatcaaagaaagaaagaaaagaaaagaaaaaattgaggttaaattgacaataaggtcaattcaactccacagtgcaacgggtgattaccaaagagtgataaattaatggccatgatgactttactcagtactctgtgacttaaagagaattttcacatatggcaaatcattactattttgctattcacaataacccagtgagagaggtaagatgataaatacccactgatgaggagaccgagatcagagaggttaacggtgacttggcacttttatcctcctgtcaatggatgatggaataaaggctcaaactcaggccttctgacctgggttctgccctgtgctttgcaccctgcttggaggccttgctttcatcgggcaaaccagaggatgttccaaggggaggcccaggtggtaggtggactagcaggcaggtctcgtgatgaccgccctgggagtcctgaagagcagagctgtgggggtgttgggtcactagggccaccccaacaaaggaccgcagacctggcagcttaaacaacagagattcctggtcccagtgtcggaggctggaagtctgaaatcaaggtgtcagcggggttggttccttctgaaggctgtgagggagggatctgtctcaggcctctctccttggctagaagttgagcatcctctccctctgtctctttacatcatcatctctctgtgcaagtctctgtgcccaaatttccctttcttgtaaggacaccagtcctattggatgagggcccaccctaatgacctcattttaaattgattacctgtttgaggaccctctctccaaataaggtcacattctgatatattaggggttaggactccaacatatgaattttgggggacacagttcaacccatagcagggggactctgacaggtgccttcagaatttggagatgtgtctaacagaggagcgagatggtcagagcctcagggagctgacaggcattcaaaaccctgggctatccccatcacaggaagagccaacgccctgagggacaggtcgactccctgccactgtccagtccttgggcccctgggctgctagaacactaattccccacctggctccatgaagagccacagggcagcctccagcctccccttctggcagttaccctgggcagttagtatgccagcttcccagctagtcccgggcctggccccacggtctgctccccctccaccgccaccaccactgcttctgccccatgctggctgccaacactgcctccagcagaggcttgggcccagctccactgggctccccagaactccatggatcccaccatttacctcctcacctctgcatcagggagaaggaggtggcctgctgaggagttaggtcttcagggggtgattgcctccgtcctccagaggaactcccacagttcctaccccaggtgctgacctggcctggtatggtggcttcttgtgtgagaccatcttcacagcactcaccctgggcttcgggatggcctacaatcatgctctcctcttcccacaccctgtgccaaaagccactgccatcctggggcactttccaaggcaggagctgacattagctcctctctgttttggggcaaaatcctgactttgaccgggtgcagtggctcacacctgtaatcccagcaccttgggaggctgaggcaggcagatcacttgatgtcaggagtttgagaccagcctggccaacatggcaaaaccctgtctctactaaaaatataaaaattagccaggtgtggtggcaggcacctgtagtcccagctacttgggaggctgaggcaggagaatcgcttgaacccgggaggcagaggttgcagtgagccaaggtcacgccactgcactccagcctgggtgacagagtgagactatgtctcaaaaaaaaaaaaaaaaaatcctgtcttcaggaacctgaccttcagacccagtggctgatcattgcaggtcaagagaatggcaggtgcagaggtcctgaggtgggcagggacccaatgagtttgaggaccagatagggactggtggagctgaaggcacccacaaggtggagtcacccctgtgagccctggcaaggaatttggattctgtcagagctgtgaaaccattgtcagatcttaagcaaggatgtactatggtcctcattgcattttttaaaagatcactctggccatgccgtagagagagacagaatggagaaatgggacgatcagtgcagaagaaagatggtgccggcctggtccagggtgatgacagaaaaaaatgcagagaccagtgggcctgagagatcagaaaatggtgaaaccaataaaatttgcctatggattaaataggagggccaagggagaagaagatgttcataataacaaccatggaacagcatggaaaatggccagaccctggagctgggctgagggaattggatggcttgaaagatatggcgatgtagatgggcaggattgaggtttggagggataagagggacattctccaaggtggaacctggggagggcaaagacagggctttgaggctggtgaggaggcccccttggtgaaagtggtagggccttggtggacacatggacatcctgcctctctctccccaacctccccagctgccttccaggtttgaagttgtggttacagcttcggccttgatttagatccctcagaacaccccttggcatttttttaattaaaaaaaaaacatttagcaggagtgtctggcacattccacttcttcccatcaagtctgcccacagtctctgggctaggatctagtctagacacaggctacctggatgaaaatcccagctctacccctactagctctgcaaccttacaccagtcactttgcttccttaggcctcagtttccccacttataaggtgggttaaggattttactcgcaaggtagggtgactgtgaacattaattgagctcagaacaaacagtggctgctcccagtaagagttgtgtgtgctggcttccctgttactagttttagcctgctgggctctgcagggcacctgtcctgccctttccactattcatgactctcgccaagataaagcatgagtcttgggtgcctctcccctgaccttcacagaggagcccaaggaggcacagcccctgagacccacagcaccccatgccagccttgggcatcccacccagttggggctttccctggctgtgctcagggtcttgcttaggtgtcgctactctgagacacctgttggggtagccctgccccaccctgttaggggcccctcctccctgctcccgcggggccctaaggacacacctggcacaaagccctctatccatcttgtctttctcgatgaccaccaggtctcaagggcaaaggccatgtcatgggtgtaaatgggcagtacttcccaggagctgccccaaaagaggtgctcactaaacgtgtagaggacagaaggcagaggagcacatggggtgggaggaggccctacttttctttggatgccgttaccagcagttcccaaacctcagcttttctaggccaataactggccttacaaagtctttttaaatttaagtcccaaagctgggcatggtggctcacgcctgtaatcccaacactctgagtggccaaggtgagaggattccttgagcccaggagttggtgatcagcctgagcaatgtagcaagaccttgtctctacaaaaaaatttaaaaattggccgggcatggtggcatgtgcctgtagtcccagctactcaggagggtgaggtgggaagatagcttgagcccaggaggtccagtgagctgtgatcacaccactgcactacagtctagacgacagagcaaaaccctgtctcaaaaaaaaaaaaaggttgaagtgcagtggatgtgctacatgtggtggcttctgaatgtctccctcctgtcctgcagcccaagctgcagcccccacagctcagttgcggggccacaggcttcccacagcatgacccctgcatgctaacaacacttgtggctgctctctgcccaaggaagcgtccagtggcttgagtagaccccacacttcccgcagggctcccagagccaccgtaattagccactgtgaatgatcacctggctggcttctaagagcagcagctcggccctcgcttgtacccgtcatgccatttgtgatgagcctgccgctgaagggctctgagagctccctggttccactgcgccccaccctagctgggggttgtttggcagcaggatcatccaagtccgggagataaggcagatgagcagcagccaaggccacagggaatccaggctgtgagacaggcaggcaggaccactgggaagctgatgttaacagctgctgctcgttaagtgttgaccctgtgccaggcactgtgctgaattctgcacatgctcaaccacattttaatcttcacatccacccatgcatcacgtgagggacccccagttttgcagatggggaaattgaggctcagacaggtcaggtaacatgatcagggttatggtcactcagtggctgggtggggtttgaacccagaaccaattgactcaagggctgtggttctcaaccctggggcaatttcaccctccagggacaagggtcaatgtctagagatactttgtttgccacactgggtagaggatagaggccaaggatgctcctgacatcatacagtgtgcaaggcagctcccacagtaaagaatcgtccagcctgagatgtcagcagtgccaactggagaaaccctgttctagaatccaggctaggagccatcacaccgtggactgcagagaccctgcccagggcagtgggttcaggcaggggtagagagcacagccagccttagttacaaggatttgccgagagcgcgccccaacatctgccgcctccccaccgcccaccccttggtgagtcttcatgaggcttcttggtgccactgtagccatttgagccccagagtaaagtctgctgagttactagtgtgctgtgtggggacggcaagatgctgagcttactgtgaagtccttggtcatgaacaagcctcacaagccccatctctttctcaatcccacttacgtttgcctggttctccaagaaattggtggtccactcagcctagacagagcctgttgctgttctcatcgcttctcctacccctcttaagggccagttggatcctccaagttctccaaacctagcaccaagtggcaccaggaaggcaaggtgaggtggtagggggctgtccgagggcaccgcttggctatgtcggggtaacgacatgttcccaaaggatagccgactgaggtccaggtagggggcggggtggcgtgtcaccatgggattcaggtgtgtacgtcgcacaggagttacacttggttgtgaggaccacagaagccagaggagcaaggggcttgttccaagtttaactagcattcatttttttttcttgtttttggctaaaaagtaatatttccacagtaacaaagggaaccttctcaaatttgaaatttatttcagacaccttggtagtagcacattttctagaatttgtattcccaatgtttcgaacaatcagcttgagattttgaggggtgtgtttaaaacgataattaagggtaattcagcttagctctgcaggcttccagggatcttgatttccttctttaaaaggcaggtgtttggggaaggtggggtgcgtgtgttggttagtctgtcactacccccagcaggcaagctttagcacggggacactggggaggcagcttggggtaaaggagaaaacccagggaccttgaggacaggaaacctgatttgcaatcctagccccaccctgtgatagcacagtgaattttggcaagtcacacaacttcttagagcctcattttcattatctttataatggggaccctgccaggaacctgataggcttatctgttgggatcagacaggttactgtgtgtggaagtgcttggtcaatggtaaagtcctatacaaatctaagccgatgttattactcctatgataacaagtcttggccaggcgtggtggctcacgcctgtaatcccagcactttgggaggccaaggtgggtggatcatgtgaggtcaggagttcaaaaccagcctggccaacatggtgaaaccccgtctctactaaaaacacaaaaattagctgggcatggtggtgcatgcctgtaatcccagctacttgggaggctgaggcaggaggatcgcttgaatccaggaggcagaggttgcagtgagccaagatcatgccattgcactccagcctgggtgacaagagtgaaagtccgtctcaaaaaaaaaaaaaaaaaaaaaaaaactctcaggttgtaacctcagctggcatttggaaatccgtgctgaagatcctgaacgggcttggagtgggctctcttcacctccacccatcacatgttggaggttctgccatgtgccaggtacttgggatttagcagtgaagaaaacagataaaaagccctgcctcctttagaaacacacacacacacacatacacacacacacacacagcccctacctttttggagcttacattctttttttttttttttgagacagagtctctctctgtcacctaggctggagtgcagtggtgtgatctcagctcaccgcaacctctgcctcccaggttcaagcaattctcctgcctcagcctcccgagtagctgggactacaggtgcccgccaccacgcccagctaatttttgtatttttagtagagacggggtttcaccatgttggccaggctggtctcgaactcctgacctcaggtgatctacccaccttagcttcccaaagtgttgggattacaagtgtgagccactgcacccggcctggagcttacgttctaatggagaaaaagaaaagttaggcatcaatgtaagggagtagatgatatagaagggtggaagggtagggtcctgtagggaaagtggaggggaataaaagaaatgggcgtgtggagggagagggcttgcagtttttaatcagggagacagactgtgcctcattgagaaggagacatgtgaacaaaggcttttgggaggtgaggagtccgccatgtagattgccagaggaagagcatcctgggctggcacggacctggagtttccaaagcaccacagggagcccagaagccagggcagagagaaggtggcgggggagatagcaagaggtgagagcagaggggacagggagtaaggatgagaccagatcctgcaggaccttcaggaccttggcccttgctcggaataagatggaaggcctggagggtttagagcagagcaatgccataatctgactccctttttctttttctttttctttttttttttttttttaggcagagtctcactctgttgcccaggctggagtgcagtggcgaaatcttggctcactgcaacctctgcctcctggattcaagcgattctcctgcctcagcctcccaagtagctgggattacagttgcatgccaccacacccggctaatttttgtatttttagtagagacggggtttcaccatgttggccaggctgctctcgaactcctgacctcaaatgatccacctgcctctggcccctcaaagtgctgggattccaagtgtgagccactgcgcccggccctgactccctttttaaagaacctgttgccatgttgagaacagactgttggggtgaggctggaagcaggctacccagtagctgtggtttggatctcgggcggcatccggggagaggtgagaagcagtgggctgctgggtccagagccaataggatgtgccttcagagtggatgtagggtgtgagggaaaggcaggggtccagggtgttccaaggtgtgggcctgggcagctggaaggagggagaagactgggcggaggatggggtttgaggcaaaagagcaggagctcattttggaccgaccatgtttgagctgtccactgaagacccaggtggaaatgccaaataggtgattggatagatgcgtccaaggactgggagagaggaccgggctggaggaaactgggagctgccgacatacgggtggtgctggatgtgatgagaccgcaaaaatgatgagatctccgaggaagtgagcgtggagaggtgaggaggacccaggcctgagtcctggcgctcctgcatggagagggaaggagaactggatggtccccggggactcagaaggagcaacccgggaggcaagaggtcagccaagaggggaaagtgtcctccctccacgggaggaaataattgaaagaggacagagtgttatgactttgccgggtgcagtggctcacacctgtaatcccagcactttgggaggccaaggcaggcggatcacaaggtcaggagttcgagaccagcctggccaatatggtgaaaccccatctctactaaaaatacaaaaattagctgggtgtggtggcgggtgcctgtagtcccagctactcaggaggctgaggcaggagaatcgcttgaacccaggaggcggagtttgcagtagattaagaactgacggcagcatttgccaatgtggaggctaccggtggccctgccaggagcatttcagtggagcagcgggagctgcatctgacaggattgggattcagggagaatggaggagcacaaatgagacaactcttttcagaagttttgttgctactgggcagcaacctgtaggataagtagggttaagagagattgtttcaggaggccgggtgcaggggctcacgcctaaaatgccagcagtttgggaggctgaggcgggaggatcacttgagcccgggagtttgagaccagcccaagcaacatagtgagattttgcctctattttttaaaaagtaataaaaaatgaaagaagagcgcttattccaatggggatgtaacagtacttgtgcatgctgctgggggaactccagggaagaggggaatgttgatgaaatgatggtgtgggagagaattgctggagcagtgtccttggtgtggaggagggacggagctggcacacggaggcacggctggctgtagtcgggaacacagatagctcatctggaggaacgggatcagctgctggcaggcagagggtgtggtgggaggctctggaagttcttcggaagcttcttttttctcagtgaaggggaaaacgggcacaagctgggagtgaggaggatggaggagaggttggaagtcagaggagggagaagctgcaaaaaactcctgtcggggtgtgggagcgggcatatttgtgactgtgctgtgagaagagtggcctgccgggcagcacgatgccagctgagctcgtgccgaatccacaatgagaccgggtggggtggctgtgtgtctttctctggccacattcaggtgcgtggttgcaggggaggagctggtgaagctggatttacctcttaagagagtcaagagtgtacacaaggggtcaggtgcagtggcttatgcctgtaatcccagcacttcaggaggccaaggtgggtagatcacttgaggtcaggagttcgagaccagcctggccaacatggtgaaaccctgtctctactaaaaatacaaaaagtagctaggcatggtggtgtgcacctgtggtcccagctattcaggaggccgaggcacaagaattgcttgagcccaggaggcagaggttgcagtgagctgagatcgcgccacctgggcaacagggcgacactctgtttcaaaaataaaaaaaaaaaaagccaggcgcagtggctcatgcctgtaatcccagcacttcaggaggccgaggcaggcagattgtctgaggtcaggaagtttgagaccagcctgggcaacacggtgaaaccccgtctctactaaaatacaaaaaattagctgggtatggtggcaggcacctgtagtcccagctacttgggaggctgaggcaggagaattgcttgaacctgggaggcggaggttgcagtgagccgagatcgcgccactgcactccagcctgagtgacagagcaagactctgtctcaaaaaaaaaaaaaagtacatgcaagggaggttaaaatggtcaattgtgttatgtgtcaccgtcaaaacaaccaggagattcaatgtgtaagagcaaggggtagctgtggggaggggtgcagagtggtgaaatgaagcagaggttccagaggagtcgcaggatttggaggtcagggagctggacagggtgaactggaaagaggaaaaagaggagacggtggtcagcgagtagggtgcatgggactgaaagtggggggctgcggttgctgcagtgatctaagagatgaccttgggagtgcatggctgagggaacagggaggatcgctggaagaggagctgccaaggaatggagaggccagagatgtctggaagagcatgcagcaggctggacaggagtggtgctccggagagtgacatgagccaggagccagaatccgcacaaaggaagcctccctagctgggggtaagatgcagagccagggctctggaaacagcagtgaggggcaatggggggccatacccacccttaggccagtggtcgagccactgctggaagggagcctggcatctgcttctggaaggcaaagaggatgcttccagaagaggtggagcatgttggaaatgttccttaggacagacaacacagtaggagggtttcaggggctggggagagatggcaactgtaggagggtctagggccttgtggggctcaaagtgcaggagttgagggggtctggggctttctgtggtgactgatgcaattggggataaagggcagcatgagattgaacctggtgccctcaaggccgagggcaggtcgagggctcccctggccccgtggtgcagagtggaaggtgcagtgtcagacctgcaaggacagccgggcgacgagtccgcgcagcacttccacgggggttttatttacacatcccactgcccgctgccatttgatttaatattcccaaaaatttgtttagaaatgcagatggactttttgttaactattcacttctcttcactccggtgacacccagaccccagaatgcagtgattggcaggaatccccctaaacacctgttcagagcagtagctgaggcccgttcctgcctcacaagtcctcagaagcttcccgaggtgaggggcaggacgctgggccactaggattgccctgacactgtcatggggagctattagctgcaaaagacagagaggagaattggaggtaccagaatggggctcccctcactaagaaagaggagggctggggcctggggaacacaggacacacgtggagacagctagcagggtggccaaaggcctccccacaccaggcagggtggaagaggcagggcgctggcccaaagccctggtgaagcgggcagcactctgtgccttgccagcatttccagaggcagaggttggagggaaggcagcagcaccctcatgtcacagatgaggacagagctccagggaggaaacggcattccccgggccacatggcccgacatgagcagatcccaagtcgaccagaagccacaaggctgccccccagatccctggcagccaacatctggatgcagccagcatctgtagagagatgggaaggtaggtaggatgtctcagacatgcactgggtgactcccctggcacctcaggcatttgggacacggctggggcagggcaggagtggggccttagcagagccaggggatattatggggatgggtgggcttcccagccctggctgcctgttaaccaggaggccagtggagccagagatggctcccacacacctgggaggaggagagggaaagactggctactgtttggagtctcaaccaccctatgagtcccgaggccatgcgatccccttgtgtttgccctgggtttcagccacatctaagccactgaatctggccagatgtgccaggtgttgatccggagggagaggagaggagagtgaggatggttctgagtgacccatccctccctccagggccatacagccagcaggtcagggcactgcccaattcagggtccctggacgtggccctattgcccgccagcagagccacaccctggaaggtgggagagaagttatagcacccctcaggatcccatgtaaacaccatcccacagcccagccctgtccgtgcagaaatggggaccaggcctgtgtggcacgtttttatggggtgtgtgacctgctacaagcgaccacctcattaatggggagtaagagaaaacctgctgtgaatccaaaatgtgccttccctgtggccagcgggatgctcagatcccagcgcccagccccgctctcctgccaccagcagtttattgtgttgtgtgtggtgggaggggtgtcaaggagcatcccattagactgaggaatcccacgcaggcaaagagaggaaggaggcctcattcattccactaaccttcgcatgcacctgcctgccacacaggaccctggggaccccaaggtaaggcccaccctgctgtctggatgctgaaggtgtaggggtgagggctcagccaggtgtgcgtgacaggggcagagccacccagagagagctactctgaggggaggacggagggagtgagtgggagggccgcgtccctgaggaccccatagaggagggggtgctgagctgggaccaggcctcactcatggtgagcagcccccactcactcggtgcgggtctgcttcccggcacagctccgtcgctctgctccctccctctgtccccctccttcctcccagtctgccttggttcctgcctctgtcttaggaaattcttggatttcagagctggaagggctctaggaatgctctgacttaagcctctcctttcacttctgaggacactgagggacagggaggtacagcgacttgcccaaggtcgcaccattattttggtgtcctagtttttctttgttttttgcttctatatattgcatttgtctctttcgtgtatgtttgcaaaagtgacacagaaagacaaagtcacacagagagacagcccccttgatagcagcagagagtgtcgggggtacagaaacatcccaacacaaacagggaagcgcacagctgccctggcctggaagcagcatgggggcagccaggaggaggaggaggaaggtgcctgatgcccctggcctggcttcggagcgtcccctctgctgaccgtcaccagaggcgggggttgaggtagtctcccctcctccctctctggagctgggcgtgaccccaaggactagccagaggtcccccgaggctggtgcttagcccgggcaggtaggctggatggcggaaagtggggcctggtttagagatggccagaacaccgaaaccaaggctttgtggtcctcacagcgccaagtggtctcactttctccctctctctttctttctctctctccctctcctctcgcgttctctcgctctctctctctctcacacacacacacacacacactcactcaggccgccccagtgagggtgatcgtattctcctaaggagagctttattgctgggggtgtagggaaaagggaatagaggaaagagctctctcccaagcaatccgttctccctccagtctcgcttcctttgttcctcccttcccttcctccctatcccctcgccagcttctcttctctccttccagccccttcttccatgttccccgctctcctgctcctcctgccgcgccccccgagcggagtccccgtggtgggaccttcacggagggcaggagggcgggactgcggctggggcccggcctaggtggccatcttcccgcagggaaggagttaagtctcttccccgcatccctcctccctccgccgcctccccggccgccgcggagtcctgcagctgggccccgggctgaccttcaccgggagggaggccgcggcgcgcatgcccaggccggggaccggcgcgggcggagggaggggcggcgcgggccgggccggcccgagcccccccagctccccggccgccgcccgctcgctcgggcgcggtgggggcgaggcggccgagcccgtcccgcaggccgcggcgcatctctccctgcgcggggagcggcgctttgccatttggtgctggtggtgcttcagcgagggaaggagcgatggggggacggcaggggggactgcggcgccgggcgccgggcggccgccctcgcccccgacaggcgcacggcctgccccaagtgcggcgggcgccctattgcgctgggaggaatccacgctcttcccgggcctccttcccacccgcaggagccatcggcggcgtggcacaccgagcgcccttctggggttaagccactggggatcctggcctttgtgaggagggagccctggcccgggcccccacactggcgccgccccagctttctggtctgaaggctcctcctgtcgcccacctaaaagcagtacgcaaatgtgtctgggcctgccttgtgaatggggcccaccacgggatgtggaggtgctcaaggtgtgcctgtgtgtgcagagccatgtggcttcctcgaccttttggtgcttgtattggtgtgcctgctgtgtgtgtgttgggagggtgtgtgtgcaaggtgtatctattgtctgtgtacacttaaggatgtctcccagaggggtggctcaggagagcgcttatgtatggacttgggtgaagctcaccagctcctccacaggggcttcaccatagcccctcgtctaactacctcccgcaacctcttccaccaccaagaccaagcccgggatctcccaggccctgcctcaaacttcccagctacccaaactggagtgcccagcatctcctctgctgtcttcttttcccaaaaggtctctccaatagttgagaacactgagctttaacaaagcctaggggtgtctatctccaacccccagaacctccaaggcctgtggtttcccatgcccctgctagacgcacccatggtgggtgggggtgcccatggtaactcacaccatcaggtaaatggcagagtaccagctccatgcattggctcattaagctttgcaagcatcaggtatctggggtactgttgagttcctgtgcccaggcatggaggaagagtgggagttaaagatcagtctctgaccttatggggaccttagcctctctgggaaagcaaagctaatgtccttgaagcacagtgcacgtcaggccagtccaatgccaattcatggtgctgggtagatggcaatgagcatttggagaagagaaaaatctttgcatacaagtaggacgaaggaaggcttcctggaggaagtggggcctgggctgggctttaaagaataggtgtgatttggacaagcagagggaaggcagagggcaggcaaagggcattccaggtaaaagaatcgggggcaggggctaagaaatgggagtgagcggggattctggaggttagcaggcagactgggcaagtcacttccccaggttcccagcagcatgacctatggcagacagaggcaggccacccacccatccccaccgtgtcagggcccaggctctgtgtgtgggggtgtgtggggggtagtctaggctaaagccctgggagagatttggtagcaaggggatctctaggtcccctttcaagctaggggtggtggaggagcaacctggaccagatgtcctccctgacatttcagattgacagtgggcacctaaatgaacagtgacagccaagagcacaaccagggccagcagaaatcaggctgcaggcagaaaggaccccctgggcaaaggcattctgaagggtttagggtcagtacccttcagtcttcagggcccaacttcaagtaagtgtttcaacaaactcccctaggcactaggctatggtcctgccctcacctggattctcacagtgaggccccagcagacccccaaacttgacccaagggccttgttccaaagcccacggctcctccccaagaaggagaaaaaaggggcgtggcctttggggacctgggtaggcccaggactccctgcctgggtatgtcaggatttgcccctcctccttccggtccctcctccactccagggactgccaactccttccacacgccccttctggggctcccttgccaccccacgccacaccccagcctcaagacccctctctttggggtcttgaggccggcccaatatacccactatacccagcccagctgccccaactcctctgggtcccctaaccccactccacccccaccccaaggaaaccaagcccagcttgcctcgttctctccacgcacccacccgagcacccccctggcgctgcgccattccccacattcattctcttcctgttctcatgagcacaatccctgtccctctttctgaaatacttcccctattgccctcactttctcacagagcggcaaacaaagactcacatacccagaaatagcctctcacagagctgaaaggcacaggccatgtcctgccacacacgcaggcgcgcgcgcacggaggctgtcgtggagggaggcacacatacagggcgtctgtctgcacgcacataagctgccacgccacaaaagggcgcggacacacacggcgtgtgagacaagggcacacacagcagtggacgcagggccacgccgccgcccgggcacacccaccgccgccggccccgggcaggcgcgaggcctcgcgggccgggctcccccggttcctgccagcgaatgtttccctgctcggcctgccaggtctctggggaaagggcctcagaaatgcagcaggagccgctgggggaaaagttggaactgactgttccctgcctggcgcggccggcgaattccctgacggagaaactatttgtggcgagagccggtggccggcgaccccccgccgcctcccctggcgtcccctccccgcgccgcctcccgcgggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggcggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtggtgagtgggggaaagttagcgggggagggcaagcgagctggctcgggctgaatggagggctgatcgggaggggccgggagggcgctcccgctctcccacccctctagtggggggcgtcatggcccacggcccggccgcgggactgtgctggcgccctggcacccgaacacgtcgccaggcggccggccgggtctgacgcgaggcggggaagggaggcgtttgcatggctcttgtcaggggcgggggtgggacttggggactctaccccccaagtagggggtcctcgctgtagccgacaggttgactttcgttcttttccttgtgggcccaggtgttgcccctgccctgggggtgggggtgggggatggggacatggcagaggctgggctgggctgtctgttcatccgttgggacagtgtcactgcttgtgtctccggagcaaggagcaggtgaccctggaggcactgtagcgggaagctcgcaggctgagccacctctgcatcccagcgggagggctctggagcttctgccttagggtgggggagaggaccgctctagggacttagcccaagttaggggctctgagggtctccttggcggactcagccaccagaagctgatgtccttaactcctcgaacatgtgaaggaaggggctggagttggggacatgaggcctagagaccgaagggacaggggagcactgtcctgccacaggcaggctgtgaaggcacgtgggagcccgggaggctggagctgagtcagtagggcccggctgggaggggtatggaggggtggggaatgggagaagcaggggctgcgactcttgggatgggtgagggagtggaggccctgtgtagaggaagctgtcgggtttactatggccaaatttggttgtgaccccaaggaagacaccctctcagtaaggccagagtccctaggattttggcctttcatggggatggggctggtggcgggcacagctctctgggggctctgaaagcctccctctcagggcctcttcagcagatgggccagtatccctggccttgataactggggagagcagctgacaggaagagggggactccctggagtggcctgtcctccagccccagggacccctgggggtaacttcccaaggtgtccatgtcagctagctgagttaccagtcctaacctggctgctggtgggagcccctttaaaaaggcccatctagtggggagaggctgtacacgtggactgtttttttaatctggtcaacttacagcttcagttcttgagtggctgtgagccccagtgccccacctagctggtggccaggcctgggctccattctgggctgctaccctggaggcctgagtgacagggtcaggtggggtgagggaagcagacacatggacaggcaggtttcactgcaggagagataggcagagacagctgctgaccgagggtgggaggacattagggttagacacagagcctggaggaccaggagggagaggtagcagttggaaggaaaacagcaagcccaagggggcccctcctcatgcctgggggtgaggtgggtggtgtgtccatgttaacagtgccagggtctgcatcccctgccctctgatcttcttcctgctttcgtggtcccagtccccatcccaccccgctctttctgtttcacagcccctgaaactctctctggccctccccatctcccttctggagtctggacaagtggggtttggaacacttcgctcgatgcatttgcatctcatttacaccccatctgaccacccaggggtagtggcaagggaggaggagccgcctcctctcagtctccacagcccccatgaaccctgactgctgacctcactggggtggggatgggaagaggaggaggtggctgctgacctgggcagacaggaagggaaatgtgagtgcaagtgtcactgccctgacccaccccaggcccccctgggcagcccacctctaacgcagttcccctcctcccaatcagagaatcctggctgtgtctggggcgccccagcaggctgcccttgcctgccctgcctccagccctcaccctgggagcaaattatgggggcagcttggtcagcgaagaccctggatgtggggacttggagtcagccgaggggagtggggtttgggacccaagggtcaaaagcagggacacagggagcagagtggctgagatgagctagtgagtaccaggcagaaccgcccaagaagtggagcctgagaaggaggagcaggaggaggagcagaagtcggagcagggagccgggtaccggacctcaaccaagccgcagagagcaaagccctgggcccccaggaggcagcccttcaggggctgcctgggccaggatgagctgtgtgaccttggcgaggtcatttttctccttgagccacagtggccccatccgtcaagtggggatgaaaggacctgctcaggctgtcttgcagaggagcatgtggatgtgaacatctttgaaaggttgaaaggcgccattaatattcatttttgcggtaccttccgcagccccgaggctcgcaatgccctgtgcggtgcctggcttcagttagcttcctgcagccagacgccaagcccctccgccagagccgcgcagattccggcgcccctgcccctcctacccatcgctcccacccatcgctcaacgctcagggtcaccagccgagggtctggtgggggaggggagacgccggctcaccgcgcctggagcggggggccctggtctgacccacgggcgcccgtttctgcttcacccccgcccacccccagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcaggtgagtgggaggcccggcgaggagggggcgtgcaggggcgggccctgggggacccgcagggaccaggtaagcgagtagcggggattggaaggggcgaggaagaatgattagcagggagcgaggcttcccgggtcgaatgccctctggggaggtaggcttagggggcaccggcctgattcttttgtgtgcccacggtagagacaggctgcggcgtcggcagccggtaccgcttccctgcacgctcccctcacccttctccttgtcacctgctcagtccttctctccacccatcaggttctgggtgatgcttcagtctttggggtgggggcggggcttccagtgggactgagggcagaggtgtaggactgtgttccccaaagtgtggttctccgctgagccttcctgccggcccccgggctgtttcaaagccactccagattttctcaatgggactctctgaccatgggggtggagcttggggatttgccctgtgggtaggtggtctctacccagtcctgctcttaattcttaggcactctggcccaggtctgctctcaagccaccagggccagcccatttccttgctttcctccagcagctggtggcaccctcaaagcccctgctggctcctggcaacagcagtgcccctccgggtttcagtatttagccaaatacacatgctttttttgcacaacagatgggtttctataaaaggtgtaatatcaattttacctcattattattttttacacatcggggaaaaaatcaccacttataggaatcccatgatgaattctttagtaaagtgcatcgtcattttgtacagcaaatggtaattccctgatttatcttgtataaatggagagttacacatagataatctgtttaaaacaaaccagacctttaatgaaatccgcttgttagccttagatttctgcatagggagggggcagtgcttgagaacaccacacgggggcagtatggagctattctctgggctgcgttttcatctcttgacccgccaaggtttttctgggggtttttgggttagttagaagcagctagtgggtcagaaagagcccacatccagctgctactaccccgggcctagtcaatttggcctcagcctgaagtcacacccatgcacattctgggcgcctatggctgcagcatgtccctcaccctgttgccaggtagtcccagggcatgagtacccccagcccatcagcgttctcttccaagcccagggtggctggaaggggtgcaagtcccgccagcttcacaccgtcacctcccgctccatggataggaaggagttcgtctctctccctccctctgagcttaggcccctttggacagggcaccccctgctttccagaaaaggtcttcagaacctggcttccctctcctttgtcctccctcatccccacctttcctcaaacacttctgcagctcgcatcttttggcagcaccgcccccaccagccagtccctcctgtctaaatttctctgtccctgaggatgtggcagggtagaagggggctcccaggccagagaatggatgggtcactcctgtgtcctgagagaggacagagcaccggttccacacaccaccgtcacagcccttgggcgggcagacaagtgggctgtgggaaccccagccaggcgggcggagatgtcgggataatctagcaggtggcctcgttacgcccagatctgtcgccatggtaacctggttttttctttaaaaaatgtacagtgccaagaggaggaagatggctgacaaaatcctccctcaaagggtgagtgcctttcacagcagcccccagcccaccccccaccctttgctgctccgccctcccctcccccctcagaagcagagcttcagcatcacagtcactttcactttttgtttaaaaaagctcattaataagtgaggctccgcaggccagagggagggggtgaggtggagggaagcagcagagccactggggccagaacacaggggcctgtcagggggtttgatccaagtggtactatagagctgtgggaccaggagggggcaagagctaggggatcagaagctgccaggcagaatgaaggggatagaaggtggccagagatcctgagcatcctaaagagacccaggtccagctgggtatggggacagcacagttgggacaggtgtgggggctgagcaaggtgccagcagagaagaaagcaccgctgtccaactgtctcagggattgagcccctactaggcactttgcaggggcccaggggaagcccagcaggcatatgatatggacaatgacaagatgaggagactaaaggctagtgcttgctgagctccaccgttgctacctcctccctgatgatgaaacacaaggcacttcctaaagggagaagcaattgttatccctacacagcaaggcccctactgctggataatggcatcctggggagaggtcctgttcccactgtcaaagctacatgcccaaaagtaggatggctcccctgacatcttttgtaccctaggattgcacaacatgcatacattccatggtacaaccctggacttgagcctctgactcctgccctgctcctccttctccagattcgggagctggtccccgagtcccaggcttacatggacctcttggcatttgagaggaaactggatcaaaccatcatgcggaagcgggtggacatccaggaggctctgaagaggcccatgaaggtgccttagttcgggggtaggaaggggactctagagttgtgtgaccaggatggggaagcagggtggtcggggtgggagcacacagcattcgcccggttctgcactctatttctacagcaaaagcggaagctgcgactctatatctccaacacttttaaccctgcgaagcctgatgctgaggattccgacggcagcattgcctcctgggagctacgggtggaggggaagctcctggatgatgtacgtcccggcccaggtctctccaggtgtcctggggtgggcatgggctgcactgagaacagaacaaggtgtctgcactaagggctagggagtcagcccaggctgggtggaggggcaggcctagagacattccaagtgcagaggatttcatctaagcccactgccctgtcggctgccaacttggcctccttctgctcctcccacctcgtccctgttctgcccccatggtccctgttgctctcccacagcccagcaaacagaagcggaagttctcttctttcttcaagagtttggtcatcgagctggacaaagatctttatggccctgacaaccacctcgttgaggtaagaccaagagcccctccgcccttgaattgccaccctcccacaggccagaatccctgaagaaccagcacagatttgggtcagggaccaccctagagtcctgggccccaccactccagatgggcctttgggagacacagctcttctctcctggacagtggcatcggacacccacgacccaggagacggacggcttccaggtgaaacggcctggggacctgagtgtgcgctgcacgctgctcctcatgctggactaccaggtctgcacctgccatgctgccccgtacacgccacacaaggccctcagggcagggctaggtcccaaagtggtgcatcttgagagacctccttcccctcccaaacctatccttccccaggggcatgtttcctcaatcaacacatccccctagtcctgaatggcctggccctgggctccttcctttctctccctttggtctaactttcacagtccccttttcccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcaggtaacctctctcctgaaccctgggatctggggagcaggcggagttctccagcaggggaagtacctctaccaaggtaactaccacccctcccttctagattcctgagtagcagaagcagtacacagtcatggtcttggagccaagagaccgaccaggattctagttcaggccctactgtggattagctctgtgctgcagccaatccatgttagcccccccaagttaggaagacctggaaaccctacaaagccaaccgctttctggaatgtaatattcttggcacttggagttaggatccccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttattaatgcatttaaaaataaatacagcagataaacctgaggagtaaaaatagcagttgatatttattgggcacttaccatgtgccaggcactgtcccaagcactttatgtgtattagttcactgacttctcacggcagccctgggagataggtattcttttcatccccactctagagatgaagacactgagccctgaggtgttaacttgctccaggttgcatagtaagtggcagaggcaggactgatacataagcaggctgacccagggcccgcactctcaacccctgccccacactgacccaccccctatcttgtcagccataccggtggctccaccaccagaccagcccaccccaatcccatccccatgcgcactgaggaatcagacttcctctcagcttcttgtggcctttctagaacaaaaggatctacaactgcatgatgatctcttcaagaagagtgatctctctctccccaattgtcctgcttcagatttttgattgtccccggctgaagttttctgagattccccagcgcctcacagccctgctattgccccctgacccaattgtcatcaaccatgtcatcaggtgaggtggccccagcttgcttctcagaccagggaatgatctcgttcctgccttccctgcccctccctctcctcccactcccatctcttctccctccctgttggatctgccccagccccggggccctggggccgtatgggggcatcgtggacacgaagggctggacttccctggcagcgtggacccttcagaccagaagaagacggcgtgctatgacattgacgtggaggtggaggagccattaaaggggcagatgagcagcttcctcctatccacggccaaccagcaggagatcagtgctctggacagtaaggtggggcccaagcccagagctggagtgggacattaacccagagatgatagaggagacttttctgagaccagggtgtggttgcagatgagcagtctgggttaaattaaaaaaaaaaaaaaaaaagagaccagactctgggccaatgggacacacatggcccgtccatgctgcttggagctgaacctcattccaagtttagttctgcccatcccctcctcccctgggacttcagagaaatcaggggctctgaggggttgtccttcacagaagaaaccccctctccctccccttcccacccgcttcctttcccctcgtctcccacatcaccaaagccaggtggaaagcatctatctttctacctgcagatccatgagacgattgagtccataaaccagctcaagatccagagggacttcatgctaagcttctccagagaccccaaaggctatgtccaagacctgctccgctcccagagccgggacctcaaggtgaagagggagactcagggagtactggagtggaagacaagcacagcgggaaagagagtaaacgttgtactccaggggcaggtgaggggattcagggctcagggctcaccccacgctccctcccaggtgatgacagatgtagccggcaaccctgaagaggagcgccgggctgagttctaccaccagccctggtcccaggaggccgtcagtcgctacttctactgcaaggtatgcagggacccttgccctgaggcttccccatcctcaactccaagagaaacctccctgttcagcttgtgggcagccctcgcagctccccacagtaaagcttcaccacgctgcctcaccatgcaatggccctccctgctcccagatgctctttcagggcaggcggtgtcagtaggtgggattgtcctgatcactcaccagaacactgacacctgctcctgttctcacttcctctaaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 36539 - DNA, 31056 bp, Homo sapiens
gaggcggcctgcagggagcagccgcgagccggccgggcgcgccgagcccgagccccagccggagcggggcgggggagggaggagccagagcggccgccgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgaggtaaggaggagggagcgagggggcattaatatgcaaatgccttgcgattgattatgcaaagccgcggggctccgtggccagctcccaggcgggctaggggcgcccagggggtgcctgctgccagcctcagcctttcctggcgccccagtgaccctgtcacgagcccgggagcttgcaactgacgccctggggaagggaggtgttgctaggaggtcgctgggccccggggttcgcaggcggagatggcgtccgagcctccccctggagggcccgcccggcctctgtccggccagtctgctgcgcattcccgggccgggccccgttgccggccgccggagctcccccgcccgccgcgccgcggtttgtttacggtgcgccggaggcctgcccccccagcccccacccctagcctctgaggcccgagtggcctttgcaaagctgcctccagctgcggagggcagtatgagtgcggtggcgcgggtgggcttgcacgggtccggggagagggaagttcccccgcctcacccgcctcccggttgagcatggctgtctggttgcaacactgctaattgcaaaaacgcggttgttgggggggaatgtgtgtgtggaaggggtgtacttggtggtgcctagatgattaggagagttgctggctggggaggagagggagaaatggacctgtgtgtgtgtaccccaccttgtttccctccccttgcaacgtgtctctggtgccccttctccatctggggccctcccttgtccagcgtgaaagaaaggcctggggggatgacaggggcaattgaaagaaccaccgttccaggggtgggggtgggggacacagaaggaaagccagtgaggtgggagcctgcccctcagtgctggctttggctccaggagggggaggggatgaagggggctgttgtccaaaatgaggggggaagcaaaagtgacacgcagacacagagatatgtccacacagacagccacatgcacatccagggacacccaggcagactcaaggacaggagctactggacacacccacatggggacaagggaagagacaggctgctgctgcaccgtggagctctgaggggtgggatatacccatgggagaccaagagcatggggaccgatccatgcacatacccacgcacagggtcacacgtagatgctgtcacacactggggcaaggaggagttgctgtcacccacacataaaaagtcactgtcacatgcatgcatgcacacagagcaattgcacacagcagcacaattacaaaagaccctgtcactcacaggcacacacgtgctcgcatgagcccagtcacacagacatcattgcttgccgtgacagtcgctgtcactcagtcagatgcaaacacagttacacaccaacacatgtatacacaacttagcaacaagtattttcctggactctttactgtggagctctgaggttctgtaggcaacaaaacccttgctcccaagaatattaaatttggctgtatgaaaaagtgttcctgcgtaatggtgtaaagcatgcattcccaatgacatgttcttggtctctatcgcttgagataccaccctactagacagtgagctcttggagacctgggagaatcacttaaagagctctggatcccacgcagagcctagcacaagggctgctctgtaaatacttgttagttgattgactgtggaacctgcagacacaggtgcactcatttgcacatggtcccctgaactcaggtgcagaatgagttcacaaggcccaggtccccacagttgcaggtccacaccaacagtcgtgtccacacaaccccagatacacacaactgcagcctgtgcagccgagcacacacttagatgcacacaatcacaaatttttccccttcagcttcctcctcccctttttcctctaggctcagccactgtgcgggaatgggctgttttttttttctttctttcttttagagggacagagaaacaagagcaaagacagtgggttcaggggggttccagagggccgagtcatgggctcaaagcagtgtccagtgacttctagaagctaggattctcttgactgttggggaaggggagagctgctctcctccctaccctaaaagctcaggggtgtctaactgcccctgctctgagtcatttgcctgggtctttcctgggaacagtcagtcacttccagctgagttcctgcgccccaccttgagtctggccctttttcccacctgtaccctcctgtccaaacttggaagctttccttaagaggccatcggctggcgagtgtctgtgtgagtgatatgtacttttgacttggaatttctctctaactctgtctctctgttgctctgtcttgcagtgtctgattctccctctctctctccttgtttctctgccagtctgtaactctctctcaccctgttgctacccccgatctacccctgtccttgtctcagagctggggactggcagcaatgttcttcatacttttccagttgttaatacccaagctccgcccctctgccccccctgcgcagcctctggggtcagcttgaggttggggtggggggcggggggctcagctggctgctcaggacttcctgcacttccttagtgccgcagctgtggccagcaagttttaggggctgggaatgggggaagggggggggggtcagccactgcccatgctgacccctcgggcctgcatgtctggagacaccagttctgtgggcaccctcagggtgcaggctgcagccagctagcagctcttaaacaagccatgaagaggctccccccacactggcccaagctggaaaagaaccgcccccatgggcagtggcgggagctggcaggaccctgctgagttgggtccactgcagggctcacaatggcctttctccacacccctggcagctgaggcccacctcagagatgcccaacagctgtgtcctttttgcccagcctcagggcctggttctgagggcacagctgcctagactaagtatgtactaagcgaggccctcccacccgtgagtgcaggttccagcctagaaggggtacctcttctggagagggaatttgaggagggggaactcaggcaggagacatcgagcccgggggcaccaagcacttctcgctatgctcccctctagccttggactatttggaggtggaggcacttggcagagaacccacagggcagctacagaggggaaagactgaggcttggtctcagggaacacatagctggatgaaagaacaaggcattgggccgggcacagtggctcacacccgtaatcctagcacactgggaggcggaggcaggcagatcacctgaggtcaggagttcaagaccagtctgaccaagatggtgaaaccccatctctactaaaaatacaaaacttagctgggtgtggtggcggggtcctgtaatcccagctactcaggaggctgaggcaggagaatcgcttgaacccaggaggtggaggttgcagtgagctgagattgtaccactgcactacagactgggtgacagagcgagactccgtctcaaaaaaaaaaaaaaaaaaaaagaaaaacaaaaaagaacaaggcattatctatcaagcaggtgatataccatcacagctaagaacagagatgatggtgatgatcatgacggccatgattgacctggactgcctaggtctgaatcccagctctgtcacttgctggatgtgtgactttgagcaagcgatttaacttccccgttgcctcatctgtaaattggggatgatcatatctacctcatttagcttttttgaggaaaaatgtttttaaaagtgcctagttcataacaaactgtatatgtgagcggttgtgatgggtgaaggaagctgtgggcctggggtctcccagatttcttagagaagcttcgtggagaattgggtctcctagacatcagtgagactggggcctggggcagtgggtctccaatttccagccttctcaccgtcatgtaatcttttcctcccagacaaatttttgcagcctggaatgagtgtatgggaaagagcccaaggcaggcccctctgccccaccctcctttgaccctcgcccttcagcttacaaggagcccttggcccctcagcctgggacacaccccaccagctaggggcacctgcataaatctttgggcatcactgcatctctgttcagggtctgagctctgggggtgggagagagagaacaaggaaagccgtcccctctcttatgtgtgggctcaaagaggaggcagtgcccttcctccctcctgggagcccagcattggtcaaccaggacccagctctggctgataggcaccagattcccctgccctccatggagtggtacttagtgtgaaaggtggtggcagagagaaactgaagcactgagtaatgaccagtgtggtgggcacagcactttgagatccagcatctgtcctgggttgcctctttgcctttgtgagtctggtgatcaggatcccctctccaaaccccttttatttagccctgcccctcaaggtgaaggaaggacaatgggaggataccctgtaggggtgacgggaagcctttggagtgggaaccaatctcaactctagttctcggctgggcacagtggctcatgcctgtaatctcaatattttgggaggccaaggcgggaggatcacttgaggccagtagttcatgatcagcctggtcaacatagtgagaccccatctctaaaaacaactttaaaaagttagccaggtgtggtggcgcatgcctgtgttaccagctacttgggaggctgaggccggaggatcgcttaagcctggaaggtcgaggctgcggtgagctgtgattgtgccactgcactctagcctgaacaacagagtgagaccccccacacacacatcctctcaaaacagacagaaaacaaaacaaaaaacccaactctagttctcatggctgcaaaggtgtctaggggactttggagaactgttgtgtctcttggggagggaggcaagcatgaccgtggtgggaagatcactggctgggagttgggaggcctggctgttgacattcactagtcgtatgactttgggcctgggttttcattatctagagacaatggttcctgtctcactcaggttgagggcaaataacacaaggtgggatgacccctgtgttcaatccatgttgcatcctggcatggtgagcaatgcctgtggattctccttttttcccagggcctggcacatgccagggtggggcatacacatgctgcctggaaccagagacagttctcagtctctcactgaagtatctggggctggtgtgtggtgggggcacatgtggttccaccttggtgtcacttggcaggccaaagctggggtcatagggacctccctccggtatgccattgcgtgaggtggtccagagggagggtcagaagtttgctgggtagacaagggaagcaagatgggtgttactggtgcccaggaaatactatccttgcttcgctgttttgggggtgggcattaaaggttgataccaaagcctcagccatgcccctcagcagtggccaagagcagaatgattggaccaagcccctggcccacctcctcctcctcctcttttcctcttctaaagaagagatcggctcttggctcccagagccccagctgcctgtttctttttctcttttaccaggcatgggggtggggaaacaggggaaccgaggctttggtgtctttcggcatttttgtacacatcagtgagtgggtgtgttgtgcacgcatccatgtgagagtgtttttgtgcatgtgtgggctggggagggctctgaatatctcctggaacggtacccagagccctgtggctctgcgcatgcggggtgagtgtgtgtgtctgcacgtgtccgtgtgtgtgccggagactcagctgcattcacgcgcgcgctctctccctccctctctccctccctctctctctccctccctcccttcctcttccctctccctctctctctccccctccccctctctgtctctccctccttctctccctccctctctctctctcacacacacactctcaatctttctctcttccctcccccttcctccctccttcctattccctccctcctccctttctgtccctgtctctctgtctctgtctctgtctctctctctctgcctctgccagttctgcttggttaggggctagctccagcctctggggtgcctgggagaacatccctccctttctttccccctccaccattccctcccctcctaggccatgctcttcagggcttgcaggcaacttcttctactgccttagatgagggagtgaggagggaggaccccaagccttgtgcccatggtgccatctgcagcaagtgccttggccccgtgacattcatgcctccagcattcagctgccccagctcccagctccaattacccgctggctgctgggggagggtggggagaatgtgccgtgcccagcttgggggtgctcctgcttctgctttcttggctacttggatctcctgcctccattcctgaggggaattgggcagggggggcgtgaagttctgtgggctgataaggaggggctgagttctccagcatgggtgtgggcatgaccacccaccagtggtcatgggggatggatgtgacctgggaggagacctccagacctgggcacccaccttgatgcctggctggagctggcccgggcaggaggagggagaggagagcagcaggtgggtgaggctatgggggagccgagtgggaagcagtctttgatgttaatactgggcatctggcccaagtcaaggctgctgtttatgtctttctgtctctgacctgcagggggggtttcctgttatattcttttggggcggggtggggaggatcctttgtttaagtaaccaatctcccccttatgaggatccccaccccatctcccattctctagcctctaaggtcccacagtggctaggtgatgagtcactgccccccagctccagaacctgtctcctgggggcccagtgagagctcaccaaggggtgccgcctcccctcctcccgtctcccccatgcctgccaggctggggccctgagtctgtgtgtactcctctgccacatcacacctgccaaatagtaccttccttcccgccttcactcctcctctccttcctggcactaggataacagagagttgggtggggcagccctgctcaatccatacctgagaatagaacagggggtatgggaaaggacagggagtcccggtcctagagaggcctctgcccctcagcatgggggcacatgtcgctgctgcagcactgccaccaccacagactcccaggggcccttggtgtgggtggctgcctgtggtgcccgtgttggcatggggggcagtgctgcccatagacgcctgtgcccatgcatgcccatttatgtgtctgggccacggtggccgccccggcccctcagcatcgcccttcctggctcccatggtgggaggctgggtgatcaggagtgggtggtgggggagggatctccccccaccctagcagcaggcagaggggaaggggagagggaggtgtgaacctacccacagaactattaatagcccacatgccaggccaccaagaaccagctgtcaccgtggaaaccattcctacgcccccctccccccagcctgcatggggtgggacttagacagggtacgaagccccccacccatctttctttgttacctttctctctttgtctcccctccttcatgtgtctctcctccctttatctgtcctcctttctacctcaccccttctccccatcccccatctctggctcccctttcttcctctccctctactgccttgtcacccctagctctaccccagccctgtcccatttctttgttcttccccctcctcccttcttccctctttcccccaccagcctttttacccctcctcccatctttccacccttttctcagccgccccgcatgtacgtgtccctgtggctggcaaggagggctgggctttcttcagagcactaaggacaaagttcaggggccccagaaaggtggggccaaagcccagagcagatacgcaggagggttaatgcgggtagtattgggggttagatcctggggacagaaactcccctctggcagccccaggagtcctttgggggtgtcctcagatatacaggactgcagagtgggacggctcggcagtgggaacctggcggggcgcccgtggatgccgcattggccccgtgtccctgtccccccatggcagaagtacttaagcttaatgaaatgcttccccctccacgggcactttgcctacactgcctcccagcagctcttatctcacaaggagggagtgggtggccaggccagccgacaggtgggtcttgctgtcctgctgtccagcctgggcacagaaccccatagctccgccccctcggcctccttggggcagggcctccctcgcctctgcagaggaggtaccaggaaggagtttggggagttaagctggactctggaggaggggtgagaggctgcccttcagggtgggtacccctgccccatgccccttacccgctgacctttttctgtccgtggctaacacaggctcatgtggtatgtgtctccccacatgctgggccctctgcctcgcctctgtatcaccccaaaggcccaagtgtgtccctggagagatgccaaggagtccccaggggttccagcctctttctgggtacccagtgagggtgccctaggcagcaagggcagcaccttgctcctctgcccactaccaggggctgactgtagctgggctgcactgcccagcaccagggcaccattcagttcaaaagaggggtggggcagagagcgagtctgcccctccccccagtgggcacgtgcaggcccttggcagtacccagacacatttggagttaaggctgggcaggagagagggatggggaaataaacatggtggcttaggttggcactgctccaggtctgcaatgtagcaactggtaagtggcaggggcctgggggaggggaccctcaggagccctggcctggggcaggagctgcccatgccatgtggctgccactggtgttccccgcctggcccggcccacagcagccagtgctcattcctgcacacactggtcctcctcggctgcccccaggacctgctccccggggctgcccctctctcagcatgcccactcctgtgcttgcctcctcccctccctgggggcgcttgggcctccggctggcgagtggatttttccagcttctgtaaacaagtggtggcagtgtgccaggcgggcaggagacaggcgggggcagcaccacagccagggtgtgccaagcaccgaggcacagcctggggggcagacggagacacccagacccggagagagagacattcagacacagacagacagacagacatgcaggcagcctcgctggacgtggagtcagaagatcgtcctctattgtccagcccaacccccgtagcggccctcgccccctgcccctcactgtctggctgagagcattaggccccagtgcccagcccctgggcttccccacccactccttctcctccccaacctccaccccttagggctggctacgccattataaatttataacaggaatttctccacaagccaagaaaaacttgacctactttcttgatggctccctgggctaaggctccctgctcatgcccccccaccccagtctcctgtccagcccccagtgcccagtcctggtctggggtgggtatcagaggtagaacgggccacttttctgtgcaatgcccatgctctccacactaccagcttgcctgggtgcagaggccccgttctgctgctggccctgcccaatcccctgacttatctccctctctcttcccaccctggctgcttatcagctcctgggggtggggccagggggcctaggggtgaggtctcctatgcagcagccacgtgacagaggttgaggtcgtatgttggggagctgtaccctttgtccccctcctacccgccacacctgcctgtgtgcacacagacagtaagccacaggtctgcagcccagggtcagaggtgcaatgccgtaggaatggtgggcccggcttggcactgccctggactccaggtagcagaacaaggctagcattagggccaggctgtgaggcttatcccacagccacctgcttactagttgtgtgaacttgagtgaatgaccaagctttctgagactcagtttcctcatctgtgaagttctcgtgccctctttggagggtacagattctctctccagttaatatgtgttagtttcctttcctttcccccttgccatcctggtcgatagcagctcagctaaaccaactgagaagtctggtcctctgcctgggaagtgggattcgagaccttgcgtgggaagctctggagtccctgaggggccagagttggggatcataacttggctggcagcatgggaggtcagttccctacagctttcaacatctctctctattaaggcacaaagatgggcattcatgctcactgcgtgccgctctatgtcccatccttccttcacagataccctccctgcctatgctgaaaactgcttgtctctggtcccctcttgcccctataatacagatgagtttcaggaaagcttttctagaggggtggtaacaatagctagtgtttaatagttgctcattaagggccaggcatttgtctgaatatgaagactgagacatattacttagtacatgaatgatctcattctctccctccattccttcccatgtctggggcttaggaggtggatctccaatctcgcctgctgtacctgttatctaagggatcatcctggtcccctctctatgcctgcccttcctgccccctgctgtcttgttatgggatcccaaagccccaaatgttgccaccaaagggatcctacccaccttcctaccgtgacaccttcttacccctgcctctctcttctctccacagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacaggtaatgggttcagcaactaggtcatgccaactcctaagcagcaggcatgggcacctggctgagctctcctttaggcaccgcctttaagcacctctgtgggatggacgtgaggccagcaagccttctgcctacctttgtctggcagatgaagtcatgttcagatgtgacaggcacttggattgagagatgctcattttgaagcggggagcgatacagagcaattacagggagcacataaggggctcttccctagacattgctgggcagtctcagatgcccccaacgtcccttccaccattgctgcccttaccttgagcatgtgggatccaaacagccttgccattttcttcctctccctaccagcccatttactatctgaccacaagtgtgttgtccacaagctgcggttcacgtaatacatttcagggcacatgcaccagtaactattggtcatagcccaagcttatattcggaatctattgggagccccacaagctcttccttgttcatggtcaagggcgggcactgcgatggggctcctcccagaaagtgcacgccaaccatgatggttttgcttccacatgggtgaggtgtcagccctgcacatacaccaagggatggttacctgtgatctgcattgcccttgaggagcccagagggtctctgtcttttctatcagctccaagtggcacagagctttgtcccagttggcacggtgccctgggagctgggtacagcctgtgcctatggccagggagagggtgggggtgggggtgctccggggagcagtgtggctgactgttgcctaggagatcagatcccgagccaggaagccagaggcctggccaggcaaagccctaaggcccacaactgggtccctggagggtagaggaagtagatggaactcacagctgggcagggcatggggtagctcccctcccccaaagcctcaccccaggaaggactctgaggacgatctggcctgtcgctgtgtggctgtcacttgcagcccctgtgtctcccagcttaggcttctgtgggtctggaagagtctgtgcttaatgtttggagaaaggcaggaatgccagttcccagtctcctaagactgcaacccctcccccatcaccttcccctcccccatgtctatgcgccaccttgtggctatctctaggactacactcagaggctgtgagtctggtggtaactgctgaagccgctagctcaactggggcctaggtgggctgagttcccctgcacccaaccctctgggaggcgtgagggagacctgacctttcagcctcataggaagtagaccggagtaatccccacggggcgtggagcatagggttgtctgtgactgtgaccctggccaaggtcactgtgtcagtgtgttgggagctgcatccggctccaggaggaaggggcctgcaacatgccacacgcagggtgggtgcgggaggttatacaatccttgcatgcatgtagagggcttatgtaacctgtgtgcaccgaggttatgcaacatgtatgtggagagcctggcaacatatatgtgcagtggctgagggttgctaataatacgctgcacagaggggctcagtcccggctctgactctagctcatggtgtcaccaggcacaagcagggtctcagtttgctgctctgttaaatggaggctgtgcagagggtgtagtgttttctattgctgtgggttatttagcatgtgtgtatgacctggagctcaagcaacacgtgcacactggagggatgagggtggttttatgaggtgcctgtgcagagtgttgtgtaacacatgggcatatcctagaggttgtatagcacatttaagaatgccctgaaaatttcacaggtatgttggccctggtgcatactcaccatccatgggtttatagtgaaggttgcatggttattcatctgtgccggtgttatgttgcatatgtatgtgtgtgttctaaaggctacatagctttaagcatatcctgagaattcttccagcgtattcgtcatgtactgaaagatgaggatgtcctgcagattatgggtgcttcaggtcttctggcgggtgaatgtgtgtgtgttggggctctagaatatgcttgtgccacagccaagccccttatctctctcccctgcaacttccagataactggacccttttaagcattgtcagctgaccctggggggtgggaggtagaatgaggacacaaaatggaaagaatcaggccttgggggattgcataagcctctcggatgagaaaggggctactcgaagactgctctgtgattctgcccactttgcctccatccagtgccaggtcaccagatggaaagcgaaaaagaaagaacggccaatgttccctgaaaaccagcatgtcaggtgaggctggctgtgcgtgccccttctccacgtccccaaccccaccaaacccagccagggctcctctggacctggatgtggaacagtaattcatgtgttccctggggggagcctcctagagggcttgggatggacttgtctgggggtgagaaaggtaatgtgggatgtgcccagcttttgagggtggattaggtcaggacggcctcttccctcttcccctaataccctcatctgaggccctaccagaatcagggcctgagctgaaggactgaggggctgtattatccccagtgagcagctgacgtttatttttccctctccaccatcctctgccttgtagatagatcaagaagaaagccctgaatgggcagtcagaagaactgagattcttcatactcttagggcagagatggacaggttcacctcgtgtctctctaggattctaccagggaggctgggctaggagaggggtcagaaacaaaaagttgagggatggggaaaagtgtgagagcctctctgctgggactccaagccatgcctgccttcctccatcctttccttcctcccagggtatatccctagttacctggacaaagacgagcagtgtgtcgtgtgtggggacaaggcaactggttatcactaccgctgtatcacttgtgagggctgcaaggtatggaagctacctcctgcccctcccctgccacctgagcccccatattactccctatgtcacctaaagcccgcctgttaggtcatcactttttttttttttctttgagacggagtctcactcttgtcccccaggctggagtgcagtggcgcgatcatggctcactgcaacctccgccttcaggttcaagtgattcccctacctcggcctcctgagtagctgggattacaggtatgcacctccacacccagctagtttttttgtatttttagtagagacggggtttcactatgtggccaggctggtctcgaactcctgacctcaggtgaccacccgtctcagcctcctgaagtgctgggattacaggcatacctgcctggttactttctcttctcttctcttattcattcatttactcattcataactcctcctctgccactcacaggaaaattgcctaacttcttcgagccttagtttcagtttcttcatctataaaatgaggataatcattctctctaccttatagcattgttgggagaattaaatatgttgggagatagttcacttgaagtgtttaaaacagtgccattgggtgctgtggctcatgcctaaaatcccagccctttgggagggaggccaaggcgggagcatcccttgatcccaggagtttgagaccagcctagctaacacagtgagacactgtctctacaaaattaaagaaattagctgggtgtggtgccacatgcctgtggtcccagctactcaggaggctgaggtgggagactgcttgaacccagaaggtcagggctgcattgaacggtggtggcgccactgcactccggcctgggtgacagagcaagattctgtctcaaagtaaaataataaaataaaataaaaaatagtgccatgtgcataagaagcatttgataaatgccagccatcacccattcattcagtgtattcttaggtgtgagagtgtagtacgtacctcgccttcaagctgctcacagcctgtcagagagagagacacaacttgaaacaaacatcagtgttattcaaaatgtggttcatggaccacctgtcctactagttaaaatgcagattcccagccttcatcttttttttttttttttttttttgagatggcatctcgctctgttgcccaggttggagtgcaatggtgtgatctcggctcactgcaaccttcgcctcccgggttcaagcgattctcctgcttcagcctcctgagtggctgggactacaggcacctgccaccacgcccagctaacttttatatttttaatagagacagggtttcaccatgttgaccaggatggtcttgatctcttgacctcgtgatccgcccgccttggcctcccaaagtgctggggttacaggtgtgagccactgcgcccagcctgcccaggcttcatcttaaccctgctcactcagagcccttttgtggagcccaggaatcttccttttaacagaatcccggagtgtttcccatgcacctgaaagagcgagagccagtactgggggggtagtgggagctgggagcacagaggagaagaggacagcaggttcttccaggcagaggggatgacaaggtcatagattttgggaggcctaattgttttgttttgttttttttgagatggagtctcgctctgttgcccagcctggagtgcagtggtgcaatcttggctcactgcaacctccacctctcgggttcaagcaattctccctgcttcagcattggtagctgggattacagacacctgccaccaagcctggctaatttttgtatttttagtagagatagggtttcaccatgttagccaggctggtctcgaactcctgacctcaggtgatctgcctgcctctgcatcccaaagtgcttaagaggcctaattagatttcactttgatcatttcagcctggatagcctttccaggatcacctcctaaaaatgcaaggccttccaagaaacagaattatttaaatcccagcactttgggagtccaaggcaggcagatcacctgaggttaccacacccggtggcactgttttaaacacttcaagtgaattgtctcatttaattctcccaacagtgctataaggtagataaaatgattatccccattttatagatgaagaaactgagactcagagaagttaggcaattttcttgtgagtgacagaggagggattatgaatgagcaaatgaacgaatgagtaaggtcaggaatttgagaccatcctggccaacatggtaaaagcctgtctctactaaaaataccaaaattggccaggtgtagtgatgtacgcctgtaatcccacctacttgggaggctgaggcaggagaatctcttgaacttgggagatggaggttacagtgagagtggagattaagtcagtgtactccagcctgggtgacagagcgacagagtgatactctgtctcaaaataaaaaaaaaaagaaacagaatgatttatatgttaaaggccaggtatagtagctcacgcctgtaatccaaacactttaggaggccaaggtgggaggattgcttgagcccaggagtttaagaacagcctgggcaacatagtgagaccctgtccatacaaaaaaatttttaaagtagccaggcatggtggtgcacacacacctgtggtcccagctactcaggcagctgaggtaggacgatcacttgaggctgggaggtcgaagctgctgtgagctgtgattaagccattgcactccagcctgggcgacagaacaagaccctgtcttaaaaacaaaaaacaaacaaaaaaaaaaaacggaaaaaaagtttaaggcttgaagtttctctctctttcttgatgtcaaccaaaccaagaccatgagggatttagagttccctagcagaagcaatacaatccttctggaagcaatacaaacagtgtagcatagagaaaggatcttttactctcacggacatctgagtcccagggaagcaccctgaaaagacagagatgccttggccccacccttggatagttttattttgtagttctggagtgaggcccaggaatctgtatctttggtaggtgcctttggtgacttttttttttttttttttttttcaagacggagtctcactctgtcacccaggctggagtgcagtggcgcgatcttggctcactgcaacctctgcctcccaggttcaagcacttgtcctgcctcagcctcctgagtagctgggattacaggtgcctgccacctcacctggctaattttttgtatttttagtagagacaaggtttcacgatgttggccacgttggtcttgaactcctgacctcgtgatccacccacctcagcctcccaaagagctgggattacaggcgtgagccaccgcactcggctgcctttggtgattttaatgcccctggaatctgagagctcagacgttggtgtcccatacctgaggcccagttctgactctgctgcccaccggccacatgactttgggcaaattgcttcatctcaccaagcttcagtttccttgtctgcaaagtggaggcagtaacagttcctacctcatagggttgtctggagggttcactgtgatgttccatgaaagacaaggcttatcttttgggtttttgtttttgtttgtaatggggtctctgtcacccaggttggagtgcagtggtgcgatcatagctcactgcagccttgacctcctggtctcaagcaatcctaagcaatcctcccacctcagcctccagagtagctgggattataggtgcacgccacaacccctggccaatttgtgtatttttagtagagatggggttttgctatgttggacaggctggtcttgatcttgaactcctggcctcaagtgatctgcctgcctcagcctcccagagtgctgggattacaggtgtgagtcattgcacctggccagcaaggcttatgtttactaagtgactgacacattgtaaacatgaaaaaatactaattcttcatattattgcaatcatcttgagttttgaggtgtttcctttaaaataaaggcgaggctgggtgcggtggctcacgcctgtaatcccagcactttgggaggccgaggtgggcagatcacctgaggtcaggagttcgagaccagcctggccaacatggtgaaaccccatctctataaaaatacaaaaattagccgggcgtaatggtgggcacctgtagtcccagctactcgggaggctgaggcaggagaattgcttgtacctgggaggtggaggttgcagtaagctgagatcacaccactgcactccagcctgggtgacagagtgaaacttcatctcaaaaagaaaaaaaaaattaaattaaaaaaataaaataaaggtgaatcccaatgtagagaattgaaatttttctcttcccctactagagttcatactcagtccctttccttgacttttttggttcccctgttttatgaattccacctgcatggacaacaggcaacatatatgagaatggtttttgggtcagtgttgtttttaaagtcatttagcaaaatggaaaatgaggttttacttggatttccttttttttttttttttttttttttgagacagagttttgctcttgttgcccagactagagtgcaatggcacaatcttggctcaccgcaacctctgcttcctgggttcaagcaattcttctgcctcagcctcccaagtagctgggattacaggcatgtgccaccattcccggctaattttttcttttttttttcttttttgagatgaagtctcactcttgtcacccaggctggagtgcaatgcgagctccacctcctgggttcaagcgattctcctgcctcagcctcccgagtagctgggattacaggggcaggcccagctaatttttatatttttagtagagatggggtttcaccatgttggccaggctggtcttgaactcctgacttcaggcagtctgcccgcctgggcctcccaaagtgctgggattacaggcatgagccaccgcgcccggccaaggggtggaccccgccgtggttccaccgcggctcaaacctaggaccttctgcatgtaaagcagatgtgataactgctacactatagaatcgcatgcttttttttttttttttttttttttttgagatggagtctcattctgtcacccaggctggaatgcagtggcgcgatcttggctcactgcaacctctgtgtcctgggttcaagcaattctctgcctcagcctcctgagtagctgggattacaggcgcccaccaccacgcccgggtaattttttttttttttatacggagtcttgctctgtcacccagcctggagtgcagtggcgcgatcttggctcgtggcaagctccacctcctgggttcacgccattctcctgcctcagcctcccgagtagctgggactacagcgcccaccaccatgcccggctattttttttgtatttttagtagagacagggtttcaccgtgttagccaggatggtctcgatctcctgaccttgtgatccgcctgcctcagcctcccaaagtgctgggattacaggcataagccaccgcgcccggcctacgcccaatttttatacttttagtagagacagggtttcaccatgttggccagggtgatcttgaactcctgacctcatgattcatccgccttggcctcccaaagttctgggattataggcatgagccactgcacccaacctcatgcccggctaattttctatttttagtagagacagggtttcttcatgttggtcaggctggtctcgaactcccgacctcagttgatctgcccacctcggcctcccaaagtgttgggattacatgcgtgcgccaccgcgcccggcgacttggatttccaaagctgctattccttaaggcctcacattatcccaggttcaaagctgcctgctctagacatcattcctgcctctgccacaaacactacccagacacccccaacccctcagcagcctgggggctgagggcatatatttctcaggtccttgagcctagtaatcttgggctcatggtgtcaggaggatgccaggtcccctcactgatcttgccttccttgctctccacccctgacccctagtaaactgcatggttggttcaggaaggggaagccatgtcatgatcacagcctgctccatctcccccaccccagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggactgtaaggggcccaggtggagggaatagagccaggtggcctggggtggggatgagttctgggagggcagcttccttccagggtaccctcagagcccacagggcagagtggcaatccagtctaggtcagaatgttcagtgtcttggtccttgctgtcctccttcctgcgcaaaaggaaacaggatccctgtgtgggccccaatgcctacctgccttacaacactcgagggccttagagagggagtcgtttggtagaaagagctcctgggcacccactctagcacactgttcttgactcccagcgaaggcaccccacttctagatgagacagggcatcttccattggctggggattgggtggcaggatattcgagtaaccaccgtcaccataatccgttagaccagaacatgatattcatctggatcagcccaaactgttgttgacatggtcccggggattaatcatgatccgggttgtgctgcccaactgctaggtgatttgggaagtcatttagcctccatggccctcggtttctccaacctgtactctaggaagagtagtttccgggagcattatggaaaggggatggagggtgccatgcgttagaccttgtgcctctctgttcacagtggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctggtaaggagaaagggggcatggggagagcagtagccaggtggcagggagaagagagtgagctcggagtcttgcctcctccaggaagtcttcttagtgtaatccaacccaaaatacatactcttcacacttttgctgtccagattttatacacttgtgtttgtgtccttgctgtctggactgtctactccatccaactgggagctcaatgaggacagggccttgccttcctcatcgaatttccagggagcgggagcgacctttcttctttttcctgcccttagtgactgggaggagagggtaaggatacagttatgtcacagtatttttgagcacctgctgggtgccaggcattatgttaggccctggtcaagctagttgctaagtaaatgatgagtttgggaccaggtgcagtggctcatgcctgtaatcccagcaatttgtgagaccaaggtgggaggatcgcttgagcccaggagtttgagaccagtctgggtaacatacagagatcccacctctatgaataattttttttttttttgatacggagtctcactctcacccaggctagagtgcagtggcacgatctcggctcaccgcaacctccgcctcctgggttcaagcgattctcccgcctccgtctcccgagtagttgggattacaggcactggccaccatgcctggctaatttttgtgtttttagtagagacagggtttcaccatgttgaccaggctggtctcgaactcctgacctcaagtgatccacccgcctcggcctcccaaagtgctgtgattacaagatgtgagccaccatgcccaccctctatgaataatttttttttttttttgagttggagtttcgctcttgttgtccaggctggagtgcagtggcacagtcttggctcaccgcaacctctacctcccggcttcaagcgattctcctgcctcagcttcccaaatagctgggattacaggcgtgcgccaccacgcccggctaattttgtatttttagtagagacggtgtttctccatgttggtcaggcttgtctgaactcgcaacctcaggtgatctgcctgccttggcctcccaaagtgctgggattacaggtgtgagctactgctcccggcctctctacgaataattttaaaattagctgggcatgggggtgtgtgcctgtggtcccagctactcgggaggctgaggcaggaggatcccctaagcctgggaggtcgaggctgcagtaagccatgattacaccgctgcactccagcccaggcaacagagcaagaccctctctcaaaaaatatgatcagtttgggaggagatggacagttggctatacgtggtgaaggaaggcagaaaaccagcacctggttcatggtggagcatgccggggggtggcacagtgcacactgttaagggcacgggctctgattccaagcagatgtgtaacagtcacgagtcagactgcccaagttcaaaccctggtcctaccacttgctggtcatatgactttaaccttattatttagctgccccatgcctcagtttccacatctgtgaaatggtgattattataattattccttttaggattatggtcaggatgaaataagacatgtaaaacatgtagcctgatgcctgatcatatattaagtattcagtcattatagctgctactactgttactaccgttgttattattagctgacttggagctctggttctggtctattctctgctcaagatgaaggaaaagctttgggcctgggactcaggcacgggcggcccctcttccccaagctgccttggagctccccctggtgggcagggagcctcagtgagaggctgaaaggggtctgcggccccagctgacccccgtctttctctctagcccgatgacattggccagtcacccattgtctccatgccggacggagacaaggtggacctggaagccttcagcgagtttaccaagatcatcaccccggccatcacccgtgtggtggactttgccaaaaaactgcccatgttctccgaggtgagtggcagaagtggggagagatgtgatgctgtgctggagggaaacctgctcccccggtcacccagtacaggctcatctgaggttctctggacaaggagcaattcctgtaggtcaacatacacagataacatacacagacacacacacacacatgcatacacatacacccagcacacaggcacacatgcagacacatacacggacacacacacacacctagcatacagatacgtacacagacacacatacacacacacatacacccagcacacagacacacacacacctagtacacaaacacacacacagatacatagaaacacacacagacatatacacccagcacacagacacacacacacacacagacacacacccagcacacaggcacacacacacacacacctagcacacagccacacagatacatagacacacacacacagatacagacacacacacacacacagacatatacacctagcacacagacacacagatacatagacacacacctagcacacagacacacacacacagacacacccagcacacaggcacacacacacacacacacctagcagacacacacatagatacatacagacacacacacaaacacacaggcacacacacacagcatacagacacacgccaaggtctggctgctctaagaaatcagccggctccaagtgctcccctccacagcccctcatccttcaagtctatgcggccacccaactccaggcagcctgaaagttctcattttccagagcactagtgctggagacaggctgccctactagccatgtgacctggggtaagttacctccatcccctgtgcctcagtgttcccatctggagtgggctggggataatgatgggtgctaactcacaggcataatttttttttcttttttgagacagattttcgttctgtcacccaggctggagtgcagtgacgcgatctgggctcactgcaacctccgcctcctgagttcaagcaattctcctgccttagcctcctgagtagctgggactacaggcatgtgccaccacgcccaactaattttgtatttttagtagagatgggtttcaccatgtatgttggccaggctggtctcgaactcctgacctcaagtgatccacccgccttggcctcccatagtgctggcattatagtcgtgagccactgcgccgggcctcacaggcataactgtgaggcttaaatggaatagggcatgcacatggcccaatacaaggtcagccgttcagagtccatgggggccttgcgggcctcacggctcccgtaggacactctaggggagactcaaggacgcggggaggggtatgctgagtgctcctgtggccctgccgctccacagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacaggtacctgctgattagtcgggagggctcagaagcttccaggggtcccagagattggctggaccctgggcctgttgctcaactccctcctgaatcttcttctgggctacctctctgtcacctgggccatcccctatcccctgttccttgctctgtcacacacttctcactcgttccccaggcccatcccttgcctccccatccctgctctgtgccttttcctgtctttgtctccttccttctcgctgccctgtccctctgtcactcacattcccctttgttccccactccccactttgttctcagccaccttccatcccctcatccctcctctgtctcccagtcccatctcttacccctcagtcccctccctaaccccatctgcaccccgcctctctgaccaccaacctcagtcctccccactccaaggctcctctctctcccccagcccccggcctgtccctctgtcctccttgcattgccccctccccccagtacccccctgcccctctccacttcccagctgcctccctctccctgtgcttctcctgtccacgtctctcagggggagcttctcccctcccctcccccagcctctctgcctctatctcccctctagtcctttcttcccacgtccccacacctcaccctccccatctccaggccttcggccagcccctcgcccctcacgcccctcttccctcacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggtgactgacctccgcatgatcggggcctgccacgccagccgcttcctccacatgaaagtcgagtgccccaccgaactcttccccccactcttcctcgaggtctttgaggatcaggaagtctaaagcctcaggcggccagagggtgtgcggagctggtggggaggagcctggagagaaggggcagagctgggggctgagggagacccccccacaccccttctctccttcctctcgtccttggatagattcagctcccacacacacacccgcactgcccaggtccctcctcagacctccagccctgggacagggcaaacaactgaacttgctatggaaaggacagtgtgggaggctgggggagctgtgtcctgcagttcccaggaccccatcctctcagaaggtaggggaagggcgggaggattgagaagggacaagccaccttgaccgtaggggaaggaggaatgtgggctgggggaagatgccctcaactcaccccctacacacacatgagagagagcccccacccagttccttggcctaggtctcccctccaggctgagggcctctctacttccccagatgcctgggtgcaaagaacggcttggcttggctcctcctctggaggttaaaatttatagtcattctaactgcactttggaaaccaagcaaggggagaagacaaatgaagaaaaactagacagagagaaaaatacaaaaaagagagagcgagcgatagagagagatgatattaagttattaactgaggctgaccagaggggaggaccccccctttaccaccccatgcactttgcgagctgccccttcttcccccacatcagagagaaatgcccccacaccagagccccaagggtagggctgccgatcagagctgtgagttaacacaacagggtcctggccaccccccttgccataccccgccctctgtgcccctttggcaccccccaaccctagtatgtcctctgctttctgccactcgtgcccgctgagttccatctacctctcatgctggatgccagctggcccctcaccagcctgccctgctgcccacacagctcccctttaagtgcccagccctaggggcctctccccatccacctcctccttccacaccttggcacccacccaggaaaaaactgtggctccaactcctaccctccttatatcctgcagtattagctagaaaccggatgctgctgcattggttgggtcgggggtaggagggctgtgcgtgagcgtctcccagaaccctccacccctttagcactctgtttccctgtttcccatctgtcttctgggctctctctaacctctgccctcctccccagctcctactcactgcactaactctgggcgggcaggtaccagaatgggggtgtttagataagtgacacttagttggggccccaggggaggggtggtcggtgctcctttttctttaaagctcttttggccagctgcccctctgccccgggaccccttcccctcttcttttctctaattcagggactttggcttgagcccctctcgccctcctggtgagggtgctctgttggtctgcacttgggtgagctgtcctcctccccctccctgtggctgccgcccactcctcaggggagagagggagagaggaggtggtcctcccatgggagcaggaggtggggtgggacagagcagaccagagggtgctgggctcagggctgcatgtcggcagggatggatgggtggacacagatgcccccggaagccatggggattggggcagggggtggggggaggggtgccagggcttcctgcgctttgcactattggggcaaaaatgtcttaagcagtggggaacctgccaccccaccctgaccctcagcctgccacagccccctacacacacacacacacacacacacacacacacacacacacggacatgcacacacggacatgggaaggcaatgctatgctgcccgtcagggcactgtccttccccaatcgttcaggtgttccaacaggggtggagggcctggaggagcacccgctgtcacctgtgcatgtgcctgtcccaccctgctggggcctcgggctgcccgcgctgtctttgtctctatcctctctctctctcctggagtactgaatcctgtattactccagtcccatgggtaggccctcttgtaccttcctaccacgcctgggggcccagtggaattcctgacctgtctgctgtcttccccatccctccatccccaccccaacccctccatccccattctcagccatggacacggcagagaaaaggccttgaagagccttagcctcttataggcacttgggactcccccaccctccccaatcatatgagctgtgatcccatcctccccggacccctcccttccccctcggtgatgtggggtgtatgtgtgcgttcctctgcgtgaatgtgtgagtgagtacacatggtaggggaggagccagggcgactcaggagtgccacgcacctgctctagagcggcagctgtcccagtccctgctgtggaagtgggggacagggccctctcctgggggccattggtgctaatgagggggatggccttgatgtgggtgctcagcatgcctcccccagtattggcccggggcactagggcaggcagggtggagcagcaggtgcagtatcggtgggaggacgggttgctgggaataggacgagggggccaggccaggacaaggggttgccagagccatgaccactaccccgcccccaccacccgcctctccatctcagtattgcccctcccatcactcataacacacatacctcatccagcctcctccctgctcagacttggggagggtgggggaggagcccctaccccttctcctggtggcgggtctgcagggctgggagagggcagggcgttgtgagagagagaccgtccataaggaggacagtaactcctgccctgggaactcctgggcgggggggagggggacactgcccagaggcgctactgaatgtatgagaagctggtgctgggctggggggaggggggttgtggccagaaacagggaaggaggtaggtctcttccccagggaggggtgggaccggcaggggtgacttgaggggctcctactcctgccccacgttgacaatcagtatgtctgttatgtgcgatttttcaccccgttgtgttttgggtcaggattttaaagaaagatatttttatggtaattgttgctcgtctattttactatatatttatgtaataaatatatgatgaaaataacccccttgggcaccccccttagacttgtgtgctgtttccctatatcctcccatctgctggcagagtacccaccccacaaactgaccagatggagaggtggccccccccagccttggcagtatttccaccccaccccccaaacgagcacacaccacagaagccagctcagctgtgaactattggatttgagacaggaacagaacaaatcagagggccaggggagggttgtgggggagacagagtggtttaaataggggaggaggggaagttcggtgatgggggagggaggcaggtatttacaagaaggctcagggggccagaggctcatcttggaatattttataacaatataaataagattctggtttgcttttccttttcgtctcgtaaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattg

SEQ ID NO: 36540 - DNA, 26027 bp, Homo sapiens
tttgctaggcagcggcagtggcggcggcagcggcggctggagcctctgattgggtttcggagtccggtactggagccaatcagcgcgggcagcgaaccgggggagcgaggcacggtgagtgtgaggagccaatatccagcggcccagagccggccccagcgccccgattggcgggtctcgctgaccactcaggagaggcccaggcgcccgtcgagcccggggagtcgagctgagcctagccgagccgggcggccagcggccccggcccggggcctgcgagcgcctcggggcactcccggccgaggcctgcaggggccgccccgcgcggggatggcgcctcggggagcaggcacctcggggctccgaccctcgcagggtgccagggccagttgggaatgcgtccctgttccccgactcaggcccaggttctcaggccccaggcctggggccacgaatggccctacactaggggacacatgcgcgccctgggcctcggcgatttcctcctggtcgttctggccgcaaacttaaacctgcccttgcactctccactctccggcccttgggacaggaagcctccccggggcccgcgccccccgctccccgctcccagcgagccgggtctgtcttatctgcagcccctctaggtcgggagggaggcctggggagggtgcgcgccgcggccgcggggtcccgtgtgcggctggcaacggggctggcccgcccacgcctcggagccctatgggcccgcccccgctgtctccctggtggggagagggggccgttagttcgcccactccccctgctccgccgcgcccctcctcccagcccgctccgcccgggtctccggcccggcgccgttaccaccccttttggctcgtcatttcctctcttccccgccccgttcgcagtggcaggaccgcacacctccgtcttggagcccaaccaagcggtctccgtttcttgtccgggctgtaagaccagtccattcggtgcctggaacctcactcttagaagattgatacccttgcgcattctttccggaggctgcacaacttgctgttcatattactaatcttatccactgctcattttgtgaaatctccctcccttgggaatatagtacagttttgggggttttttttccctttgtttttgccttcgcctttctatgttactttgtgtcaggcttgacccagtccactcatctcttggtttatgtttttctgatacactttcaagtcctgtgttaacgttttctcagcagatgtttagaaactaacagtgttgtggggttttccttagggtgagaggttgctgttggcaaccaattatccagcagttagtatatgccaggtataatccgtgtgttagggagggagtacgtagaggtcaataagaactgtgcctacctgatggaaattgacaggtgaacaggtagttaatacctaacggttagtgctataaaggggccaagttcagttgctgtgaagtatccatgcgtgagctagcctccgtgaaaggcttatcaccaccgcacttttgactggccttgaagaatgatggtaattcttccacaggaaagatggaagagcttgctcgaagagaagaaaagcatgtgcagaggaatcaaattacactgttggaggcaggaagatgggatagggaagtgggcagtagttgtgatagtttaggggggaaagcccagttggtaaaatacttgtatatcttgctaaggaatattttggaaacagttattattttgtatggaggttcaagtagaagggatctagagctatattttttcctaagattgaaaaaacgagtttctgacttgtttatgggttctgccccgtgatagtggctgagttctttggggatgaagaggagacttgtcctaggactctgaaaattatttttactcatgtgaatcatctagtgcattccctggcacataaaggtcttaagtatctggtgcccatttctaaattcacatttaatgttatacaactaataggtttcagaaaactcgtattccagtgctctttcattactaaaacttcggggacaggttttattttcactttttagggtgagtttttcattgttgcttaagtgattttcttaattcatttgattgtcacgttatccgcattagcagatgagatgatagagcttaagtagtctaaaaaacatgtatatttgcctttggaacgtttttttgtttgtttttggatacagggctttcctctgtcatccaggctggagtacagtggcgcaatcgtagctcactaacctggaactcctgggctcaagccatcctcccttcttgttctcccaaaacgttgggattacaggcatgagccactgcgtcctgacctgaaatagatgttttaaccttagtatttaaaaataggtatgttctggtcacttcaaaatcactaaatacttttgcttggcatctttctaaaaggcattataatctggtaacttttttgctaaataccttacaagcttccaccagtctgcagaagaatttctttgtctgacattttgagagaaagtagtgtggccccaagctttttttcctgtttagtccactgttcacatgctgaaatatttctgttcttgtttttatgctctcttgatttgtagtacttcaccttcctccacatcatcacatagctaaatctttctcacacttaagaccagttcatcctgcaggcctctgatagcaaagaaaaaaaaagttcaagtagtacctttttttttttaagccttgttgatttatccccagctggaacaaatctctgtcctccaaattcccatatcactttatctcttaggattccagtataggtttttagtccattactaaacttaaagactctttgaagtttgaatcttcgtcagagatttctttttatttttaaaaccttcagaacagtgtctggcacatggtacataattagtggagagaagtgcattagaaagctccaatccagaaatctgtaggatgatggggaagctggacagccctttgttgtagtctagtctttcatcaagcgtctatcaggacccacttgttgagttgtgaaagaaattgagtgagccaatgctgggaatttttaaataatagaatagaaaatatctgccaggcatgatgatggctcacgactgtaatcccagcactttgggaagccgaagtgggagaatcctttgagctcaggagtttgagaccagcctgggtagcatagggagaccccctctcttaaaagaaaaaaaagaatagaaaataccaaagtgcatcttgtgttgtataaaggtaaatgctgtttcatgaaactttcatttcagttacatgctttatacatgtgtgcactgagttgtgataatgaaatgtgtttcttactaagggttgtggtcaaaaaagttaaaaagctactgttctaggctttgcctggtagtgattatcaactgtgataatcctatggcttttcatatgcttacactagttgagtttctgaagaggttttagctttggagtttgtgtaggtccacatagaatgggttcctagtaagtggttggctaagtctcagcttttgcaccttggaatagtggggcaaagagaattgcactgagaagagaatgcactaggaagagaattttcatgctagccagaataaacacttattatttgtttctctctctttgaggaaaaaccattcaaaactttgtgttaagagcaagagctagacagactaaatctggcttagtttgtcataatcttgggcaaagaggcactttgggaaagactatcgaattgtattgcagtcttgctaactgaagctcacagtagtaggaacatatgactttactgaagccagttgcttatagcattaaccattaacagtatcaatatcatgatacaggctaaatcactctgtcattaatgtgagagagaattgctgctagatttgaagctgctcttcaaatcttgatactcttcaaagtataaatttaaatattgctaaattggttcatttgtattaccagaataaactagttaagaagaaaatctgtacgttacatatattagtcattatgtgcttcaagttatatttagtcttgtaaagatgtaaacttctggatattagtcaaggaaaaaatctcatataagaaggaaatttggagttggggaggcgttgaaacctaaaagacattcctttcatgatccttattttttaaaatcaatttattgagagatactttagaaacaaagtataataattttaaatgtgtattttgatgagttttgacaaatttgtacacctgtgcaactgctaccacaatgaagatataaaacattttcatcaccctacaatgttcctaaggctccatgccagtcaacctccctctttcctgtctccctgtattctccactcccaaggaaccactgatccattttctgtctctagattactgatgtcttttggagattttatataaatggaatcatatatattcgtttacatcataaccttaattttattagtttatagccataaatgtattgtgtattagagacaagatagaatttagggaagcctgttagtgcccctaacagactcacagtctggctgaaaacctgattttctattctatacccagaatctctgaggagcagacttagtcaaccaattccaaagagactggtgtaaaaatcagaaaaccggtttgtcatgttgctgattatatttgctccctgttggccaatctatatgtaaatccaaattatagctagaaatttacctagcgagcattccattagatcaagggcagtgctttggagaaccatatggccacaagtcctcttgctgtgatgacatagcctgttatttatggctcatagattcttatgttgtatccattttggttatgagtaatggggttgattaatttttattttgattaaattttgttatatttttcctaacattccaacattcatttgggaaataagaatttctcaaaattcttattctagaaataagaattttcaagtgtgcagtgaaatcaaaggaatttgaaaataaacacctgtatacctgccagttagggtctattaacatcttactataattgccttaccagatatttctccacccattcatccattttttgatgcatttcaaagtaaattttagatatcaatacacttctttctaagtacttggacatatagttgcacatattttggtttcttctttcacactgtattgagacaccttgcaaatgattaattccaccagcatgtgtggatttatggagagtggtactgtactttgccacgataatgagcagctcagttaggtcacgtcattttattattcagatgttggaatttatgagggcctagtgaaaaatcagagagaaagacctatctacatttttgtttatatatctgtcctccctcccatatttccaagatgaattgccgattgctaacttatatcattttaattttttaatgaagtctttattaaaggttctcagatatcattcagtttatctaattgtatccttatttttaaaagtggatcttcaactcttaaagtctatgagaagggtaaattttgcctaccatatgtagtggacctgagtaacatgtttggtgggaagcaattacgtgttacaacttaaagaagctttattctctaaagtatatgtgcaaacctgaaaatcagtgttaggtatgccttgtatcaaagtgatgtagcttaacgagtatctcttaggtgcaagtattgctctgacagtattgaaaggtaaggttgccagtatactgaaagcattttagaaacgtgaaaatagcattatgttgttatgattgtgccatgtaatcccagttaaaaatgatactgaatataagcatttcctattctcctatcctgttttcttgcaaataaagtacagtgataaattatccaggttaattgtctggtaaggcctttattgacaatctcactttagtttctttccccacctttctaacaggagtgtacctcacagccttctaggatctccagagtggacaggaatctcacttggagggaccatggagcagtatacagcaaacagcaatagttcgacagagcagattgttgtccaggcaggacagattcagcagcaggtatggaagcaaaactgctttaaacattacagcaatgaaactgataacagcaccactcaattggttggtctattgccctggggaattatttgaaagataccagatcttgtgagatattgggtctgatggcttgtgctgaaatgccatgtctagcccatgaccacttagaatctactcttcatgggtgcctggttatagtaaattgcctcttttatctcattttaagtaaaaacatctagtctggttttcagatggaaatttggactttaaaatttttctggattctatttggtctttttctcttcttgtttgagctaacttgtgatttagtaagtctttggccacaacagacaaaccaacatagcttccaataaatcttctgttttttgatttggtctgccacattttttattcagaaaagctctggtttaacattaggataatatttagacagccattcttatggataagacatactagaaaggaattccctgctgctggtttattcctaattaatagattgctttcttgaatttatacacaggttacattttctgatgctttatgcttgggtttattatagtaaaatttcacttttttccccaccccagaagaaaaaaatgtattatgtttctatttgaccttaggccaagattgatattttggaaatactttgttttcaaaatggaatttagctaatatagaaaagtagtagggaagggaaaggtagtattgatgatgagtttttcccgtctaatgatcaaagacgaactcccctgatagctttcccttccatacagctgctgtggctctggcagtttccttcaactgcctttttagaggaagggattccacaaagggccctccattcacaccagtgccctggagggtgggtttttattctttcagaatttgccattagtggatgtaaaaataaggttgaatcattgaaaacatggctcttaaagcagtccagttgggtagaaataatcttagttttgaagctgggcatggtgctgcatgcctgtaatcccagctactctggaggctgagacaggaaggttggcttaagcccaggaattcaagaccagcctgggcaaaacagcaagaccccatctcaaaataagtacataaataaagtttaaaaaaaaaagaatcttagttttgggacatgagagcattgacgtcatgaagatgatttcggttcatagtgattaattactcctcctttcttggtgattgcatttaagcccagaattttttatggtagtttcagggctattaaaacctaatcatttttttcttgtgaactcatctgaggagataaaaagggcattaaacaattgtgtaagtagaagtgtcagattcctgtttctggagggaaagattgcattacaaatctttgtgttaatgatgacaactgttttgagtttttgagtcaaatttttgaggtccactctggagacaaagggctaatatctttaatcctactaccttcaacaaaacagcttcaatatagggagtctgtacattttgaaagtccttcaggcttccgtctctctcctccaagaggtaaggtgatctgtgtcttgaactacacatttccttcctgacatatttcaagctcttcctgttcctgttctcagcagcagggtggtgtcactgctgtgcagttgcagactgaggcccaggtggcatccgcctcaggccagcaagtccagaccctccaggtagtggtaccctctctgattctctgtgagcactgcatgaacttctcctctcctcatgtctggtgctgtttgtgttaggatctccagtaggaatggcaaagtcagttgcatgtctttgatgctgctaacttgtctttgaggcttataagatgccagtttcctaatatttcatgccaagtcatatagagaccccgtatcaactttctgagaattggatttgactagcatgtttctttgagaatgcctggaaaagaaatggtataagtgacaggaagaaattcttataagtgacattagaatttattcagggctcggccgggcgcggtggctcacgcctgtaatcccagcactttgggaggccgaggcaggcggatcacgaggtcaggagatcgagaccatcctggcaaacatggtgaaaccctgtctctactaaaaatacaaaaaaattagccgggcatggtggcgggcacctgtagtcccagctacttgggaggctggagcaggagaatggcgtgaacccaggaggcagagcttgcagtgagcagagattgcgccactgcactccagcctgggtgacagagcgagactccgtctcaaaaaaaaaaaaaagaatttattcagggctcacactctgatccaattaattgcatggtaaaaattttgtgtatttgtgttacaatggagaaggaaatatatacatatacagacacacataaactaggctaggctgtgctttatttttattcaaggggcaactcaactgaaaaataatcattgcacttggcaaggtttatctaagcactgaatcttgttaatctcttgttaactgctattgtttccactacctttcctgggggaatagtgacctgtcttattactagatctgcaaagattaccccagatacctcttggttaggcagaagcaggatgtgctttctgtaagtcttaggtgttaaagccactgtgataattcttggttaatcaatacagttctttagcatcgtgtatggctaagtatcctaaattgggttctaatttggccagttcctataaaacacaggagtagcagcactagtctactctgtgtatgtaggttacttttattaaaataactctatttttgagaaattggcaagatttgggtaccctactttttccctccattgaattagaaatgattcaaagtagaatctagaatgtagaactggcatctcactttattgctagtgctgctaagcatccagcagataactacctcttattgtcatcactttatcctttcaatcccacccctacccctgccaccaatagtgtttggtaatgatgtacagccaactttgaacataaattaagccgaaagaaactgagcttgtaggcattccaaaattgtgttcaaatctcacagtccaacagcttgttaatgtttttcatgcttgcttcatcttactcatatataaaacagtattttggattgtcattaaccccttgtggaataggaatgtaacatgctcttaactgtatggcttcttgtttgatgcatgtgtctttgtaacatttttctgttgtaaatacagtgagctctttggagtctcaaatcatttatcatgtgcacgaatagcacatcaattggggaggaaattaagatgatgaatagatagaaaattattaatagctgtatcttaaaacttgtgtttcctacttacatagattttatttaaaagaagtggaaacactttatggaaataatagaaacctttcctctagggatctgattattttgggagaattttaaatagttattttggttattcttgctatatgtattctgagaaatctttcttgatacagaatatgcaagcatttggtgtagcaaaggggatttgatttggaatggggaaataagggaaagagatagcatgagagagtcaggctgtaaagtccttaaaaaagtaaagtaaaggttctcaatggacagtttaacaaaacttaggatttcaatgttcctggtgattctaatacattagtggtggtggcagtggcggcggtggtggtggtgattgtaggaggaccttactatctaacctactcatctaggacagaatgatctgttaactaattgctgttacttgcacatactttcattaagtgtgaatatttcagtcatgaatattctgttctaagtaatttctgtcaaagatagagtctgaaaatgaaaattttggactattccatggatcattacagtttacttctaaagcacttttaaagtgcttccagaaagcattctattaggtatttttgtattgggacttaagatgtgacagagcacttgtagtgacctggctcctacagtagtctgtttactcataggagcttgaaatttgtacacttgactgctctgtgtaatttcaatatttgttgttgcttctgataaagctaaaataaccatgtggatattatagaggccagtgaggaattccaccatggagactgcaaactgaccagaaagtgcttttaagaaatctttagtagtgagtttaaacaacaaacatatctagaattcacagagtaaaatgagcaggataaaggtatacatttgacatttcattttagcttgagagactgtagggaaaaaagggtcatcctctacataagcttccagagctgcttgctacccagcctcctagagtcattgctgggtacagtttgatttaccttcttcactttatttagaatttgtactcaaccaccatcaccaccatcacctttccctctcattgccttctctccagccttcactacagaccattcctggattggtttaaacaggcaactaaccttgccattatgattaaatgtttgtcatggatttagcccgtgtttggtgacaaatgccttatatctattgagacttctcaaagactctggatattctccattatgtctgaccttaaagtattgagcttggcatttagtaacaggattcatagatatttaaagataacttgaggacttgagacatatattttcttagtcttttctaccttttccttttctagcaaggcagcagaatagttccagtgattgtcttttggtaaaaaccattttgtgtcttatgttatttcattgttcttattttatttcattctaggtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaagtgagtaatatttaaaaatattgagcagtatatcagaggagaggtttcaaagaatagattattacaacctatttgataattgatattgcatttaactgcttcctaacccacattttgcattcagttgattttctgcctttatagtaccagtgatataaactagaactatgcagaaattggacagctccagtaatgactaagatattaggcatgatcttgaattgctgtaaagtatatgaagaggttagaatctagtttatagtatattttattttaaaagaaacaaaaatgagtatttagaaagttagaaaaataacaaaacgagcaaaaagtgggtccaaattaattaagtagaaaactgacgtatagaaaggataaataaaatctagattgtttaagcagaccaataaaacaggtaaatccagttgaaacactgattgagaaacagaaaacaaaagtaagcaaagatgtagaagagattaaaggaaggccaggcgcagtggctcatgcctgtgatcccagcacttggggaggccaaggcaggtggatcacttgaggccaggagttcaagaccagcctggccaacatgacaaaaccccatctctactaaaaataaaaaattagccgggcgtggtggcacgcacctgtaatcccagctacttggggggttgaggcataagatatcttgaacccaggaggcggaggttgcagtaagccaagattgtgccactgcactccaggctgggcaccagagcaagattctgtctcaaaaaaaaagaagagattaacagaaatatgtagaaatgttacatacaactctgtggcatcatattttaaaattagatatttctcatcgagatggcaaaaaaaaacaaaaagtcattatatccactgttaggatggatgtggagaaaaagaattaatcattatttttggtaatttaaaactgtagagttattttggaaaggcacctcactatctgttaaatacaatgaatatttgagctagcagtcccacttctgagaatctgtcctataggaagaaaagcatcaatagtagggggaaattacaaagacacttttcatagcattgtactagcaaaaaataaaattgcaatctgagtgtccattaataagaataaggaaatggttggaataaatcataatatattcatagggaatattgcatcatcattaaaagaaatgaactgttgacttggggtgggttaatattgaaatatttttagtggaaataatttgcagagaaatagtgtgtgatctcatctttgtaattcataaccaaccccccatgagtatatgtttatagtcatggaaaagagagtatgagataactattagttactctatctaaatgtttatattgtttcaacagttacagcagtcatattaatgtcttagttttctggaggaatttaagttgaaaaaagcagccatgatcccactgctcataaatcaaacttgtactttttgtgtattcttttgtgtttttatgcataatttttgggcataattgtaccatgcatgtggggttgtgttttcattttttttttttaattctttcataatgttcagtcaacttgatgaatcagaatttctaatttataaaatatagttaaggattttggttttcatttgcctttgtaggtaaacatttgggcacgatagttttatttttcaactgaattctcaggataatttctttggattggggattgcttgggtaaagggtaagagtatatttgagcccactggcatatttttgccaagatagaattgtacttgggattaaaaatagttttcacatttctctttgcataaatatatgaggctttaaatatcttttcagcatgtgctttccttgattccctattgctatatcctttctgttcttctctctttgcttcctctccagtcccccttgctgcgccttctccactgttgagtagagacaatgtggtatagttaggaacagtatactgtgagtgtagtggtccaagctttcattaccaggtctgccattaaataagcattctgatcttggccaagttatttaattgtcggtttgctcatccaaaaataaaatttatatgagatgatatctagggttcattctagctctaaattctgtgatttttatggggttttattttgctataaggaaccttcaaatagttatttccctgcttccaagtagggctataactaaccaagctgaaaaaaatatattctgttacgtaaataaagctctctaggtgagattccatagcctcccttacaatacttaaggctttaatcccctttgtataggagttttttttctcattagtgttgagtagccattttttaaagaagactacttcttaaccttttttgaattgtattctctattttagaatcctagtaaagcttgcaccctctaagaaaaagtagagatgtccagtctcatgaaaaattctgcatataattttagattaaaatccttggcctgagaaagatactggaaccagagagacagccaagaaatagatagaagaatattggaagttggcatataataaaagtggtataaacatatcaatgaagaaatggctgaagaatgatacagaaaagaaactgatttctaattcatactgtattttaaaaaatatttgctaggtggattaaagatctaaatgtagaaaagtaaacttggaaaattcaaaagaaaatataagaatttttatgctatagagaaggatatttttaaaaacaaattgactaaaacataatatgcattgaaatacatcaaataaaagtaaacaaggtgaaaacttggaaaagatatttttaatacatacaaccgagtttgtattcagaatatgtataaataacgtttatgtatttatacaaaaataggaaaatgggcgaagaatatgaatagatggaagaggaaatcctaacagccaatataaacttagaaatgaagttggttcacataaccagataaatttgtttacttatttatttgccaatactttctgaatgccaattatgagctgagtatttggaaaaaataattcagaagacctaggcaatctatcccctaacaaagtaggatccatgaatgtctctaagacatggaacccattgacctgtttttttcaccttccttccatcagtagtcctttttcctatcagctggtagactttgtgataacttaaggttctaggcatgttcttctttccagaccaaggtggtcccaagttgaaattatggatggaaagtgacctggctataaaaatctatctttctgaaagtatcctccttccagactgccatctatgttgaagcaatgctcaaataaaaaaagtttgttgatggaattaatggtcaaagaagcaaagagaaggttacttagtactagccatgtattctggcttttaagtttgggaggtattcttgaatataaaatacaagacattttgagctatggggctctcctcactgctttctcttttgcacttaaaaaaaaaagtgttcactagttatatgaaaataggattttgtacacccaacatttaaagggttgtattgcagttttttagttccaaaatttagagaaatatttttcaagcttcttgtcaggtttctgataacactcctaataaagtggctatagccattaaaaaaaagaaagaagatagatttggatagcacacgatcccttgctttccataattgctttataaggtttagctatccaatcctaggaccaaataggagatacaaattaaatcaacaaaaatttgacaaacattaatgacagtagtgagtattggtaattggaaactaataggaggaatataatctgtcacattgccttaattatctattaccatataacaaattatcctagaagttagcagcttaaaacaacaaacatttggccggtgcggtggcccacacctgtaatcccagcactttgggtggccgaggcgggtggatcacaaggtcaggagatcgagaccatcctggttaacacagtgaaaccccgtctctactaaaaagacaaaaaaaaaattaagccaggcgtgatggcggacgcctgtagtcccagctactcgggaggctgaggcaggagaatggcatgaacccaggaggcggagcttgcagtgagccaagatcacaccactgcactccagcctgagccacagagcgacactccgtctccaaaaaaaaaaaaaaaaaaaaaatttattttatagtttctgtgagttaggaatcctgacacagctgtgttggattctttcaaggtcctctcaaggcccttatcaaggtgttgtcctgggctgcagtcacatttgactagagtagaatacattttgggttttttctttgtttgtttttttgagacagttactcgctctgttgcctaggctggaatgcagtggtgcggatcttggctcactgcaacctctgcctcccaggctcaaatgatcctcccacctcagttccccaagtagctgggaccacaggcatgtcctaccatgcctggataatttttgtatttttcagtagatacagggttttgccatgttgcccaggctggtctcgaactcctgacctaatctgctcgcctcagcctcctgaagtgctgggattatgggcataagccattgtacccggctttcagcatttttaatatatatagtatttcctctgtaaaaaagtacttcatcattcaccaaaatggcaagattaaaaaataataataaagcactttagagtgtattttatttttttatttttttgagacggaatctcgctctgtcgcccaggctggagtgcagtggcgtgatctcggctcactgcaacctccgcctccggttcaagtgattttccggcctcagtctcccaagtagctgggattacaggcatgcaccaccatgcccggctaatctttgtatttttagtagagacagggtttcatcatgttggccaggctggtctcgaactcctgacctcaagtgatccacccacctcggccttccaaagtgcaaggattacaggcgtgagccaccacacccagcccagagtgtattttaaatatgcatgcttttcaatatatataatcataccactgctatctttcataaaaaccgacattgatttgttaatatcaggtatccagacagtgtcgaaattccctatttgtttcataaatggaaaataagttgtgtctacttcataatggagggcagagcaggacttcttttttcctcttcagaacattttctgctttctagagaaatgtggataactctcggggaccaaaggagaccagtgtcagtagagtacaatcctttttttatgttcttttctgcagatacagttggtcccacctggacagatccagatccagggtggacaggctgtgcaggtgcagggccagcagggccagacccagcagatcatcatccagcagccccagacggctgtcactgctggccagactcaggtaattccactagctctgtcacacaggagcaaaactgatttggaagagtcagataactgagtcagatatttcatgtatagcatgtatagtagaaaaggggatgaaaaccataaaaaaatatatttttggccgggcgcggtggctcatgcctgtaatcccagcactttgagaggccgaggcaagctgatcacaaggtcaagagatcaagaacatcctggccaacatggtgaagccccgtcaaaatacaaaaattaggtgggcatggtggcgcatgcctgtaatcccagctactcgggaggctgaggcagagaatcgcttgaacccaggaggcggaggttgcagtgagctgagattgcgccactgcactgcactccagcctggcgacagagtgagactctgtctcaaaaaaataatttttttttttaaggactacatcgttctttgttagtatctttgggatctgttgaattgtgtcattacttatttcctccagacacagcagcagattgctgtccagggacagcaagtggcacagactgctgaagggcagaccatcgtctatcaaccagttaatgcagatggcaccattctccagcaaggtaagtgtacccataagcttccctaggactttttggggcaacttttttgtcccttagacaactgacatctttagaatttgagtggtgaacttgacactacatattttttggacaaaaaaaaaaaagatttcctctagctctccattgattgttggtttcttgtcaccatctgtgaccaacagtgattccatgtgtagcagtttctatagtggttgctaatctagggattgtgtaagcttttagggaagaagtgtttctaaacagaagaatagaaatagggagttcattggtaaagagagaaatagatcaaaaatcaagttggctttagagtgctattgctgcttatgtttttttctgggtcattccattactttaaatgactattatgtatacagcacttttactaagaagggtcctcaaagagcctctagtctagtaagaaagacgtgaacaaataaatacaatgcagggccctcatggaagtatgttctaggaatagataacataaataatagatgtttggtctgggaggaggagtgcagaaactgaacttgaaggcttttggaagcacctgttagtcaaatagttaaatcaaaaaaggacatctttgttagattccatgactttgtgattgcaaatttgcaatatacaggatccagagagtgcactaactgtgtgctcttgtattactccagggaggccctgaactggattgagcccaggcaagagctcaaacagaatggtgaacaaatcctcaagtgctgctattgatagtctggggacttggaatgcttggtttaattttaagttttaatactacaactgactcattgtcagtttgagataaacaaagtataagttttaaaatctctgtcctgaagcagattgctcattatgtacaagagcagtaggtatagctgtagtcagactgacctgtagaagaggaggcctccaaaccttttcaccttttgaaaactgctaaggatagagttactcaaaactgggacctagacagttaatagaatttcaaagattgtgattacttagattatatatagcacaccacagtgggagagtactttttctccccttgtgtttttcagtgtgttttgccaggatcggtgagtgtataccagatagaagagggactaactatgttcccttctttctgttctgtgtgcctgttttttgtttgttttatgttttgttttcttaaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatggtaagaaaatgtatttttcagctttgtctttgaaattttcttgaacatgcaacttgatgcctcctaaaatttattatgttgacctcttgggattgagatcgatccttaaggcactgtcggtaatctactttgacaataacattatgacaaaccataattcattctgagcacctactatgtgccagggactattcaccagggactattctagatgctggagataaagcaatggataaatagtgattttatggaattcttttcagaattcaaataacgaagggaattatatactaatctttgagaagtggaaagtagtattgcccatgatggacaaaataagaaataagctaaaaattagaaagattgtaattgatagagaaaccaaaaaaaaagtgtcatgtaaatgtattgggaagataggaagatttgggtggtgtaactgaaagctaaatcctcatatgtcaaaataggatgttaaaatgcataaattaagaatgagtaacagaagtctgcacagaggtggaggaagctatgaaaagaaacagaaccaaccctggctcagtggcatgcacctgtagtcctagctacttgggaggctaatccaggaggatggcttaagtccaggagtttgagctcagcctgggcaatgtagagagacctcgtttctacgaattgaatgaaaaataaataatttttataaaagattcaatacagttattcaaagcggttgtatttgggaaagagctgtggggtacaggactctgttacttgtttttacctacatttagtacagtgttttggtgttttttaagaaaaattaggattgaattataagttaactattatttttataaatataggcatttagtagcacttggtctatctatttttgtgctgtttttttgtcttatgactactgttcctgaccattagatggcagcagaaatatctagagccatgggtggacatgaattagggcatggttatatagtttctcagagtggcacctgaatctcctatgacacagtcatctggggtgtttgtttaaagtgcagatctttagtataaatttctccagggatccgcatttacccaagtaccctataaaaattactttttgtggcatttacaaaaaaaatggatgaagaggaaccaagaaactgtttctatgtccatacttcatgccaccaataagctctggtttcctgttcacacagatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaagggtatgtataacattgggaaggatataggaaaggagaatagcagggttctacttttgaaattatcttttatatggcttgttttctcacgtaccttccaaacaattgacgttagatacttgttgtctcttttgtaagagttagcatttgttattactaatatgcagctgcagttataataacgaaaacaaacagtggcttaaataagatgttattccttttcatacataaaagtagtccagagataaattatcctggactggtagcacattttcacagttctcaagacctgtttcactgctttaatattgctagtgtgctgttcatggtccaagattcctgcttaggctccagcctaggaagaaagggaacaagaaaggtaccctttcttttttttttttttcctgagactcagtcttgctctgtcatccaggccggagtgcagtggcacaatctcagctcactgcaacctgcaccttccatgttcaagtgattctcctgcctcagcctcctgagtagctgggattacaggtgtgcgccaccacgcccagcttatttttgtgtttttagtagagacggggtttcaccatgttggccaggctggtctcgaactcctgacctcaggtgatccacctgcctgggcctcccaaagtgccgggattataggcgtgagccaccatacccggccaggtaccctttctttcaaggaaactttgaagaagttgtgtaccttccactagccggaatttagttacctgatcacacctaacatgcagataaggctaggaaagtccagcctggtgtggtggcaaatgcctgtagtcctacttggaaggcagaggcaggaggatcacatgagccgaggaattcaaggctgcagtgattcatgatcatgccactgcagtccaacagcaagggtgtcagagtgaaaccctgtttctagaaaataataataataaactttaatgctaggaaagtctttttactgaacactcatttgctcaaacgaaatttggcctgttattaaagcagaggaaagtgtatatattgtgaagtgtaggtggtagtctgttattttttttaaaaaaaattcatactataagcattcacagtcttacagtagttatatatggttagctatattacttactaggtgttttctccaaagcttccatcgtcattctaagtcataattgtcccttgtgactttgatcccagctgtcttaaactttggagaatggaatttgtgcactagataactgtgctggttctggatagtattaatagttaaatggttttatttctcgttttagaaatacctgcatgagtctcggcaccgtcatgccatggcacggaagcgtggtgaaggtggacgatttttctctccaaaggaaaaggatagtccccatatgcaggtaggaagacatatacattttattcttctctttattaccttgtattgacttgagttgaagccttcagcagtgtcctcttgctattttcctactctgggactactcacattctctaaactggatgcaatcttatgtctctttagattatcttttatcttaaaaccactaggccagacttggtggctcatgcctgtaatcccaacactttgggaggctgaggtgggaagcccaggatttcaagaccagcctgggcaacatggcaaaactccatctctacaaaaaaatacaaaaactagccaggcctggtgatgcatgcctgtagtcccagctacttggagggttgagatgctcttcgtctttgtcacttattactattcattctttcttgaaaatcacacttttcttaattttcaaggaacaagttttatttttattgaacaggttttattaccccatcacaaatataatttgaatgtttacttttttcccttctaactgatgtgagcctggtctaatcctctcttctttggcttagatttataaaatagctgcttaatttggtttcccttcttccacttttgttcccctctagcctactctccacatcctagtgtgatctttttaaaatgtttatcctatcaagtccctgttctgctcaagctccttcaacccctaccctttcccatttgcacttagactgacatccaaagtgcttactactatgcccagcaaagccttacatgctccagctcctgtctacctctaactgcatttctacttcttggtctctatgctgctgtttactgttcattggtctacttcctgccacgggtctttgtccttagaattttcagtctgtatgccctttatctttttcatgcatgtctatctccctatctgttaggtctgggtttaattaaataccctatctagaatagatctcttctctctcagtatgttcttacaacatcttttctttttttggaggcagtggtgtgattatggctcactttagtcttgacctcccagctcaagtgatcctcccactttaggctcccgagtagctgggactatagccacgcaccaccatgcccagctaatttttaaattttttgtagaaatggagtctcactttgttgcccaggcaggtctcaaactcctaggctcaagcgatcctctcgccttggcctcccaaagtgctaggattacaggcgcacaccattgcacttggcccttttctttacagtgtaataatatttaagttgttgaatttttcaagattgtttccttcactagactgtaagttgtatagagggtagaggattgtttcgttctctgttatatttattggacttaattctatttaagtaagttgtatttaagtactgacttagatgtatttgttgggtttagtatccagttctgaaccaagcaatcagtgtttcttgaattaatagattcctcccatttgctgatactccattctatattaacatcacattccacttgcactattgcaatatccatcaaattaatctccagtctcctctaattggccttatatagtacttatacagtacatggttaaagtgttttttttaacctgccagtccccaggtcaaggatgcatgctattaatagttctcatttcttaactgcatcaaatctcaaactatttctgtataacatctaagcaactttgccttatcaccccctcaacaatcaaactaggtttcctcagtgtccccacacatgaacactaacaactctttcagtgctattaatcctcacctgtagtgtgagagcccctcctttctcattgctattcattcataacggtgtatgaatgtgggcctgacagctattgtggcaggagggcattgtgccaggaactctcctcattctgtgtgctaacaatatgatcttggtcaattcagcctcttttatttttatctgtaaagtggaatactgttgatacttcacagcaatgttgtagggatttcattcagtaatccacattaggcatctgtgtagcaccatacctagtgcatggtgagttcagtaaatgctagttgtttttgctcattgttcaagacccagttccagtcttccatctccagaaggctttcagctttttctcagatcctgcctaccaaggcttcagagccttggtatgggggaactaaaggtggttcttgcggagtgttgcaaaaagcttccaaggatttatccttgtgttaacacggtaggtcttaagtgagaaacagcatatagagtttagtggaaagaagatgaaatgggagtcaggagatttgggagttagcccttgctggactcctaactttctgaccctgaccctagtccacgcaaatcactttacccatctggccttcagatttatctgtaaaacgagtacattaaagtgtatagattctaatgattctttctagccctgctaagtactcagtatttaaatgatgatcaaaaaacagtgacaaaaatacagcatgacatggtttctctgggtcttttccttagacacctgaatctgaatactcttaacccttaagtatagagaacaacacaaggttcttaggaaagagatacactaacagccctgcagtgtttcaccatggagtgcaggccagactttaaattattttaagaataaggtttattgtctcttctttcctaatggggctacactttaagccatgtatgcagacttaagatgtattacaagcctttgatttacttggtaaagttatgtgtattctcttggggggataagtagtgagagccatgagttcctgttgcttttgcaaaggactttaatcatcatgtcatctttgtctctaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttga

SEQ ID NO: 36541 - DNA, 64426 bp, Homo sapiens
gccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtaagttcagccccctcctggcacttttcccgcagcttcttccctggggtcggtctcacggaaaccctgcctccagaggggaggaaacagaccccactcctggagccccccagcacccttgcggtggtacccggccagagagcgatgccgctgcctgccccgctgctgtaggggagcaagaatgacctggaggggagagcaagaattgttcgcagccacgtacgcgtcccaggcagaaaaggtggcgttgctagggcggccagcgggctttgcagttaggaccgcgagaaggctgtgcccgtctgcggagctggggtgttccctcttcagacctggaggcttcctctccgaggacatggggctccggggttgtgaggggagtgagaagataggtgaacgagttttagggcccctggacctactgcagcgcggagctgggacagtcgcaaaagttgcgcttgtttccctgaatccagactccctggccagtggggaaggagagagaggctttttgcctaagtcagttcccttccctccctgcgcgaaagggtagcgtccttgggcttgagcgactgtcacctttttgtccctctcctctcccaggtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagaggtaagtgaccagggatatttgactgctgaggaaattgaaggatgggcttaaattctggggcagcgacccagggactggctcggagttgtttctgagcctactcttgcgctgaacctgaccttggaggcagcagggctggagtggcttgggagtgaggaaagacgttgtctctaggcatcttctgaggccctggcaggtggtcactcccttgaggaaaaaaatgcttagcggatatgagagcgggagtgcagatgtgggagcccctttgaacataaggcaatttactgtttggttgcttatttttagaaccatctctaagtatacaagtatttctaattatatgttcattgaaggggaaaaaatcagaaaatacagataattttaaaaaagaaaacaaccactcattttcccaccactgataaacatttttctgcgtacattttcagagttttttcttctgcatatctttattgctgtctattaacaatgatgagtttacactgcacatactgttttataacttgcttttttcacagaatagtgtattgtaaatatgtttcaatgtcaataaatgtatttctacatcatttataatgatgcatactactgtatcctgctattatcctgtataatagtgggtgtaccacagtatgctcaaccagtgttgggccattaaggctttttctggtttttcattattataaataatagcgtgaatcactttttaaaaagctaaatctttgcacatgttcttagttgacattccaggaagtgcaattggtaggtcagagaggatgcacttttgataaagttcttgataacttctgcctaattgccttccaggtaccagtttacaagtttcttagtttataggagtctgccgtcaatgtgctttacagtctctacctgcggaaagtaaaaaattccaggctcctggtctttagtcttgtcatcaacatttgaagtcctccaaatggatatgagtggggccagcgtgcttggtaaatggcaaactgcctcattcctgaagaaagtaagggcttccttctatggaattagacctgaatctaaaataccatactctaggggctgaaaccatatgattcatctcaattttaacttacggaaatgcttcttcactatagaaggatggtacatgccccctgtaagaggtgaggttgcttgcccatgtcactgatctctatcttgtaaggatgctgtgacttatatcttttgtatggggactctttattttttaatttttgagggtacatagtaggtgtatatatttatggggtacatgggatgttttggtacaggcatgcaatacgtaataatcacatcttggagaatggggtatccatccccccaagcatttatcctttgtattacacacaatctaattacactcttagttatttaaaaatgtacaattaagttattattgactataataacctgttatcacaggttatagtcaccctgttgtgctatcaaatggtaggtcttattcattccttctatttttttttttttggtacccgttaactgtgtccaccttcccctgacccctactacccttcccagcctctggtaaccatcctgttactctctatgttgcataaggactctttaaatgcaaggtttttggaattaaaacttttgtctggtccttttctggggtgggggaggtttagggtagaagagatttgtaaattccatctctcttttacttttctaattaaaatccacctgcagacattaccatttgctagttggcttcagaatgtttcattaagaaaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccttaaaaaatgatgagttcatgtcctttgtagggacatggatgaaattggaaaccatcattctcagtaaactatcgcaagaacaaaaaaccaaacactgcatattctcactcataggtgggaattgaacaatgagatcacatggacacaggaaggggaatatcacactctggggactgtggtggggttgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaataaataaataaataaataaataaataaaaaagaaaggggaaaaaaaaaaaaaaagaaaggaggattctgtttggataggggatgttctttcaattacccacattgaagtttcttccaatattttaaagagctctgggacttgagttcttgttttaatagttctttggagatagactttggcaaacagtaatctaatttgcttgaaggactgagttctacatggcgttcttaaagtttggcttactaactttatattgcaaagttactggaaactggaagattcaaagcaatggcatctttgccattaaaaacaattgcagttggtgccctttttctccatggatattcctgtcaggtgtgaccagatgttgcacctgatattgcaggaatgtcaaggtgtaattgtatctgaaaaaaaaatgtgaacaaatagtgtttgtcaattcagttaatctgagatttcttgaactctcataggtagttcacagagcaaaaaagttatggtgtagacctttgaaatacttattgatgggagacatagaggactaatgtttagctgtgctttttgtggggaaagaggagtgttttgtttttgtcattttagggatggggttagagacagctgagttatatagatctctgtaatgtggggaatgttttgtttatctggaatttaagtcaggttgaaagggctaaaaagaatggatattgagaatgaggtatcaagagagattgttctgagcaaaaacatgacccaggagaaggttgagagagcaacctattagcaaaggggccagagaaatggatgaaggagtcacaggcagtaacataagacagatgagtgcaaggttgcccgctatggttgaatatttgtcccctctgaaaatcatgttgaaacttaatcctcaatgtgacagtattgagaggtggggcctttgaaaggtgactgggtcatgagggctctgccctcaggaatggattaatttattcattcatggattactggattatcatggagtgggcctggttgctttataagaagaggaattgagacctgagctagcacattagcacactcagctttgtcgccatgtgataccgtaagtaccctggcactctgcagtcaccactagccagaaggccctcaccagatgtgacctctcaactttggacttctcagcctccataattgtaagaagtaaattccttttctttgtgaattacccaatttcaagtattttgttgtaaacaacagaagacaaattaagacactgcccaatggaggcctccatctgggtggagactgagacatgttgacttggttcaaaggttgatagtcattgatggaggtggttggatttcacagagaaaatgagaggtaaaagcaggactttattgtagctttttgacttctggagacaaggtttagaagaggggtggtctacagcccatccaagagagttcagactgagtctgagatatcactgtgaagatgaagagaatagagacatatatggaaattggttaatgctgaaccatatatggaaattagaaatgctgacgttttgctgaagagtatcaggaaggatatagtattagggatgtgatagcactcagcatttgtctttgaatttttggcaggatctgtaggatttagtgcagtaaaataaatgagggacagtcccccatgtgacagtgtcctacaggcagtgggagatgaagaactacactaaggaatggaggttagtgttcacagcaaacactggaggccagacccaatgatcctagagctctagaggacatgtggtcctgaggaagatgacaaagagaactttgtgacccctataagagtcaccctaattcttcatttccattttcattttcattttgataagcctctataggcaagccccttgaagaaaaggatgtcactattctgatttttgtccagatagctgcagttaattaaatgaattgaaaaaattagaaactcttagaggggtgtatgttgcatgcatcagcctggctctgatgagtgtcacttcaacattgattgggatgtcctgtacctgggagggagagtcaggctctggtttctgcagagggctctggcttttctctctttctgataacagggcctgcagccactcaccctgatcctctctgtgctgctcctctccctgtggaggcccctctctcctctctgggatcctgggggagctgggaaccagtgactcgtttgtcaggtttggcagcccatctgagggcttctctttggagacagagcctgtgcggctcttgcaaaagcttgtatctaggaatgtgaggacctttcctgtttggaagccagtcaaggagttttttgagagggggagcccttcaagacttcatgaagtgggctctttagcaattagatgtagaattttgtagaactgaccaagaactttacaagtgatcatttagtgtgtgggtggcttttaaacagccaaactcttttggcgtgtactttgggatcataaattctacttaaaaggaagttgtttccttcctctgatatttgcctattttggtggagacaaagaaattaaatacttgccacccataatgagtgctcatctcaagaacagtatatagaagatgttgaataaattttaattgaaatgaatttgttggctggttgaatgaatgaatgaataaaataaagtgctaaatgcccagagttcacagcaaaaagtcagactctcctcttcacagctctgtttactactctcttccccccttccccatccccttcaattcttcacagtctctacaacctccttatcttatggaatttctctaaatttagaaccaggattctctcctatctcacatttattatggcagatcaatgccaggagctttgaaagcttagctttttgaaatggggttttttctccttcctctagtacttttctttccctagttgatttttctttattctgactaatgtataactctgaagttattgagtccacattagttgatgatgtcgactatcttatggatagacatgaggcagaacagcctttgtttatatttggcagtagttgtggcttcctagtattgagaagctctaaaaacatttcttgctttttgtttttggaaaagtcaagctttgctgatgaacaatcaacaactggaacaataacaaataaactaggcacctgttactttgtgaattgaatgaatgaaaaaagcaaagcaagatgttgttttttctgggttagagaactaaaagaactgctgattgtattttattttctcttgaaaagtgtgttacatctatatttctttatcctattagcaaaacctcaaaaccttactttgaaattaaacattgaaaggaaaaattaacattagaaaagagctagaacaactgtgggagtagacttagaacaaagggaagagcccattccttccttgctgtttccttcagtgaaatgtgatgttcttctctgtgcccgagtttgtctgtctagcagaatggaaaggtaatgatacttaccagtaaataatatttctaagagtcacattatttgtgaagtaagttgtgttttaaaaataccttcccagttccttactaaattgtaaaagtagtgtgatttagtgagagagagacagtttcagaagcctaaacataacagctttttgagaatcaagcactgttcacagatctttaggaggagcggtcgctgaatgaaggtaaaggcaaaaatctcatcttgttgaaaatatgagggtaaacagaatgttaaggagtgatcctataaggacctgggtgttgaattggcagctgattcaggctcctggtccctctctggtctgtgttggctcctgcagtgtttataacattcaccagctgcctctgtgacacctcccaacctccaccctgagatcctggacacacaccccggctcttggcctctaccaccttctccagtgactctcctaccatttcaaccatggctgtttcccagtcctacaccgtgagactctcctgggcaaagcctgtcttttgctccttcacatcctcagcatcaagcataacgtctggtgcttaagtagacacttggctgtttgaattagtgtatgaatgaataaatgaatggtgtttacaaacatataaacaactaaccaagcataatgaggtgaatgctcactagagatgcccataaaggtgttacagaggttcagagaacagaaattattctatagggaatcacaaacacctctgagtggcagcatttgaaggttaggaggctttctaggcacagggaaccacgaacaaagtgtagaagcatccaaggacatggtacaaatggggactattaaatagtctgacaaagatgcagtggaactgagcctgggagggacgtatgcagccaggttacaactcaccttgaatgccatgttgaggaggggttagggtgtcctagggtgtgggctctagagctggctggcccaccaccacatacttgccacctgacctgaggaagacctgttagcccctgtgtctttttctcatctgtgaaatgaggataaccctgatgctcgtatgaaagggtagatggaagaggaaagagagtgatgctgtgagacagtaaggaggccttttgaccaactagtgcctaacacagtgcctgcccatagtggtcatttaataaatggatgaatgaatgaatgaatgaatgatgcaaatgagagatgctgagtgcctagggttataaactagggcagtgactgcaggatggacaagttaattttgctgattgctcttagctctgaaagagtttacatgagagaagtttgaaaccttacaaagtatatattttttaacctatgttttaccaatgcgtatttcaactattaatctaaattgacaaatggtatttgcaataataaataatattgcttatgaaattatattgttaacttgaagaggaaattttaaagaaggttatgtttaaaaacaatttggaggaatcctgaaaaaggggaagttctttgcacgttatgatgctttgcttgcattctgtttctttcttcttttatttgttttttacaggatgtttctctctctctctctctctttttttttttttttcctcacagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcagtaagtaacattgagctgaagccctttcctatttgaatataaggacttttaggaagtacctgaacacaagtgaccataagaccattacataatatattggtggcttctaagtaaggcatcaagtcaaaaccaaggaactagattcaaccctggaaggatcaagttcaccaaaacataaaaggtcctttatttttcctgctctattgggtatagatactggaaacagaacagtatgtgtgtgtatttgtagagccactgaggcttgctatgaaaaacattgctcttggaaccacataaaaatatccagtcataaactgcccagtttgaggttttccagattaatcatttcacaggaggaaacattgtgatttagtcttttggacagatactgttaaacattaaattgagcaatgtaatttgcaggaaaaataactaagatttataggtttccagaagtctgaggatgtctctctggcttcattacctaaaatgaattgaacccattccttagactcatcagtgtctgcccataatgggcatttaataaatagatgggtgaatgaatgaatgatccagagggcttacttagctagtgcaataataagctcttctgcattttgccagtacagatagtgccagtaggatatttattgacttcagggttttttggggggtgtgtgaggggaggtaggggtgccctcgcttttattcgtttcctgaatatagaagccagatagaatacattggttacttcctggcctcctttaactgcttcttgacttcattaaatcaatcctgggtaggtatagaaacaccttacacttttagcatgccatccactctgctcggctaccagaaagagaccactatagccaggtttgcttactcagagctgacatttattgaaaacttactacttgccaagcatcatgctaaacactttccagatgttatcttaattaaaactcacaagaattgtaggttagtactactattttcccagttttacagaggagcttagggaagttaagtaaattgcctatgatctcaaagttaagtggcaaagccaaaatccaagctcaagtctggagtgctgaactacttattttatcttatgctgagtccttgtttcctttcccatccttatgatccacattgggcatctttagggctccatctaggctgccgcttagtctggactctggagcaaactcagttccttactctccctcctctggttccaccctctcttctacttgggagctcatagatttattattccatagatttattattatagagaggtcacaatggccaagcacatggaatacaaagatttctaagacactggtcctgcacatcagcagcttgtaccctattagggttgatagacaaatagatcaacaattacagagccctgggtaagtgctggcatctacacaggagacaggagacagtggggccaaaagacctgtgggaaaaagcagttgtgttccctgagcagagccataaaggtctcttggaactaacatccacaatcacgtgtgacacacaaacacacagacagcatttccacttaccccctttcatgccttccctcatttttatctttgatacttcccagaaatctctgaattgcttggcgaaagcagagtaagatatggggccaaatgactcacgtatttttctttattgtaatccatgcttaatacaaataataaagtacaagcaatgcagaataatgtgaaataaaagtaaaagttatccatgatcactacttcaagtgataacaagtgttaatggtccttctagaatttaggtatatacaaaacttttaaaaccaaaatggttcttttgctatgtaagtggtgttttcacattaatcacttcttataggggtcttttagtcagatgtctgtctatactaccattttaaggctacaaaacgttatgtcatatatgtataaagacagcttattaatgaacatttcatgtatttctgatttttcttgttataaatatcattgcagtaaacagcataataaacattgctcacattctcgtttctccctaaaacaaattcttaaaagtggaattgctgagaaagggtgtatgatttaaaagttgtacatttcagattgtcaaagttactggtcttttcctttctgattttggatcttgttgttattcttaggaagaacttctgtacatcaaatttatagaaatgtccttcaatataatcttctatttcacttttcattatttaaaatttcaaaaatatacagaaaagtggagagaataactagatgaacacccaaatgcccatcacctagatttatacattgtaaacattttgccatattcatttttttgtttgtttacatttttttcttttcttttttttttttttttttttttttgagacggaggttcgctcttgtcgcccaggctggagtgtagtggtgtgatcttgtgctcattgcaacctctgcctcctgggttcaagcaattctcctgcctcagcctcccagtagctgggattacaggcgcccaccaccacacccggctaatttttgtatttttcgtagagactgggtttcatcatgttggccaggctggtctaaaactcctgacctcaggtgatccacctgcctcagcctcccaaagtgcagggattatgggtgtaagccaccatacccggcctgtttaaatgttttaaagtaagtcacaaacatcatgccagttcattgctaaatgccttagtatgcatctcttaagggtaaagttaggctgggcaaggtggttctaatcccagcgctttgggaggccaaggtgggaggattgcttgagctcaggcattcaaggccagcctgggcaacatagcgagacctaatctctactaaaaatttaaaaaattagctgggtgtggtggtgtgcacccgtagacccagctatttgggaggctgaagtgggaggatcacttgagcccagggggttgaggctacagtgagccatgatcaatcacaccactatgctccagcctgggtgacagagggagaccctacctctaaataaataagtaattaagagtaaagttattttcctagtcaattgttttcttcctcaaatttgtctcacaactgtgagctcaaaggtcataaattatatagttcataatgtttgtcatactcttcctctgcaaatttaaatacgaattcacacgtgtatattttgaaatcatacttttctatcttctggaagacaagacagtagttaataagtatttatgatgtttagggccagtgataggcattttatttatttatttttttgagatggagtctcgttctgtcatccaggctggagtgcagtggcatgacctcggttcactgcaacctctgcctcctgggttcaagcttttcttctgccttagcctccagagtagctgggattacaggcacacaccatcacacctgactattttttttgtatttatagtggggtttcaccatgttggccaggctggtcttgaactcctaacctcaggtgatccgcccaccttgatttcccaaagtgctgggatttcaggcatgaaccaccgtacctggtcagtgctaggcattttaatgtggttttctcacttaattctcctaacaacccagggaggaaggcattgtcatcccattttgtaacccaattttcctttgtagaaataaattaagttctttctattactaagctttccaaatgaccttggattttaaaataaactcaaattggttacttttccattatgcataatgacaaaacccagatagtgatttatatataattagaaggttattttatttagcttttattggccataatctgtatttttccactgtttgaagattttatagtttctgtttctaacttcaagaagaaatttcatagttgcaccacctctaatgtgataataaactcaatatcctcagaacttcaggattttctcctactgtctttagttttccttatttgcttgccaataaacaccaacattaattcttatgaacttaacaaatatgtatagcatattgcacacaaaatcagtttttctttctatgcttttttccctaaatttaccacaacagtaaccacagcatatacatatatgtacatgcatacacacacacacacacaaacacacacaagagaaagacattttcaaattgtactgaaaaatattgttactatagaaatccacatgaacatgatgagtacccacccaaatgaaggaaaatcttttgttcttatacaatttagtgaagtttttattatcttattaggcatggactgttattcctcattgactgacttttgaggaaattccattgcttgggagaatgtgagcatagtgttttgtacaaatatcagaggagtatacaaactggcatattcaacctaaccagactcttgttcactcaagttttcccatatttttagaaatcatatgtagttgttctctttagggtataccattgactctaaaataatgggttattgggatatttggaaactcaatggagttcatgttcttttctcatggagaaaacgagagagctgtttccagaagtctttaaaagacttctaagctactttcttatttgctccttaactttttcagtgcaaaaacaaattttttaggttttggcatttgtatttatttgaatttttttacattgactcaccattctttgtggattagggaattaatcagttcaagtgaataaacaatgaaatgtctttaatattctgtagagtaatgataattcagatgcttattgactgcagtgtgtggtatggttttctgtcataatataacatagatgagtagagcatgggctttggtgttaactgaattcggatccaattgtttgttatgtgaccttcagaagatcagttagccttttaaagcctattttcccctctataaaattgaatatgatcacctctatttgcagattgtattgaagaatgtgaaacacttggcacagggaaggggcatcaccaattcatgaaagtatgtcgtagtcatttgggtgtcagtatttggtagagttttaagcatacatttttaaaatgtgttatgtttccagacaagtagaggaaggatgaaacattcctacattccttgtttattttcaaatagccagattttagataaaccatttggattatggggcagattgataatttgatgatctggcattctgtggcatacagctttgaaacataatgttaaataaaaggtagttcacatcaaaagtccagtatgatccctttagttaccatgtaagtctgcttttatttggttttatataccagtgaaaactgaacctgatcttaatagcctttcaggttttttgtttttttgagacagggtctcactctgccacacaggctggggtgcagtggttgcaaccaaagcccactgtaacctggaactgctgggctcaagtgaccctcctgcctcagcctactgagtagctagaagcacaggcatgtggcaccatgcctggctaagttttttagaaaagggttttgtagaggcagggtctcactatgttgcctagactggtctcaaactcctgggcttaagtcatcctcctactttggccttgcaaagtgctgggattataagtgtgagccaccatgcccagctgtctttccgttttaaaataagttgttcaccttctaggaaggtgggtgaatggacacttttgttacatttgttacaatgactgtttcctttttatttagactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactatgatgtgaatgaggaggaagctgaataccttccgggtgaaccagaggaggcattgaatggccacagcagcattgatgtttccttccaatccaaagtggatacaaagcctttagagggtaggatctcccctccagattctgatctgtcctcccccttgcatccaacacctacttattggccattctatcctgaaacagaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgagggtgagtgcattagaaaactgggtgctaaggtttcatcttaaccatgctggttttgcatagcgttgtgatttttctcttaagtgggtaggtgaaaagtttagcaaaaagaagattggatctaatttttaatccctgtgtttcaagagatagagtaaatttcctttgccaaataaatcttggcaggcagattctgttcggaatctcttgatcattaataatgtttttttaaaatatgggcctcatgaagtgagtgggggaaaactgggtttgttatgccagctacgctctcaagtgtaatgaactatttcagtttgaaagttcagcaaaggtaaaacattttgcggcttcatacacattccagtgatggacgggtttgtgctttttaaagtggtgagttgtgctggctcagatgaacatgccagattcatactctgttgtgagacaagcctagcgcttcccttggttggggagatatgcttgtgatgtgtgggagaggagagcccacagggaaagaaaatgactaaacacctgtgtctgttgtcatttctggttcatggctatgcagctgtggcatgaacctccctggagccttgtcctcatttcatgacccactgatcggactgagaggcgaggagggagatggcgaaagcaggcggtggttaattatcatggacatggggtctatgtcagtcttctagtccttgttgagacttgtcatgccagctgtttcttccccatcagacatggaaagatgtgaatgggaaactgactccagattgtttgttccagggactgctcatctgacctctgataggaagaaagaggtcagaggtgactgctttgttctgaatctccatgtttttccaccttttctgtttcctgtcactgttgtggcaaaaacatggctgacctagcagagagggccttctgggttctgctctggtattatctgcaggctattgcatggagaggtactaatttcaggagggaagaaaatattttctgactaatgtggcattgtgtaaggattcgagggagtacattggtgtcggcttcgagtttgaatcctggctgccaagcttgctgggtgacctgaagtaacttatgtaacccataagcctctgatttctcaggaattacttgggaggattcaatgagacagcgtatgtgaagttcttggcttcgtgtctgcactcactggttcttaataaatagtggctgctgttactaattttagaagatttaaaacagtgggaatggggtggaggatgggtagagaatgaagaatgtgcttattaaagagtttcacattaatttgtgcctaagggaccacatttccatgaagttgaagatgtaaattttattggaagtctttagaaccttcagatccttctgagaatctccagaatttacagtatgagtttcctctaaatacattttaaggccaagtatcaaagattttcacaaagggatttgaggtaaagacgcattcctgaatggccttctcatttgtgggttgtgatttccttccctgggaagagcgtgggaatattaaaaagcagatctatggagtcatgtattaaagggttaagaagggactgcacaccctgctttgggctctgagagcttgagatcactggagtaaagtgcaggaggcttcaggaaccagccatagagtagaacagaggcacagctataacccttgtggggcatgaactatgatatttatcagctgccggatgcagtctactatagacatcctggtaatggcaaaaaacgcctgtgaaaaagctggttaatacgcattttggaggaagaaatctagaagtgtttgaaacttagacaaaaaaaatccagtttttgttttaaaagaatttacggggatgtatgaagtatagaagcatgcaattgttaaatacttttgaggggatgcagtgactgtttctttcacataaaacattggaggctcagaggtctgtctggtaagtgtgggcttcctccgggaagctgtggggtgggagtggcagagacacagaacattgtccggtactaagtacccagccatgtggcatctgcctggctttttctgctgatggaatagaaagcacatggttttggtgctggttggacttgaccttgactcccagctctgctatgtggtttggggcaagacatgtagtctgtttgacccttggctctcctcagctctaaaacagagttaatgaagacctcgtcatatacttgcaagaactgaaattgagcttgggaagcaccctgcccaatacattttagtttccctttgaagctttagggtagtcatcttgctaaaccaagaaattaagatttagttaaaggcccagaaaatatcactcctttttacatttttttccccttagggactcattttacagacctttctttttgttcagaaatttagattttcagatcatatctacaccaggcaggaatgtcctggccacactcgagctctgtcttcctaggccacagaacagcagtagatggatgtgcaagcatgctttctctgaggagtcttgtttccagggagctctggtcgttttgttgtcaagtcaaaaagttacccaagcacctgccgtgtacctgtctctgactcggtgctagtggaagttttggctggcatttgctaagtgcagcctgctgctctaaagtgagaacttggcattagattgcattatcacagttagtcctcagaattgccctgtggggagttcgagaccagcctgggcaacatagggagaccttgcctctataaacaattttaaaaattagccgggtgtggtggtgctcacctgtggtcctagctactcgggagactgaggtgggaggatcacttgagcccaagagttccaggctacagtgagccatgattgtaccactgcatagcctgagcaacagagagaaatattgtctgaaaaaaaaagttgtcctgtagggtaggtacaatcatccttcccattttacagagatggaaactgagcttggaaatacttagtgacttgtctagcaagggcaaagactgcaacaaagtcatgaagaaattagagaaagctgtagggtgacagagagtcaaaggcactgtccaggagtgtcactgctgttggggaagtctttgtgaggaaggaggggcttgagccaggcctggggtcaaagtctgagagggagaatgtgtgaaaacattatgaacagagaagtgacaagagcggagttgcagagatgggaatgaggagggaggaaaggagggagagagacagagacaaaggttgattaaggcagtggggtgagagagttgccagtgagggcttcagctgcctgggaccatgggactgcctgtgttgtgagtagaaaggaatgaggtttactgataggggtcttagttattcttaagcctgctgaggcagtgctatacgcagcttaatttaatctcaatctgcatgatgagttaggaggaaggacacctggctttcagaaacctcatgtagtcccactccacttttggccttgtgaaaggctgcaggagtgtgttgcaagctcaacttccaccctgagaagaatttaagcaggttctgctgccagtgcaaccctccaggtgccaaagaccatcccctgggtgcacctccaggttgcagagggtctgtgaccaggagccgccgccccccgatgcctgtgaagacacctatatgaggagattccatggtagggcccctctcccttcaccagaagtggagagagcctgttagtgtcatgccagcagttgtaaaaggccacccccagggtcgtgatcactgccaccagcatcattacatgccacacacatcaaaattaaacaaacatgaaaactggacgaaaaagcattccactgtttgttataaagttggatatggtttttctaactagtctgtcattctgagagatgggaaaacttagaagaatttttcctgcggtgaaaatgactttttttttttttgaggtagcagtaaaaattgttagtagttgctccagctgtcctgaagcagccctgtgcacgaagcctcctgtgtccctctgtgttggcccagtgaacccagtcgacaccatggaacctcccctgtgtctggcccagggccttctgtgaagaagggcaggccggccaagggctgcagacaggtgcttaagtgtttctgggaaaatgaagattgaaagatggctcagaacaagtgcagaggagaattttccatttttgttacgaactcctagttaggacaagtctcaagtcctttggcagggcatttctttctttcctctgatatctccccaccccatttttctttctattaaggacatgagaaaagttaaaaacaaacaaaaaaaacattaaatagaaaaaaaagagatttaaaaaatcttcatgttaagaatcctttagcaactatcaaacctcagttaacaaatccatgacaaaatgagttcattcaaacctggccagcctccaccctcctgctgtgccctgaggtgtcagcaaacttctttatggtctgactctccgtggcaggagcttcctggcatagtgtgggtcccagaggaggccatggactagaaactgtatttctcaaagtgtgggcactcatccaccttcctctcactcagctgggagcctggttaaaaacactgatttccaagcgcctcctctaccttctgaaccagaaactgcatttttaagccacctcactccttcaacacctccaggcctctgcccaaatgtctccttctcccgaggtcttccctgaccatactatttcaaagagccaggtgtgcctgccctctctcaccctcttgtctgaccctgccatattcctctgcacttcagtgattctgatgccccctcaatttgatgggatttagagccagaagattgtttcatctctgtaggcctcaattttctcatttataaaatggagatatcttctaactagaataggaagaagtgcatgaaaatacactcaaagccatgatagggacatgaaaatgaccaccgaaaagaaaaagtgccacttttcctcgggtgggtttattgcacatctcatctagctgggatccagatcttgattcccagccttcaagaagttcagcctctttgaatttcactgcaattcccatagaaatttgagcagtcacgttggccggaggtctggcttttctcgccctggataaatagctgcacgtgggctcagcaccgttctagctccaggtctcccccttcttcagggaagggctatctggctgctgtgcgtctgtattactttcactaaagaatcttcacgttgtattcttgtggatggatgcccaaatgggccgtaagcactgagctcagcttctcaggtggccagaaatgagcacgagaaatttcctaacattctgcccaccccaggagctgccaattggtcagattaaatttgttaacgacattgatgagcaacacctagctcagaaatccaaggcttgttgtatcccaagccttctatcaacaccaattggtgtgagaatcactggcggggtggctaaagtgtagattgctaggatgcacccagagagtggaactggtaggtctaaggtgggccctcagaatttgcatttttaacagaaatctcaggtgatcctgatgcagtggtctctggaatccaccgggagaaatgcagctctccgtgtgaaggactgcatggtgctgtgctgagggtgtaagttgttattcaccccttggtgaatttccttgatgcctcatgctgttgtcagaactgaaccccacaaacctgctcctcctcagtctccctatctcagtaactggcagctccacccttttggtttcccacatcaggactgaacatcatcccacatccagtctaccagcaaaccctctcggttccaccttcagaatatcccagacctgggcccttcttatcccctgtaccagcacttcttaccaccaagggaccagctcctgtctgatttactgtagtcggagcatgttactcttctgctcgaaaccctctagtgcttcccatctcactcagatgaaagctcaaatccttcctgtgatctctgagaccctgcatgaatgacccaggccacctcttctctcaccatccctcccacatgcccacacacccctcctgcctgacacagcaccacgcctgccctcatctgtggggttcactccctcacctcctcctggcctctgctcagtcaccttctcctgaggtcttccctgaccatgctattaaaaagagccatgtacacctgccccctcccaccctcttgtctttctctgctgtatttctttgcacagctcttacacatccaccccactaagtaatttacttgtttattgactgctgctggggagaatgtaagcttcaggatgtgaatttttgtctcttttgctccctgccatgtcctcagtttctagactaggtacaggtctatagtgaatgctcagtaaatacttgttgaattagtgaatgaatgaacaaaaattgtaagaagcatttacctttcacctaacaagctgccattgtaaatggtaagtgtgcaaacctgtgtgtgcacttgggtatgaaggcaggcgtggaagagggattataaatggaggcttgccttcccccggattaggggctgatccatcttctttccttcatgtggctgttatgaagctgaaagagacagtgtgtgttcttggctcagtaagtaccatcctaaaaatacaatattccacaaaactgtttaaaaagactcccaggttagcttaacagtaactagttagcccattgtaattacagtttaagtctcataatagcctttcatgggagcctgctcattgttataacttctttttctgtaatagaaaaatgtagtacagcttccaatctatttataaacctttgcacagttgcacttgtaagttgctggctgcatcgccctgcctctttttacttagataaaagctatgactccacctagtttaactctccatatctagactgtctctcctccatcttctctctccttgtttcataattcagcctcagaataagaattgggttgcagaataaggcttcacaaaataactgaaataagatacaatccaagcctgttatttccttaatttgtgggcagaacagcttgtaaagtttggattgatttttatctgaatattatgaaaacggcttttttttttttttttttttgagatggagtctctctctgtcgcccaggctggagtgcagtggtgcgatctcggctcactgcaagctccgcctgccagattcacgccattctcctgcctcagcctcccgagtagctgggactacaggcgcccaccaccacgcctggctaattttttgtatttttagtagagacggggtttcaccgtgttagccaggatggtctcagtctcctgacctcgtgatccgcctgcctcggcctcccaaagtgctgggattacaggtgtgagctgccgggcccagccaaatggctgttctttagacctatagcagattgcctttttacttggtgttcagaagtacattaagaagaaatgcgacttctggcaatgcaggggtgaggaagaggtgttctacttattttagagatgaggaagctgaaagacagtttgcatagtttccacaaagcccccgagggagggctgaggttgagtcctagagcttggcgctttctgcagcccctcattccttgagctctgggagaaagtcctgatggcccttaagccatgagcacactggtgagtgtgtgagtccctcctgtagctgcttccttacacttagttgtgaatttctgagctggagaaacctgagattttgacacatccaagttacattcatttccttttactctaaatgtttttttccctttcttaaactaatagacagtgatacagttttcttcacagccatctattttaccatgatccatcctgggttttttttttttttttttctgccttgagttttatatcacttttctgtttaagttaagcttgtcactttcttgtttaaataaagttgagtcatgcctaattttctatttttatcaaactggaatttcttagccaagtcatcaaggccctatactaaatcttgagtcataacttcattcctactatgttctaatcagattttccacttgaacctacactgtctgtcctgccaaccctcagcttgctgctttcccaaggatctgcaggcagcactccagtactgttcaaaagctaatgccgctgctgctactctcatttcttacctgtgctgtttttcaacatgctgtaatagtcatctcgataatcttccctgcttgcttctaccattaaacccagtttataaagtatgactcgaattatacttgaagtctgtgctgattaaccccagacatgtggtgacccctaatctagtgctcatgatctccgtacttggatcccattgaaggggtcgtggagagtagcagttaagattctccagctagatgtcctaggttcggttcccacctttgccactcactgcctatgcgacttcaggtgctttagtctactgtgcctcagctttatctgcaaacgggttaaaaaattgtccctggccagagtggtggctcatacctgtaatcccagcattttgggaggcctaggtgggaagatcacttgagcccaggagttcgagaccgagaccaacctgggcaacgcagggagacccctccccccaacccaccctaccaaaaaataaagtaggcaggtgtgatgcatgcttgtggctgcggctactcaaaaggctgaaataggaggatcacttgagcctgggaagtcgagctttcagtgagccgagatggcaccactgctctccagcttgggtgacagagcaaaaccctgtctcaacaacagcaacaaaaaaaagtccctgctacctagggttgttgtgcaaattaagagttgttggccgggcggggtggctcacgcctgttatcccagcactttgggaggccgaggcaggtggatcacgaggtcaggagatcaggaccatcctggctaacatggtgaaaccctgtctctactaaaaaatacaaaaaattagtcaggcgtggtggtgggtgcctgtagtcccagctactcaggaggctgaggcaagagaatggcgtgaacctgggaggtggagcttgcagtgagctgtgatcgtgccactgcactccagcctgggcgacagagcgagactccgtttcaaaaaaaaaaaaaaaaaaaaaggttgttaaatgtaaagcttgtatatgttaagcgcgattgaagtgttaactttgttatatttttatttgctgatggaggtctttatcttggtgacattgtacctataatgctatgtctcattagctcctttactttctgttctccctgggaatactgggtaaagattgatctttggatttcttcctcccctcctgtctcctcgtttccagatagacctggaacacaactaccacttggtttttcctaagagtagggtgggtgtcctccttcatgccagcatccgtgtctcacactagaattccatgccatccctgctcaacagcatgctcctggagtctccagccaactccacctcctggggatgtggaggcagaggtgtgtgcagccgcttggcctcctggtggccatgcttgggattggcatatttcctagtgccccggagaaagcaccctcctgtccatccacaacccccgccacaccctacccccttggctatttcctttatgaactatggcatttgctccagtttccccatttctttgcagcacagatggccctcttcttttaatgggcagaataagtaggaaatggaagaaacagctgccagagcactgaatttatcctagtcctccataatttcttggaagatctgcgagtggggcccaagctgtctgctactgcgtggaaatcatgcttgtaccatacccatcatagttaaaccctgccaagggcatagggcattttaatagcttgaatccctgttgttttgccctcctctgtccccttctccccatgccttttctttgaggtaggtgcgtgtgttctttaagacccttccctcaaaacaatcttggtagcgagaccagctattatcttttttaagttcagtgttccctaaaagaaggatggttagacataagacatttgttagcttctctattatgtcttcctctcaggatgtgtttaggttgaaccatataaaagtgctgatatttagccctttttgacccacaaaaatagtggtttcatgaagttcaacctaacatgtacttactggtttgctttcattttactgcactcaaacccacgggtgcagtctcatcttagttcaccaactctgcaatgggacccagccgggagcagtaagcaattcttcttgccagcagacaaagcagattaattcccttgggttgaatgttatgccggtctcttaaacatcaaaaactgtttgttatgatctaaactgcttctatggagcagatgttgtgtccccgatgcagcagtgacattggaatcatttagtccttttaaggcaagtttgttttatttttcagtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgaaggtaattgactggggccaggaactcctgtgtgtctattcctgctgcttacctgtttccagctaccactgtgagctctgctttatggaccaaacatctccactacttaaatcagagtgctatcaacttgcaggtgctcaataaatgtgtgaggaatgaactggtttgggctgattcccaatttgaggattatccagaaatgcttccttctgccagctcattagagccaaagtgtagtggagtagaaggaggaggggagaaaacagactggaggcaggactgtttcatagatggataattggttggttaggaaatcattaaagtgacttgctaaagagtgagttttggaagttgtcagtggaataattatacctgggtacacccatctctagccaggatgacgtccaagcctaactggatttgctgtcttttaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgagtagggcctctgagaaggccggtagtcagcattgctttggcagtggtgctccttggggcactgtctttaggcctttacgcagtgacagaggaatcacttgtttaatgtactagagccacatgtgtgtagttttctggccacaggttgttgggaatggtttgacctcacatcactgatttttgaaaggcagtgatttcgtctaaatgttctcccagctgttctgagaaacaggatgattccattcagaacatttgtgtcctcttaccccaatttgttgcagcatatttgtcaggctttttaaattatgcacagatctgtcaaatgcaaaaatggtacttggggcacctggggatgattttacttcatggggaaggggtgctcttctcctcccagctccacaacctataatagtataggccggtgcaccccagacttgaacctgcacacacatcacttggaggtcttgtcaaaatgtaaattctggttcagcaggcctggggtggggtccgtgattttgcttttctaccaagctaggaggtgaggtaccagtgttgctggaaaggccacccgttgacaacaaggatttagaagatactttttggattctcaccttccaacctgaaaacttgtttgctagaggttttatctttattgcattaaaaatagttttgtgagaagttctttctccatctttaactgcagagctcggtagctgttaataggttcttgctttaatcaaaatttgaataaagcccttgggtcaaaagtagataaaaaatggcacacctggataaatttgtatttcagataaacaattttctagtataagtattacccacatatttcatgagacatacttatctgaaattcaaacaaaaccctgaatgtcttaggtggtagtttatttgtttttgtttttttgttgttaggtttatttgtttgtttgttttttgctaagtctagcaaccttagagaaaagtcaaggacgttcccaagagtatttctcacagaatacaagcttgttcaaagagaagctgggtgaggtaaggcaggatgaaaccatattcttcaatggaaaagtttgggaacttatggaatcaacagctgatagtgcttactctcagatatcagataatctccttaggcacgatctccaacagcagtagaaattgggagcgggcagtatatactggtaactgtttaagcaagacctcttttcatccctgtgctgaatgtttttcatctccaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccagtatgtataaccagtcttcacatctgtaaaatggggattatgcccatctcacaagatagatacaaggcttaaatgacttacatggcatgtccttagaacagtgcatggaacataaaatgagctctattatgttattactcttattgttaccatgaaatatatcgtgtaagtgagcagaatggctgctatacataagaatatctatatccctacatagtattttcaaataataaaatcaatagcaacattgtccatggggtgggtagggatggtataattatatacagtttttaaccatcctactttctgcaacatggaaaaatagtgattattggaatttatatttatctcaaccttgtttcagctgatgagttcaggctgctttaaaaaaaaaaaaaatcacagaaagaggccaggtgcaatggctcatgcctgtaatcccaccactttgggaggccaaggtgggtggatcacctgaggtcaggagttcaagaccagcctggccaacatggtgaaaacctgtttctactaaaaatacaaaaattagcagggtgtggtggcacgctcctgcgatcccagctacttgggaggctgaggcaggagaatcatctgaacctgggaagtggaggttgcagtgagccgagattgtgccattgtactccagcctgggcgacaaagcaagactccatctcaaaaacaaaaccaaaaaacacagagatgctataatttattataaaactaatgctagatttggagtcaaaagataagaatttatatcctggacttgccatttaatatctatagggaaaggcctcttaatatctgagaatgtattttctcatctttcacatggaactaaaaatgctttttctatattatgtgatcaatgtgtgcgaagcgtgatgtgttctgtgaaagtactacctgcgcacaggatgctgcctccatcacagctgctgttgtgcagcacagcaatccggattgagttgtgcctttcctctgacccctgctgctcctatgctgagagctggcagcctggcaggagatgtagggaagacaaggggaagcagagacctgggctgtgaacaaaatggtcagtgtccggatcactgacctgagcttgactcctagactcagatggtgagagacaaccctttcccttctctggaatccttcagatttactgaagtgcgaggtgttggaagtcgtcacttctgtgaaatgtagaagatggattggtttaaaatttagggtgtagagtcaaaccaatgtgagtttcagttccagctctaccatgtggcagcattgcatcttaggctacttaacctttgtgagcctctgatcacatgatttagtgcccacctcaccaggctgttgtgaggaataaatgaggcagtatgtagagagcactgttggcatggctggcccttagtaacacttattctttgtgtataataacatggacaattgtagtgccttctccctctcagcactgtggctttgcatccactcaggtttttgggatttccttacacattttttcatataaactcaggaggttcccaagggaacacactccaagaattagatgaaaaaaactgcagaaaaatccacctcacatgaaaatctctgtatttaatatttttaaaaaattaccactgtgtttgttgcagctgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaaggtaaggtttccttttttgttgttgggtaaaaatgacatccttttaagtagagttagaatgattcacagaggttactaagggttacctagtgccatgctgtgttatgtgctaggtataaggatgaatagagcagatccttgcccttgagttggaaacagaggcagaaaagagttttagggcagggaacagtgtccctgccaaagtcaggaaatagagcatagtatgtgaagctggtttatagcaatacccaactgtgcgtgccaatcaggaatatacctgtgaacaaggcagactggaattaggagggagagtgatgctgacaagtatttgttacaagtgtgatgagagcagggcactgtgagtctagtttgaagattcagaaaagatgtccccaagaaagtgacattttagctaaaacagatgagaagaatttcatccaaaactaaggtggagcaaagagctagtatctggaaaaaccaaacatcatagaacttgatgtataacctccccctccatgattcccagaacattatacttaatggtgaaagactggatgcttttccctgaagcttaggaacaagacaaggatgtctgctgttgccacttttattcaattcagtactagaatttctagccagggtgattaggcaagaacacaaaataaaagccatctaaattggaaaaggacaaagtaaaattagtctcagatgacattttgtgtagaaaatctcaggaattcactaaaacactattagaactaaagaacaagttcgcaatgttataagatatgcaagatcagtacaccaaattgtatttctctatagtagcaatgagcaaactaaagattaagaaattgtttcaaaaagagataaatttttaaaaagaagtgcagtacttgtacattgcatcccacaaaacatttttggaaaaaaatttaagacccagttaaatgggaagatgttccacattcatggattggaagacttaatactgttaagatgtgaatacttcccaaattgatctattaattcaacataatccctatcagaatctcagctggctctttgaagaaattggcaagctgattctagaatttatatggaaattcaaagaacacagaatagccaaaacaatcttggaaaagaataaagtcagacttgtatttctcaaactcgaaatctagagtaatcaagacagtgtggtcctggcgtaaggatacatgtaaagatcaaaggaacagaagtgggaacccagaaatactcacattaaaagtcaattgctttttcaacaacagtgccgggagtggggagggatagcattaggagatatacctaatgctaaatgacgagttaatgggtgcagctcaccaacatggcacatgtacacatatgtaacaaacctgcacgttgtaaacatgtaccctaaaacttaaagtataataataatagaattctgatggttaaaagacaaaacaaaacaaaaaacacagtgccaaaacaattcaatggagaaagaatagtcttttaaactattgttaactatggtgctgggaccactgagtgaccacatacaaaagaatgaagttgaaccttttacctcacagcatatccaactcaaaatgggccaacagacctaagtgtaagagttaaaacttttagaagaaaacatatgggtaaatttttgtgactttgaatttgctaatggtttcttaggtacgacactaaaagcacaagcaacagcaaaataaactgggtgtcatcaaaattttaacagtttgtgcttcagaggacattattaacaaagtgaaaacacagccatagaatgggagacagtattttaaatcatgtgatatttgttctagagtatacgaagtatcttacaactcaataaaaaaacaagctaactaaaagatgggcaaaagctctgcaaggacctctctccaaaaagatatacagatacccaatgggcatgtgtaaagatgctcagcatcattagtcatcagggaaatgcaaatcaaaaccacaatgagatactactttacatcatgtggtcgagtataatcaaaaaacgggtaataacaagtgttggcgagaacatggaaaattcggaaccctcatacgttgctggtgtgattataaaatgatgtggctactgtgaaaaacaaaatagtggtttctcaaagtgaaacacaaagttaccatttaatggagcaattctactcctttctatatacccaaaagaaatgaaaacatagatccccacaaaaacttattcgtgtatattcatagtggcagtattcataatagccaaaaggtggaagcaacatacatgcccatcagttgatggacaccaaaaaatatattcatatactggaatattattcaaccataaaaaggaatgaagtacggatacatgctgcaacatggatgaactctgaaaaccttaagtgaaggtagtcagtgacaaaggacagcatactgaatggttacaattatgtgaaatatccaaaataggcaaatccacatacatagaaagcatattcatggttgcccagggctaagagataatgagagcatagggcgttaatagctaaagggtacagggttaattttgggggtgatgaaaatgttctgaaattgattgtggtgacggttggataacactgaatagacgaaattgtttaattatgtactttaaacggatgaattgtatggtatgtgaattacttctcaactgaaggccaggcatactggcttatgcctgtaatcccagcactttgggaggctgaggtgggtggatcacctgaggtcaggagttcaagaccagcctggccaacatggtgaaaccctgtctctacaaaataaaacatatatatatatatatatatatacacaaaaaaatttagccaggtgtggtggcatgtgtctgtagtcccagctactcaggaggctgaaacaggagaactgattgaacccaggaggcggaggttgcagtgagccaagattgtgccatcgcattccagcctgtgcaacagagtgagactccgtctcaaaaaataaaaataaatggaagcaaatagtagtagaaacaaaactctaaaaccattctcatcgggtacagtggcttacacctgtaatcccagctactctggaggctgaggtgggaggatcacctgagcccaggagtttgaggccagagttggccacataacaagaccccgtctcaaagtaagcagtggttctcaaattttaatgaccattagcctcacctgtgaagactgattttaaaatgttctaggcatatcatgtcacagaaagacatgcaggaaacttaaaagcatgttgctctgtgaaagcagctagtctgaaaaggctacatacagaatcattctaaccatgacattctggaaaaggttacactatagagacagtaaaaagatcagtggttgccagtggttcaggaggaagaaggagaaggatgcataggtggaacatgggatttttagggcagtgaaactattctgtatgatattgtaatgttggttataggccattatgcgtttgtcagtctatagaactgtccaacaccaagagtgagccctactgcagactatgggcattagttaataatgtgtcagtattgattggggataacaaatgcaccacactaatgcacaatgttgataataggggaaactgcacattttgggtggggggatatgggagctcgtactttctgctccatttttctctaaatgtaaaaccatcctaaaaagcaaggtcttaattattaaaaaatgtttcaagcaagccagaggatgagcttgtgaagtcagggaactctacagatgggaagtggctttgtcagatcaaggggacattttaattctgaaaaccaggtcatgttttcccctagaatgtaagagccacaccaggagaaaaaaaccatcttcctcaattcagccactgtattgaaactgttgagcccagagttagctcctcagtgaggtgaatctgtaagtgatacgcggttctgtgctttgttattggagctgagggctccttaagcctcagcaggctcaataaagaagtgttgcttcagcaatatgacaagattaaggtacaaggactagactcttttctaggatgcgaaagtgacttgtaatgagaatcccgaggtgctttggttttaagaaacttggttgggaatgtaggcattaggtgcccagatattggattgtaaggtagcaaatgaacacatgaaaatgtgagttgattttagaggaacatgtaaattagaaagggaaagattgctgtagtagatttctcaaagagagatttaaacctactggggagaatggtctttacctttaaatgtccaggtcagccctgtgttgggtgtaggcatctgatctgtaaaagcaactgttagtgaaatttcccaggctatggagtcccattcagattctggaaccatttaggaaaaagatgtgtctctgggtatatttttcctagagacataccaaatgagagtaagaaaggatcagagaaagcaaactggcaggtaccaagttgcttgttttctttagaattttatgattttccctcccaccccagtcaaataataatatcaaaggatggtttacttggtgccaagtactgttctaagcaccttacatgaattaactcatttaatccccacaatgacctctacccaatggtggggtgggggtggggttatttgttatcccattttacagatgatgagactgaggtatagaaatgaagtaatttgcctggtcatagtaagtgacctgggtgagctgggactcaaactcaggcactggctccagtacgcacacccttacccctcatggctctgctgttccacagtggcctcatgactgcctcataatttagaccaaactttgaaagaggcaatgtgtgtcttttaaaccctttgtgtttgaaccctacttcatccacacacagcagtactgttcattctacctgaataggagggaaaaaaagaaaaacaaaaaagaaacacccaaaagttttttctttcccctcttggtacacagcagtatcttcctaagaactgctcagtttttccagagggaacgatagttgttggaattcatgtgaaacagcgcagctgtccacacctgatgtgggtgtggtgcgacttcccagggcgaggatgcagaactggggtgtctttcccagtgagtaattggagcctctgtccctcggtgacttctcaaccagcagtgccaccccccaccagttgtttgagctttaagctttaagtgtgagtcagctgttttttgttgttgttggttggttggttgttttgtggggtcataaaacacgatccaaaaatgcttcctgtccttccacttcacgggtccttttggcgagttgaggaggctctgggcagagggctgtgcagtgaagctgaagggactgttcctttaaggaaaaccgctcttccccttgattaaatgagtaaattagttccagatcctctgttaagagagtcaggcagtttaagagggtgagggcgaaatagaaaatgtcttaagaaggatactgtgttctttacttactataataggagaaaagcttacaagtcatagagaatgagtcgtgaaatggttttagaaatgtattttaaaaatgttttgggaagccaagttcagtgaatggggccctgtgctcagaagagccccatgcttggtttaacgctttgctttgaaccatgggctccacattttcattttgcactggggattgcaaattatggaactaatcctgtcagtgacatacattttaaatcagtattgagtaattagggacactttcttctcaattttaggtaggataatatatcctgtccaagtttgcaagtcaacttttgagctgagattttttttttttcttttaatgcctagcagggtggtaagctcttgatgtccatgtgaacacactaatctttgctggaatgtgccatggtgaaattttgatgctggaaagtactgaataagaaggctaagcattagtatttataaatcaaaacatgttgacaattacttcctgctttggtggggtatgccaggcattttgtacagaatcttcctaaaatggagaaatgatgggagatgatcacgttcttgtcttacattgggtcctaatggatgaagacatgaccttgtccttagttataacctattgaggactgactcaggaacctggtctaggctcaagttaactcggcaaccacaaccccagtgcggtgcctctttcctgtcagccaagagatccagaggaacggacctccaaggatgtctgcatgcttcagggagctaggcttatgctgacatagttcatcaggtttaaaaagtgctggaattatttattggtcctttgttttggcaaagattctgttactccagccgacaacattgtggtgaactgaggataaacccatagccctccttattttcagccaataatacgggaatcaataatacgggaatattccactacaagaatgcactgtggtgtttcttataaagtgggatggaaagagtttaccagaaaacaaggctgtctcagccaaggcatcccagctcacagcaggctatgacagggcactggaagagccataacgtgggcagtagggcaggcacgggggagaatgccagacaccctgaaggacttgggagcgagtccagtctatgaggtcagctgcagcagtcagcacttgggatctagattaggagtcactctgggcaagtctccccccatagcagtggggttgtggttgccaagttaacttgagagtatagaccaggttcctgagtcagcatctgttacaatggagaacaacagggtcatgtcctcattgaaggctcagtataagacaagaacctgattctctcctgttgttatttctccattttaatagaagattctgtacaaagtggggtgggagacacgggtcagaaagagtgaaatgatagagaatccaggaggaggtggtaaaatgggtggtactgccagtgtctgcctacagatgccatgatgctggtgtctgtgagtagtgagaactggtgagcaggatgggactcagaggatgctaagctggctatcaagacagggcctcaggcacagaagtatgaggcagaagcctgagttattacaacttagatggatctccctttgtagcagagatggctcaatgtagaacctgacaggcttagctggggctctggaaatcttttgagtctaagattagagttaattctagggactgaggttgagctagaacctcaaataatgatgaacagtggccccactgagaaggcagaaggagtgcagtcagtagagactgggtagacctgccaatggggaattgcctttcaaatatgttctgttgggttttcttaattttctttagcaggattggcagatgtacatgttcctatttccattttacatggcagactcagaagtacacagaagtgccagagttgatagattcattctacctgagcatctgacactccttccaatacctctgtgccattggcttagactagataacttcatgaagttccttcagtgagggttgcagcaaagcggtggaaagcatgagctatggaaccagactgctagacttttattccagctccatccacctcttctgactgtgtaaccctgggcaggttatttggcctctctgtgatgcagcagaagtggagatagtattttcctcaccatgtagttagaaggatgtaatcaggcatcctcctatctgtttagaacaatgcctcacacataaatgctcaatgagcattgactattatgtagaaataaatatatatattttaagacatggtcctgttctgtcacctaggctggagtgcagtggcacaatcatggctcactgcaagcttaagctcctgggctcaagtcatcctcctgcctcaccctctggagtagctgggactacaagcatgggccaccatgctcggctaattttctttcttttcttttccttttctttcttttctttttctttctttctttctctttttctttctctttctttctctttctttctttttctttctctttctttctttctttctttctttctttcccttccttcctttctttctttctttctttctttctttctttctttctttctttctttcttttctttctttctttctctttctttctttctttcttttctttctctcgagataaggtcttggcatattgcccaggctggtcttgaactcctggcttcaaactatcctcctacctcagcctcccaaagtgctgggattacaggcatgagccaccatgctcagccaaaatagatttctctaggggagatttcagtcgttaagtaatcgctacctagtgagtagatggatccttggtaaggctactcctgaagagtaaatactgggaaagtcattcctgtttagtcttagaaatctttaaaaaacaagatttttaaaattaattggatttacctataaaaattgggaattttagtaagagatcaacagatttagaaccaggaagttggagtctgagtctttgctgtgccacttcctgactttgtgagcttgggcaatttttcccatgtctcacttgatttccttatctgtgaaaattacacataatggggaaaacaactcaccacatagaatcatcccaagaatcacaggaaataatagagcaaaagcacttttaaacagatgttttgggcgtttttattccctggatgcaaacctactgaaagcaagtaaaggtactagttgtctatagggtaggcaataggaagccatgctggagtttaaaactgaagtgcagaaaatccaccctagcttcagatatggataatttagtaaggtcttccggtgtgtcacaaaacacagacatgcagtcagttccgaggactcctctatctccgtgacatttgcttaccaatagccagattgtgcttttatttcccctctactcatgcagaggattcagaccccactccggggaatccttgctatgatgggagccacatgtgtgacacaacagcacggtgccatccagggacaggtgtagattacacctgtgagtgcgcatctgggtaccagggagatggacggaactgtgtgggtaagagccatgttctcgtgtctccttcttgtagcccttgtttttcctctgccctccccagccttatgtctgtagaagacaagtatctgtcacctttacaacctccattgtcaatgattttagcagctgttaatctgaatatagttatttaaaaattaaagcatagctgtttatgtttgaaaagatggtttggagtggagtggattttgcaccggggctgtgaaaagaaaacatctgttgcagttcctggatgttttgagttaagttttgtaattttgagcttttgtagtaagtagttcttagacttaccaaaaagcacattttctgattttctttaaattttagacagacattgtgtgtcttatatccccaaaaggcaacggtagaaatttcttgatattaaaaaaaattgttggttttcttccaagtatccattctttttaaaacagttaaagaattcttagaatattcacttaaaaatttatcttcctgtggtgtttacttgaatggcatgaaatttttactatttctgattatctgcaacatgcattcatatctgatttttaaaaattctacatctgccaaccatttgtcccattgaagcatcatactagtgagaaaacattgagtttttagaccctccacttctgggacccttgaattaagcagaatttttctcttctcatttcttcttagatgaaaatgaatgtgcaactggctttcatcgctgtggccccaactctgtatgtatcaacttgcctggaagctacaggtgtgagtgccggagtggttatgagtttgcagatgaccggcatacttgcatctgtgagttccaaaatcattttcctgtgtggccaaaatggtgctctttaatcttgctctttaatctgtcagtgttttgacttctgctattcagaggctctgctatatggttttcttaagaagacagtttacatcaaaataacccaaagctggctggatgtggtggctcacgcctgtaatcatcgctttggaaggctgaggcaggtggatcgcttgagttcagaagttcgagaccagcctgggcaacatagcaaaaccccgtctctacaaacaatacaaaacattagccaggtgtggtggcacacgcctgtagtcccagctactcaggaggctgagataggaggattgcttgagcgcaggaggcagaggttgcagtgaactgacagcatgctagtgcattccagcctaggtaatagagtgagactctgtctcaaaaaaacaaaaaaaaaaacaacaaaatctctcaaagctatggctcagtttcagccctgtttattttcactgtttttccctaaatagatatttttggtgttgagttattgaaggatgcccacctcagttgggatttctggcccagtcatgtaacaagatgatgaacttcactagtaaacacctccagctctttagatagagcctaaagtatttttcaaattagaagagatggatttataattcactgatgcatgtcctacttgactggctaaagagctccttctgtaacaaattacctcttctgtatttccagaaaatactacagacctaaaaatggatcaaaagaactatcccaattcatcccattgataaagatggatgagagtaaagaaaatgcactctttagccaggcatggtggctcacgcctgtaatcccagctactcaggaggctgaggcaggagaatcacttgaaccagggagttggaggttgcagtgagccgagatcacgccactgtactccagcctggcgacagagtgagactccatctcaaaaaaaaaaaaaaaagaaagaaaatgcactctttaattcagtgggatgagggtaaaagtgacaggagaaactgcgtgtgtgtgtgtgtgtgtgtgtgtgtgtgtgtgtagcaattgctctggagtgttataaactttaattgaggactgcttaggtgatgggtttttgtgcttagtattttaacagcaaattcataccagtacttgaactttaatagcatacaaaccatctaggaatcttattaaaatccagattctgaatcactggaccttgggtagggtctgagaacctgcattccctggtctgttgctgttggtctgtggatcatgccatgaggagtgaggctcatcctttgcaggcctaaactctggatgcccttatcttcttctcttttcagtgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactggtgagtaactgcaggtcagcctcaatgactggaaagttgctttggatgcacatccccacatagatggagctctcccagaaaagacaaaggacttcctttgactctaacagccttgtggctgccaaaatagtgagaaaaaagcgtcctttgagttagaaaggggagccaagggtgatttcctctggactagatgggcgagcatatatggcttccttggcggagacgttcctgtagcactcgggagcttctaaccttggttccttggagccagcgcaggctggaggaatttagggaaagttgcataccttcctgttaggcggtctccaccttaattcaacacttatggttgtgctcttctgctttaagtgatattttaagcaatctctaaacacatatgtaatttctaatttttctcctctttcaaaagagagaactccacatatataaaaagacacatatcaaaacttttctcccagaaatctatctttaagacttaatgcagtattttataaaagcaccaaaccatttgcaaggctagccattggaatttaacttagaaagaatgtgtgaggttgttatttaaaggctcgacataactctctgagtataaatgtccatgaaactaggattaggagtactttaaaatagaaatcattaaataaatcttaaatcacaaaaggttttccaaacataccctgtggtatgtgatcagattgaaactcagtttcacgtgagtcacacacacacagttagggtaaaacgacacactggggatgagagaatggtgggaaacgtgtttagaatgggaaagggcctgctggggaacatgaaccttaaaaggcagactttcccctgctcctggtgttgctgtgtgcatctgcctccatccgcccaggcccaccgagctgatgtgctaagaacagctttgcaattcctgggagctttataccagatccgaatagcacgggcctccctcctcctcaccagatgtttgattctcatccttctcccattcctttttcccctttggtttcagcaggatgggctgagtggacagcaggctgaggccatgtgttactgacagaacaaaggtcactgtgacagcagctcagccctccacttctctctggatggggcaagtgcacatggtggtttctgagcctcattcttactctttccacttgtgctgtacagaagctctgctgcatggttttctcgaacaatttatgctgaactaacccaaagccgtggctcagttcagcccttttatttttttctttcactaaatagatacttttggtggtggtattgaaagttgaagctatggcttgaatattcgtcttcttcaaaactcatgttgaaacttacattccactgtggcagtattgagaggtagggcctttaaaaggtgattggatcatgagagctctgcccctatcaatggattaatgggttatcttgggaatggaactagaggcttgataagaagggaggcctgcctaaaataacatgttagcacactcagccccctcaccatgtgatgtcctgcaccacctcagccctctactgagagtcccaaccagcaggaaggccatcaccagatttcaacccttgaccttagacttctcagcctttagaactataagaaataaattcctttcctttagaaatgactcagtttcagatattctattataaacaacaggaaattgactaatacagatggtaaccctcagttgggattcctgtgtgtcttggtattaggcccagtaatgtaagaagactatggacctcttgaataaacacccctagctctagataaagagtatttcccaattagaatgaggtagatttgtaattcacagatgtttgtcccacttaaccagccaggagctccatctgtcatagatatactggtgagaaaacattgagtatatctataatagatacactctttacagataccctctacaggtatggagttcagggtgaggtgccaaagcctgacagtgggaatgatgcttttccttcgtgtggaacacatcgtttgtttggtttaaccctagtaccagctctaagaaatgtgaatccactgagaaaaatcttgtctgtagaatttatttaaacatctggctgctcagatcagcagagatggtgcttttaaaatatttagttccttagctctctggtttaaagcaaagaagttgaaattaatttcagcctagatatgatgagtgttaatcagaatattaatttagattagatgctgcatgctttgatcacttctacaatgattctctccctccttttttcttctacttgtcctgcaagactttgattaccttctggggtcatgttagggctctgaaattgactacttttccatattgggaatttaagtattgtcattttttaatttgccctatttttgtcattttcaattgtccctattttatttctggttctctgcttttaggattctttccaaagcctacaaactaaaaatatgccaaacccatcaggtgcttcccccagtgtattggttatctattgctgtataataaattaccctaaaatgtagcagcttcaagcaatagacatttaatatcagtggtccagggacctgggaatggctcagctgggtcctgtgctttaggatctctcacaaggccacagtcaaagtgtctggtgggtcagtggtctcatctgaaggcttaactggggaaagatccactcgtggttatgggcaggattcggttctttgaggaccattggattgaaagccttggttccttgctggttgttggctgccttcagtttcttgccacttgggcctctctaacactacagcttactttattaatgccagagaaagtctgctagcaagatggaagtcataatcacaaaaatgacatcccttcaatgttgctttattaattaaaagcaagttactgaaagggtggggattacacaagaccatgaataccactaggtagggactgttgggggccatcttagaggctgcctaccacagccacttaccatgtagttgtcttctaaactttcagattgtggagtagtagagaatgaatggtcattttcctaaagacccatgcataaatcaggctaggctaatcatgaaagtaacttgaagaataaatattgaaatatatgtgtatgtgtgcatatttaaaggcattccatagggtacatgtgtctcagtgaccaaagaacagaggctgtattttgtgggtgctatgcattgttaaagcacatgctcttttactccatcaaactaacaataagggggtgtgggagtttttctccagccatagtttgttaaaaaaaccggctccctggagaggctgcacttggatttgggttctcagtctggtctgagtcactagccaggaggcttttatccaagtagagttaaatcctctgcagcttccctcaatctggagtgatttcaaacttgtgttggtgtgagctggatatttctcagacatgtttgtccttttggattgttgtgacttggccaggtgcaaaagcagattgtcttgagttgggaccttcccaggaggagcaagtgtgagttgaggaagctgggttacagatggcccattacccagagccatcattactcaggggcctgagggaagatactgacattattctttcttgggtttcctggcgttttttcttttcttatttttttttaatttttatttatttatttatttttttaggcagggtcttactttatcacccaggctggagggcagtggtgtgattacagctcactgcagcctcagccttccaggctcaagtgatcctcacatctcagcccccccaagtagcatgcccagctaattttggtatctcttgtagagatggggtttcatcatgttgcccaggcttgtctcaaactcctgagctcaatcgatctacccccctcagcctcccaaagtgctgggattacaggcgtcagccaccacacccggcctagcttctctcttctttgataacgaaagcatgatctccattatgtgcctggccaggtttcctgttccaagaatgtaggtagatgttgggtatggtatggtaaaatcagtgtggttataggaggaggcaaggatgaagcttgaaaggaagtagtttattacacttacaggtctggagtgggttcaccacatgccatacaggggtacaatcagcagggtgcccaattgaacagattgtgcagtagagagagagtgggacctgtgggttgaatcctttattgggatctgggatgggtttgaggttaattgatgccaagaaatttcactgggctcaaaggcaagtgggcagtggtgaaggggcgggagcctgggggaactcgaggccaggggttaggtttatcatccaacagttcctgctggttttgctcagtacttgggcagtgagaaggatgttgaagcacgaaagcatgaactcgaaggatttttaacacattttccaaacaggttctttactagcttaatagagtgtaggattgcactgagattaagctacctctcattacctgagtgataaaggggctctacgacttcttgaacgtttttgtctttatagcagtccctacaggcccctgctagtaatgactaagcataagcagtggcctccttctccttctccaataaagttcctcccttgccagggggctgaaagtctttccatgttttctctcttgacatctgatgtcctgtgcatgcccaggtcccgggactctagtctctatcatggtgtgagaggccctccaaggaggagtcaggactgcgaattcagggagtctcaatctttggggcaggaatttctcacttgtgatatcttcagtctctttggggactttctcctccttgttggtcatttctaatagtttctgtctacccagaactttagtatctttgatgatgccaacagtatctgtggggaggaaggctggtctttcagattgagtcagaattcttaggctgaaggttctaagcacaccgttgatttatttggtagctctggggaatcccctctctcttgagttcaaaagtaacaataagaaactgctccatgggctccagaaataggccctgtgtctcaggaattcctgcttcctgtcattgcttggggttcctgttaccattagaagtacttttagcatgcgtattgtgaatagctttaatttcctgcattcggctgaatgttaatttttacaggtttagttttacagccagttttacagcctattccaggtccaaggtattggatggtcaccagttttgcccagctgggcatttgaattgtcctgttgaagaggcagagccaagctcagggataattatgacaacattggttgatttcagggtaactgaggagccaatctggtttgtttctacccttgcagatgaattgatatctgctttcttgcctttataggcgaaatgatggtatccagggaggccaaccactcacctgggtggagactctatgggttgcattgagttcagaatttttgggggaggactcctaggaactgatatatgctgactaaactccccagagacagaagataagcagaatacttaccttctaattataacataagagattcctctctagggaacagaacacctacgcttaatgcccagtgtgtgtacttaatggtattcgagaaagcacattagttattagaggatgacccagtgacagtgtggtctggacaaagggtggtgcaggtaactctagaagaggttccatgtgggtcatgggagcctgggtgaggagctagccctgttcccaacccattcacatcaaatttagggcttcaaatatctgtcttcccatgctgatgtgtctctaccatgggctgcaccgtattgatgcaacacattctcattttctaggtttcacactgatcacaccatcccacattttttttttttctattcacacattttaaagaaacttggttattactatggatggaactactgctttgttttattttcagccaagccttaatcggacctacaccctttgtttatcctccttttactctgaaagacttcctgtctcttaaagtagcttatctcatcccttgggcgttagttttaaccattcaattctcagagctgctttttttctgctggggatgggaggggtgggtgacttgctattgtcggcatatgcggatttcattaaataaaaggaatgtaagttggcttttgtttgaagtgtcaggattttgttgttttgagaaatatgatggtgaaaattaatcctcatggtgctatgtggagagtgtaggggcctgaattgtttgtactgatatgcctggcaaatttagatttccattttgtaagtattatttcaaaaccctagataatatttttttcttatttcttctaaaagtggaaagtaaagaaaatacctggttaatgggggtgtggttctagatagtaagattctaattagtcaagacagaatgtgcttcttagctgaaaaatatttgggcctcatctggctcctttgcatctacagacgaatgttacagggagatggtgccaacaacgaaagaaaaaaaaaccattgttggatatatttgtctttattgcagcattgctgaaaggaagttaatgacttatagtctaaaggttagttcaaaggtaataacttccttgaattcactgtcaatgaaacatgctgtaagatgtgttgtttttttctgtgagcgactacccatttgatttctacactgaacacgtttagtctagtgtgttaactcacatgttccttgattttttttcttcctttctattaagcttacctttaggtgtcagcatttttctgctcatgctcaaaggtcttctgaagctgacacctcactgggtgttgatccacatatccaaagcccatgcagtcgcacagattgtgtgagtgaagtcatagtgttctttgcttctttcttctgtttctgacctctgcagatgtagatgaatgctcagaaaacagatgtcaccctgcagctacctgctacaatactcctggttccttctcctgccgttgtcaacccggatattatggggatggatttcagtgcatacctggtaagtttcagagggccagattaggcacatgaatctcttagctccttcaaggatatttttctatgacagcccactcttgatttagcctggtctggagccttggtggattttccaagctgtggatttttttccttggttacctcctgctgcctagtttactgatagttcactgattcgtaacatttctggaggcctgcgggagacgacccacccatcgtcctacctcatagcccctctggttaactgccctagtgatctgcttgaccttgatgagtgcaatttggatgaagtgttgagatcaagcttattaagcagagccttatgcgccggtagccagggttaagcccgtggcgaccgtgttagaggagcttggctagcttggtgcagtctcgtgagtggtgagtgccgttggcttgcagcttctcagacttaacctgtgggcctcagggcatgaatgagctttggcttgttttctccagagtctcttgggatgttgggcagatgccaccgctatccctcattttccccagatgacaatagggaggggccgggctgctttacacttagagccagctagggacctataggatgaactagaagaactggagagaaatgaggtaaatagtggcaaggtattataaaataagaatctcgggctccaaaatcccagcgcttttccatgccacgctgtgggctggtgaagtggatgggttgcaatgccttctatttctcttttgtgtcttcctctgccttgatcctggaagactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccaggtgagcttaggcctggggctcaagaagcagaatggcactggtggtaggtagatcataattcctgcccagaccacgcaggcacggggccagtcaccatccttcatagcctctttcctcctgagaagacttgaataatagtgcgtacaaatatgcatgtttgtgtcataaggacatagagatatgcaatacatgacacatatgatctgttacacatttgcctcttagacccttgtccagtacaaactgaaagttgagattgtgtatgtaggtcagactgagaacactaccctagacctgttatagagcagcttagggagatctgacagttagaagatctggccagactggcgttttgaccagaaggaaaactgctttcctatgtaactatctcacttacctctgccttctgaatggcaggaaacagtatgaacgctctgttagtatcaataggaaaaattagaaaaataacacctgctagtggagccagttagttttctctaaactgacaatcccagccctctgtaacccagcccaacatctcagaggaggcacagacatctggtttctgttagcccatacaacctgagaacatgcctgctaccatctagagcattccccagctgggtggggcatggtgatcaagtgctcacagtcgattccaacagcaggcagataaggcaactttctgttccttgttgaattattcagggataggtaaaacttgtttctttaatcattacagaagaactttatttaatgaagagcataggattggcttgataccgttttagccaaaatgattccgacacagcttgctatccaaagatccatttttactattgagaagggttccataaatactagtcttggcttttaatgtgtgaaagtaagaagaactggagaattaccaatagtttttttcccttttaatggtgttaactgttgcccgggtatggtggctcatgcctgtaatcccagcactttgggaggccgaggcgggtggatcacgaggtcaagagattgagaccatcctggccaacatagtgaaaccccgtctctactaaaaatacaaaaattagctgggcgtggtggcacgcacctgtagtcccagctcctcgggaggctgaggcaggagaatcacttgaacccaggaggcagaggttgcagtaggccaagatcatgccactgccctccagcctggcaacagagtgagactctgttttttttgtttttttaaaaaaaggtcaggtcttggcggttctcagataggtaaaaattggtaatggtttgatccatagtcgctctttgtttctatttttaggaaaagattttaaaggtccaaaaaaggtacagagaaattctatttccctcatgccttctctttgaaaatgtcttggttctaactccatctgggatttgaagaaatcaaatggttgggaggtgcctttggggaatggttcagaattcgattaaatttattaagacaggcatgtgttaaggacaatgattttaaagggggaaccaagattttaaaggggggggaaccaagagactgagaagtgaatgacgaaaatagggtcgtgttctcttgtgcggactttttcctgcccacactctctcggcgctggtttggccccaactgctatctctgactggtctcatgtttgatggggtcagcttgagggagggtaaggacgctctgtgcccacaatttcaaaatacttaaacccttgccaaccagaagcacaagagaaagaaattcatggttgggttgaaaagtagcaaatagtaacgaatgaaagggatgcccatgtatgagtgatttgggacacccatttcccaggagttaggcatgtctctttgtttggaatgcagacacatagcacagggtggtcccttaaagcaaaaatggatccttggagttctgaatgtggagcaggggtggaattgggaacttctccaggaaatcctgcagtgtttgaggaagtagcatttccctctctgtgttccttgagacacatttggctgaagaagtcagagtcttaccttctccacggggtcttaaaaagagctttgtctcccatgggtcatgagctacagtgacaacttaacggcattcgcttcccccaattctggtgagtcgtgcagttgagctagagctagttgggtttgagctctgacaacttcattcgcagtcttttgtgttccaagaggaattgtaggtgctggaacctgatcataatgctcccagctttgttctttagagtcactggagggttttgaacggagtgacatgaaatgcctttatgtttaaaatgggccattctggctgctgctaattgaatttacactggttttggagagagtgagggcatagaagggtggaagcaggaaaaccagtgggaaggctgttgcagaaattgcagggagaggatgaggctttttgaccagggtgagggggtgcagtagtgagaagtaaagatattctaagtggattctgaagttacccctaaaaagagtttttgacatatcaaatgtggatggtgagagaaaggagggtcaaggataattaggtctgagcagtggaaaaatggaggtgccatttactcatatgggaaagaccaggggagcagctggtttgatggtgaaggcaggggctcagtttctattagtttctgatttctattatacatctaaatggtggtagcaagtagggttattggctatgtgattctgcagaccatgtgctttaagttgcaggaattaaaaaggaaggagaagcacctcctcttgtttaagttcctttgggtagtcctaacataaatgaacaagttatctcaataaccttctgcagcagagtcttctcagaacaacctgtattttggacaaagcctcaatggcactgtggaagcagcctgggaggaaactgctttgcaaccaaagccagcaggacttcaaccatggagtgagctgtgagggaggggacaagaggagaggatgctggagaaagggggggaaagggcaacacggcaggaagctagagcctgcaggaaaagattcagctttgagataatcccaggcgcagggtggctaaagcaattctggaaactgggctgtggaagaaccatttttaagctgtttgccaccacctctgctatgctttactactaattccactcagttttacctttactccatgtagttttccagtgggtagacagagggcaccgtggcgctgggctttcagtaatactttctaagacacacactggccagtcgcaagatggccctctcctcagcagcttcgagcttgaagcttgaagcaagtggggaatgaatacaaattggctttaagcatcacctcggctactgagtccccaaggatcacctgcacaagtgctctgtcagcagaggcgcccgaggtacaggcaggatgggccttgtgggcctctcctggccagaaggagatcatgccccttcccaggctgagtgagctgcactgctgatcttacctcctcttgttctttcttgatgtggctgggccttgatgacagaccctcctggcaagaaagaagcatcacatgatctatttctgattcccatggtggagaagtacttagaacacatttgcttcccaagtttggtgtccacgggcttggctgagacctggacagtaggagaaggaaggccaggaggccaggcatggggtcttgagctacattttgcattctgtccttgactcacaatcaaaggtttttcttcttccctcttccccatctgctcagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtaagcacctggccgcccccgctcccctcagctgtatctaaggcctttgctagggatggtgcctgctgtggtgaagtggggggacatgtggggtcaccaggtctaatgaaagaagtcactatgtgctatgttgatttataatctggtccacacaagatcccaatttgcgtttggtgtctggtttttgtcattagcagcttccataattggaacatctgcaactcggttcagcaggcagttactccccctccccagcccagggtgacaggggacacgtgtcactctggagtcctaaaaggaagctgacacaatgctggctctgttttttttttctcttgaaaaaaaaatctgttctgctttgttctgagggaagtgttttgctgtcttcttccctagtaaatggcagatttacataattgatccttaaaaaaaccctagaaattagaatttcttttgaagaacatctggagcacatctgcgtagggcgaagaacttttgatatttttggaggctctggtatgtggtaaagtaacttttcttcccatctccctgcctgcccttgttccccttcctgctctcccaccctctctcccacaggtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatgtaaagtggatttctcctgtagggggcagggctgcgtggctttcccagtgggagccacctcacaggccctgttgcagtgaggtggactggtgcagggaagtcctggagggtttctgagctgcagcccatcggcatgggcccgatgccaccaccataggaccagggctctctcttgctgggagtcacctgtcactgaccaaggctgtgctctctggttcgttcatggagtttcagataatatggaaagggaactttagagttgtcagcacatggaggctgtatggtgatccaagggaaaatggaccgactcttaccctaagtccccagggttgtatgtcataacatctccatggaaatcctggaaatcaaagtgacaggacaactagtcacaaggtgtgatctctgcggtttgttggggactccaagtggaagtcagttaatgactgtctcaccgttgcagcccttccctttcactttggttctgtccctttgacccacttctttcctaaccttccctgactccatagatgaaaacttgaggagtgtgtgatgctgggagaggagtggatggagccttccccaggggatgtttgatgcttcctgagccagcagcctccctaatgcaaggcaccccattttggggagcgggttttctcaaaaatggaggaaaaaaaagggtggctgtctcgaatggcatcgacacagtggaaaatcatctgattccattgttgaacttcacactccaggcacttgctcatccctgagaaagaatagtacggcattcaagtttacatttacttctgttaatgaacgacacttatttggttccagaaaagcttagaggcagccagtgtttaggaagagatgtgttctttttaagattcgagtttgttgggtcctgtcccctcccccaagaaaactctcacattgttttgtaaaactttctctggaagaggtagagactaagaagttgacatcactttaagctaaccctcttttattcaagtcatagagcttgattgcctttctgaacatgcccctgaccaggacagggtggtgatggtagtggtagtggaactgaaagaaatgggacgtgggttatttgcacattttaaggaaatttacttaaactgggactttttctctaacctgaggttatgacatgggtttatgaatcccatgattcccgggttaatggaagctcatttgaatgtgtactcttgcctgggacaaacgacttttcaattttcaaataaaagtgtagttgaccttaggcccgccccccatataagctgcctgtttttccactgaagccaaatcccgttttgtacaatctttcttggctgactacgctcccagggggcgtaagtgaagccaagccccaggaggctgttaggcaaggcaggaacttgtatgacctcagggacagccagctaacccctgaatgttggctttgcacatctgctgggcttctcagagcaggagcctggattggaaactgaatgaagcaagttctgcatggagttgaggaaaaatatcagactcagcattttttttatttttattatttttttaaaagacttgtcatttatttagcaatgaggaggagagacctcactagccagaggttggataaccactactccctagttccttaacccaataaattagattttttccttcttttgagacagggtgtagctctgtgttgcccaggctgcagtgcagtggcaccatctcggcttggtgcagccttgacttcctgggctcaagcgatcctcccaactcggtctcctgagtagctgggactacaggtgcgtgccaccatgcccagttcatttattttttgttttttagacggggtctcactatgttgctcagtctcgaactcctgggctcaagcaatcctcctgctttggcctcccaacggacagggattacaggcgtgagtcactgtgcctgactacactttctttagtacaggatataaccaacatcttgcctcctaagagtcaggggcaggagtataggtgattgtacttcaggtagaggaaagatctcattcacagaggaggggagagtagattttgttggcatatagtggcaaattttattaaggctctgggaaaagtgctgatgacattgggaaaagattcagtttttacccagtaaaatattaaaaacttattttgcttaaggccatgtcctctaattactgaaggggctgatttttttttttttttaaatcatcagtcataatagcacctattgaagggcttactgtatgccaattactgattaggacactttacaagcacttatagtattaatttttatagcaaccatatgaggcaggtacactattggcctcattttgcaaatgagacaaacgcatagaggttaaatgcccaaagccacatggctactaagtggctgagcctagatttcacccgagtgcccacatgtccagctactctgctctgttgcctgcaggatcacagtgcagtgttgctcactgcagctgtgcatgagcaaggcagctgagtgtgaacaaaggggaaatgtaacctaattcttctaattctatgatttgatgcacaaagggctccataatcgtgggaattgattacgactgccgggagaggatggtgtactggacagatgttgctggacggacaatcagccgtgctggtctggaactgggagcagagcctgagacgatcgtgaattcaggtcagcagcttcactcagcagtctgcatttcatttgattctacaaagtcacttgtctactttacgccgaagtctcccctcgatttttctccattaggggaggttaagttctaggcaagtcattttattgagctgtataagactagccccctctgtaagcaaacaccttcatacatacggaatgaaataggtgattcctactgtgcgcacttcttaaaagaattcatggtaagaattcagggtgacgccttcgtttattcagcctggctctggcactgtggatgccggttgtcatcaaactggtaggtctgctggtctagaagctagaggtagtggaatatgtaacaaaagtacttgtttctctattaacctggttcttggggacttggagacacttgggctttgctttcccctgctgacccccctgcccacccgaccgttggagggcttcaggtttgccctccatatcctgcaaacactccagtcctgactttgctttatttccaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgagggtcagctgggcttccctaattcttctcttacctgtagatcctgatgtgaagcccttgggttttaaatacaatgtggggaaggtcagaacaagagagtgaaagctcaaatgcattcatgtaacaaagatttactgaggatctaagaggtgtcaggacctgttctaggaaaagacaaggtctgttctttcatggcacttatattttattaggaggaaacaagactggtataaacaatattagtctgtgatgtgatatgtagaaaattcagatagtgttgtgagaactagggctactctgaatcaaatgatcaggcgaggcctcagctgacacttaaactggaagtgaagtgggattcctccagcagcacatttagaaaccagggttgacgctcacagtagggctgacctacatcaagtgacattagccaaagctcagacacctctggcttcagtgttgctgtagcagaaatcaagataaacattttccctgtctgtataattgctaaggtcatcaaatgtgacatacaggatttgttcactgtctcagtacttgttacaatcagggagaatttttatatcttgagaaactcttgccatgtttaagtggagtttctacgaaatgaaattcccagatgcccttcaaatcagtaaagaaaaccttcagctttaattttcaggtaagtgctttttgactatgaaatacttagtgcagtgcctcaaaggtggtttcaaactttgggttctacacacaggaaaagtacctgtatccttctctattccagttgacttaacaggaattaatagccctcttaaaaactctttgcataggcttgcctttctgacatttggacatttggaaggtccttttttcttttttttttcttttttttgagacaaggtcttgctttgttgccgaggctggggtgcagtggcacagtctcggctgactacaacctccatctcccgggttcaagcaattctcctgcctcagcctcccaagtagctgggactacaggcatgtgccaccatgcccagctaatttttgtatttttagtcgagacagggtttcgccattttggtctccaactcctgaccctgggtgatccacctgccttggcctcccaaagtgctgggattataggtatgagccactgcgcccggccccttattccttcttggtgcttgacctgaaaactggggagagctgccatcttgtaggcaatgaaactttggccatgtctctggagtctggggaaaaagcatacttttaagctgaaatccacatcacagccatgagtttaaatatgaaagtagaactttcttatccagacagcaaatataaatgctaaaggacttgaatttttaataaaaagaaaacccaccttgaaccaggttgcaatataacacatgtaattacatctccttcaactgcgtaacagaatggttgtcaagccttcctgcatatttctcatttgctttctatagatttcacctttacaactttcttcctctggcaatccccaaataatttacaccaaatatctgtgtgagcttgtttcagacttattgttgttgatgatattaaatcattttggggaggagactgatcagaagcgatgaagcaatgatatgcatgctgtaccctctggccacctccaccttagcgcaaagtggaaactgctttctagcttttgctctcagcttctctctgcttcatctgttgggcataagggatgaaattcgcaacaggggaaacctatggtttcttcctctcctctcactgaggttctctgtagcccaactgatttattcaaagcttctatagcttttataaaatagtattttataaaaagtgctttcaacattatttctgctctaacgataaacctgtttgtttccttataacctatttccacttaataggaccatatttcctcgttagtatctgttatgaatatatttcatttttaacgtggcatttaaaaggtaaagtgcttaacttaaaatgtttccatccctgggtgccaggtaccccttcaagtaccaaattgtatttttggcagaagaaagaacagtttccttctcaaatccctggtccacatctcttcaagttccatagtttgtatcgaagccattcctaacagctgtatttgtttctattctaaaacccaagatccaattcaagacttcaacaaacggagggttttggggcagttgagtcaaggggtatcttggaggcagggattctgatagtaacttagtaatgacttctcccacatagtgacaataatcagaaaaccttgtgatacaggtaaaagtggaatatggctgtgtattagttacctactgctgtgtaagaaattgcccaaaccctcagcagtgtaagataacatttagtctcacagtttctgtgagtcaggaatccaagtgtgtcttcaccgagctccctcaggcatggagtctctcacaaggctgcaatcaggtaatggccaaactgcagtgatcacaaggctcagctcggggaagacacagcccaagcatgctcacatgggctacaggcaagactaatgtctctggccaacagccctcaaggacatcagttccttggcacatgttcccctttacagggtagcttgcaacatggcatccagcttccctcaaagggagcaagagagagcccctaaggcagaaaccagttttttgagaccgaatatcggcagtgatagcctatcacttctgctatactctatgcactagaagaagcaagacactactaatgcagcccaaactcaaggggattgcttaaggctataatacatgaggagatggagatcactgggggctgcttagatgctgcctaccacaggctacatggctattcttttacaatcttgatttttaacttacagcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggtaatactactgatggaatgcaaatagataacctctcatcacagtgaatgtgagcactaacagattttactacaaaatgaaatcccatcacttagatctcctttctttggtctgtaaacttttaagtactagtaaatttaagtactagtaaatgagtcttaaaatgaactttctggggtttgggtggagggaaggatatatcaagcagtaagtttgtactgcttgcctgaccatgagtgcctggcatatttttaacagttaaaagaattagccattgttgaattgacaaacttaagtgaagttattcttatgcggggagagggtcactataacttacctataaacatctgttataatgctaaggacattctttggaaagcattgtagcagggtagcttccttcagtaataacatgggtattagcaacctacatttgtttgcttttatcagcacaactgaaaaaatgctgtgtgtctagttctatactaaagaatatgaaaaagactgttcttgaatttgtaatctaataaaagggcctaatgtacataggtcacttttataacccagttgtttaaaacaagttacatttcttaaaaggatttgaaatttaaatcggctccatgagaaatgtgaaacttggaaattcttgaatggtttagctattgtaaaaatttttaagactgattcctttacattgaaatatgagttatgttaccattttagtcacttttttcctcctacctagaaaatattttaaaaatactaaggattttggttaaaaggttgcctcagtaattatagacatagcttacaaagggcaagtatttacccagatgttataatttataagctaaggcttgaaatcacacaaattataaaaataattatgtttaatgccctactttggcagaaacttaccagatttcagtaaatgcaatcctgtcttccaaaaaaggattgaaagtttgaatctctactaaaaactggagactagtaataggacaggtaattttacagttgctaatctatgactgtaatggaagtaaaatatcctatttccccattctatcactgtgtcactatcactatgtcactatcatttttggcaaagcagctgaaggacctcattttccccctttgttttaaaaggaaccaaaaaactggagtgtacactacctgatggaactggacggcgtgtcattcaaaacaacctcaagtaccccttcagcatcgtaagctatgcagatcacttctaccacacagactggaggaggtgagccccacaaattctggacaagcctgaaaaggccaactgttccagaggacacaccacttgttttaccaaaagtcagtacctgacttgactcattaagccctctgaggcttttgtttcatcacctcctcattggcagataagatccttcaaggatgtttttcatcctttcatgtttttgaaatcatccttttacttcacccagaaatcgaatggtattgctcacatatagcttaaaaagtagcaaagctattggataatgtctcaaaagggagcatattaatctaaatatgttctttagagaataagactacccttgataccatgagctatattacagggcttaagttggcttttgacactgtggacatattgtctgagggaccgaaaaatactatttagactagttctcaaatgaggaactgtggaacattaaagtctaagccctttacaccatgccctacaactctgatttgatagctcatcatgtgattctaacatgcagctagagatgagcaatggatttagagcaatggtcttcaaacttcagtatggctttagcaccagccctgggacagagaaggctgccagaaattttcctctattgcaactgattttctgtggctgactgacttctttatctagtaaatgactgtccctgaattcactcttcctttctgttaccagggatggtgttgtatcagtaaataaacatagtggccagtttactgatgagtatctcccagaacaacgatctcacctctacgggataactgcagtctacccctactgcccaacaggtaaaaagtatgctttaggatgctcctttaaattagcagggtagagaagggatatatatggtatttgattacccctgctgcctgtgacactgccaccattgccttcttcctgccctgagggccagtctttactaccttaaatctacctagtttatacacaaaatgcaaagacttgctgttgcaacttggttacaatatactcacccaccaccctgtcccacccctgctcttctctcacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatg

SEQ ID NO: 36542 - DNA, 125464 bp, Homo sapiens
cagcggcttcctgctttctgcacgtcctcgccgccgcgccgccagtccgtttgtgctagctctggccgtgagccggccgcccgctgccgccggccgccccgcagctgcctgcgccccagccgcgcctcgcggccagcccggctagctcaggtccgctcccggagcccgcgcccctccacgctgccccctgcctgtccccggccatgctgtcccttcagtaccccgacgtgtaccgcgacgagaccgccgtaagtatctctgcctccgcccagagggctcccgggcaaaggtgcccagcctgcctgacccgtggcacccgcagctcctcttcctgtaggccttcgacccccgcgtccctcccctccccctcggcctttgtttgggagaattgggccgggggcgcggggctcctctgcagcgctggggtcccgcgggcggtcactctgctagtgctggcggcggagcctgtgggcagcgccgcccggccgcttcctagaatcaatggggtcaagggcagacgcccgggtagaatgggtgtcttcagggagtgggaagacagacggtgtcactgcttttttgactggcgaagcctcttgcttaaatatggtggtaggagaaagtgtccgctggggtgtgtgtgtgtgtttgtgtgtgtgtgtgtgtgtgtgtgtgtgtgatgtcacatttaaaaacgaaaacaaacttttaaaacttacactttaaagtccttagagttgaagcatattcgttcgattttaaaaggtgtgttgagcgcctaccctgtcccaggtcggatgaggcgcactgggccctggggatgccagagacccggacagaaatggggaaggcggagcagtgaccccatagtgtggccgtgctgatccatgttttcttaaacaagaaaaggagttgagagagggtgagaggaggtcttagaagggagaggggttgacctttttcagaatgagtaagttttgtctagtggcggagttgaccaccatttgcctaagctgcagatgaactcaaggtaactgttgagatccagtaggcggaattctgggcagacaccttttttgtgtaaacgtgaatttgacgacttaggaactggattgcatccacatgttgtggccgtgattctcttactaatagctacatttctcagattacttaaaatataatcagaataagtatgtatttgtgtgatacagttttaatgtttttctgtttactttcccaatttatgccagaaagtgtttactttaaagcacgtgctacattggggtaaagggtgctgacgcttcggagtaaaggacatactgttttaaattaagacttccaagtgacactgatgcattcattcatggtttctttgaccagtggccatctggtaaccatgttttctcagtctgctcagctgcttgcttattaaatttaccctaacagctcaagaagctctattcctgtggtttaaaggttgtttcctttgaatatgggagtaaagtgatcctgctggaatggagaaagaggctggactaaatgaaaagaccagagcgctagttctggttctgtcattcactagttaggtgacttttagcagctcttttacctgttatgggccttttttctcatatgagaaatatttggactgaccatagggcttacttgcttctgcagtaggaatgttgtcattcattcattcattcatgtgacagtctagctctgcagtgttccagactagtaatgggaagccaggtgactctcttggttctggttcttgaggatcagaatataaagaattacccattctgtggtttgataagtgcagttttaagtttgtttttagagttacttgttagtttttcaccactgtgggtgcctaaatcctacagtttgtttatttatgtttgatatttcatgaaaggtttaagtgaggattttatgaagacgtctaaaagattataaacaactcggaagggtatactgtggattttaatacactccagttccttctcattaagcaactcatgctaactctaagcctcgtggccaagggaatgtagctctggcccagtctggatcttgttgtgtggctccttgatagcttacggtggagtatctttttttttgcattaaggttttggttactaagccctaggcttgacttaggtatttgcttaaatggtagcctttgatttctaggatgggtttgtttctccccagcatcagctgggcattgcggtagctctctgtctctttcacttgagcaccttcagccatatgctcagtactctcctgctgaaagctttggagcgttgagaccattttggtggagttctgcctttttgggcagaaatttggaagccatgacacttcttgtgcaataccatcgaccattgcttaagagagttgctatcaggaaattcaggcctgtcacaggggactcacactctgatagaagaggatttagggtgagaggagaacacagaagaggatgggactaatttccatcaggagggggaggcattatgtgaattgagtctggaagttgaccagttgggtaagggacaaaggacattcctgatcctgtgactaaagtaaagccatagctatgcaggcctggattgttgtggaattgcatttgtttgtagggtggcaagaaggcgattctgaccagaccatcaacagatggataaatttgcatggggctggaaagatgagcagggcaggtttgatgggtcctgcctgctgtgtgtacgagtctgcactttatcctgaaggcagtgggtgagttgttgaacagtacaagtaaaatatcgaacaggattaagtagtacagtaccttatcagggctctatttttaaagcttcttgaggagatcaagaatgattagcaaacttaaatcaggtggaagaatttgattcaagggaagtggctataagacacatccacctcatttgtagggtatggtcttagaaaaaattggaggtggaaagttgtggctcctgggattaactctggaattgtcctggagagaatgtttcttgtcctagttaaaaatatctgatcaataacttccatctgctgtagatgatggtgcccggtctgggcagatagggctgcttggtgtaaaattctagatatgcctgaatttagtaacataatccaggaacattttttaagtgtctattctggcccctctgatgagtgtttggggaaaagggtgggctgactgctttagtcccaggtctggttctgaacttgatatggttctgggcatgttacccagccttatccctgctgttgctcctagaagtgcatgattgaaagatgctttacaattcaaaattttctgatttcttaatgctaggaaaagcagattgttattttaagcctattttataaccacttcaaggtgtgtaaaacgtaaaagacttgcagatgagaagaaaagatgaaaagctgttgttcggtggtgacaatctgctaaaatttagagaggtcagaattgaaaattggtaactttatgaagacccatctggagaggctttagtcgggttttatgttccttgctcttgtttttacgtcccttgctcagtcagttgtttaatgaaaatatatacagagtgttctggcttacctgcccatttatccagttgtgcatttccccaggagttctttgacctggcatcagacaaggacagatgtggaaagcccggtgttgtaagggccaaggagattgttctcacccagccagagccacactggaactagagcagcactaggttttctttaggaaatagcccttaccttctggcattgtagaacaaagcaaggagacagattaaaaaattcatctgagatagaggtagtcttcccaacagctttatacaagaagccttaactagaatgttggagtggttcagagacttgattggcaagacattgtcagtgtggtttcattaatggggttaatctttttttttttctgagatgaagtcttgctctgttgcccgggctggagtgcaataggcgttgtctcagctcactgcaacctctgcctcctgggttcaggagactcccctgccttagcctcccgagtagctgggattacagcacctgccaccatgcccggctaatttttaaattttgagtagagacaggatttcagcatgttggccaggctggtcttgaactcctgacctcaagtgatccgcctgcctcagtctcccaaagtgctgggattatggctgtgagccactgcactctgtcctaatggggttaatcttgatggtatcaggtggagagattttgtaatgatttttactgctggataatttcttttggcataatcacttgaggagtggtgaaaactgtttctacttgctccttcaaacgccttcaagtggcttctaaggccaggccttagaagctccagaaagcttccttcagccaggttctacttacactaagcagttttatttcttccaatatcatggtaacctgaatgggtgatgcttttgcaccttctttttgtaaacagtggaaaaaagcatttcataacagtaaataaaaaggaagaaaggcattagttttaaaatgttttgccattgcatttaagtcagctttttgaacttatgtcaattagaatcattatactacatattagtaacttgctttttggcagtttagacataaaagcaaacctgggctatattgcagggagattttctaatcattgggaagctcagcggaacaggagaatgagcacgtgtgtgttagccccctccctgacgtgcccttcttgtgtgcccactgtattgtccactgtattgtgtcattctgtgcttggctgctgacagcacgttttcaagtttctttagcacagtggcaggtctttgttttgtgttgtagggacagagcggtttcctgttctgacctttcatctttctttcctctctagctgaaacattcttttcatgaagggtggcttgacacctttgagaacctgccaactttggttcatgtggtaatttgggcagacacgttgccagtgagccaattagcatttttgtccatccctttcctatttctccattacattaaaaaaataccagttttaattggggttagagagtaattatctaatacctcattttgttttttacaggtacaggattatcatggtcataaaatttgtgacccttacgcctggcttgaagaccccgacagtgaacagactaaggtaatttggtttctaattaaagataaggcagccttagtagctagcaccaaactctaaatgtcagtaactatagcttttcctttctggtgttctcctgtgttttctgccatgggatggtgagtatacctgttgttaccactactttttgtcaaataatttatgggaaaaagacaaaagcatggcttagtcccagagaagatcacctaagtgtttcagataatgtttatggttcatagtgacactgatgagctattttaaatgaaaatatcagaaagaaaactgatttttgccaaaagaaaaaatgaaaacctagatagaaatgatgttaaaggaaaaaattgcctaaatatttttttccaaagaaaaggaaatcttgtatatgaaatgaatattaggtcatgaaaactgaacactgtccttaaattgcttattgatgtcaacacaacaacagtgaaacaaaagctaagtagtgaaggggcaggggggagcattttctgccctaaaaacataaagctttcatattcttttggagaaacagtatttcaaggatcctgctgaagtccattcagtaatgaaggtggccctaagtcctatgtcccacagacatttttccctttttggagtgcctaggacttgtcacttatgtatactttttttttttttttttgtagacagagtcttactctgtcacccaggctgtagggcactggtgcgatcttggctcactgcaacctccgcctcctgggttcaagcaattcttgtacctcagcctcccgagtagctgggattacaggcatgtgccaccacacccggctagtttttgtatttttagtagagacgggggtttcaccatgttggccaggctggtctcgaactcctggcctcaagtgatcctcccgcctcggcctcccaaagtgttgggattacaagtgtgcaccatcgcgcccagcccatttatgtgtactttatgtagttaattaagtttgcttggttgggggaatagtgtttctcaagttcatcttaagttcttggattcttctatttataaccatagtacataatacttagtacatatttgcagtttctgatatgttcagcatcccaaaatttattcgagcttctttagagttgcagggtacgtttcccatttaaaaaaaaaaaaggttaaatggcactctaggtagtttttcaggccagtcttcaaacgcctgtgtcttaactccgcctgtttcttgcagtccctttccaccgtatataccagtgttctctggagacctgaattcagatttgccaggaaagcatcccttcctgatgtagaattgcccatctccccactgggacaaggaaagggatggagtgaagagcttagccagagcatgatggtatatggagaaaagagagaaagtagaggcaggggagtaaaccacatgatcatctctttcttcttcctttagtctcaagcactggctcacctgctttctgctatcctcacctgttctttgtgagtagtgtctctcctttgcccactgcaaagctcttacaacttctttttatcctttgtccctaaagtaagcacactgctattttgagatttcctaatggtttttacttttatctgcaatcctacattctttctctaactcccttcaagaaagacaaagatctcatggatgagaatggttgatatttggggtttaatttttctttccagaagcactgggttatagtagtggatgggcagaaattccaaagtgagaaacacctgagtatctttaggaatggtgaaggctgtagctctgcaggtaagtctgaggggacagagaacaggtgtggggttacctccccacttcatccctgccatagattaccttgattgttcaacactgggctgactgagacagagggattgggtctgggagtggagagtcacatgcacctgcataacctgtactggctagaaagcaccagggaaaggatgaagttcctgtgcatctcttggaaaactgtctctaaggacctgatgatttcttcacctgaagtatcggctataacctggatttctacagcctttgatggtgattgagtgatttagcactgtcaaaatgacccaggttttatctgttagtgaatgtatactttgctgttccttagttgataatgacaggttcgtggatgacaagccacttattagtggatatcaggcttccaattagtggatgaaactgctaattaatgatcttatagtcagcacttgatagaaactaagacattggagtatacactatttttgtggtatacatttcttggatggttaccatgtgccaggcactttaccgggagttctgcattccctgtttcatttaattctcaaattctgaaatatatctttttatttcccccattttacagatgaagaaattgaggtgctgagtgattaaatatgttgtccatggctactcagctagtaagtgtgtagtcaagggtaacccaggtagacgaggtggttatcaattacacattaaaaaataagtaaaagtaaaaagactgggtgtaatactttgcagatgcgagctaaaggaatgtattcatgtctgtgcttgccatgtgcctttgtaggccctcaggtgtgaaccctgggccagcccccactcccatgctgacctgttcttttttaaaatatatatattttttaaattgtaataattcagagtactgtgatcttacatccttctctgacttcatattctaccatggcaatttttcatgttagaaagcaatctttgcagcccagaattttaatagtgatactatttcatcaggcagatgcactatattatgcctaatgacttctgttggaaatgattgttttcaacttttcactattacaaataatgtcccaaatgtcccaaacaagcacttttctagatctccacatttctgacaatgacatgattacttgttgcagtagccttgaaatctcttctccattctcaggtatttgctttttgtcgttgctatcaaatgggttcctttttcattattgatggcatatacaagtgttactgactcttttgttagagacagggtcttgctgttgcccaggctggagtacagccatcttctgggctccagccatcttcctgccttagcctcccaagtagctgggactacaggcgcacaccaccatgcctggctaaactagctactgctaccgattttatatttattttgtacctagttcccttactgaactcaccaaattttcagttatttcccttagatttttagatacataatcatataacatataatcaaatttagtgataattctattttctcttctatcaaactttggttattttatatattttgtacctagtaatttttttgaactcacagatttgaataagttttcagctatttcccttaggttttctagatacataatcatatcatctacaatcaattattattttctcctctaccaaatttcggttcaggtcttattgaattggtcaaagctctgcaaaacatgtaagaatagtagtgagaaagaactttctagcctagtgtttaaattgttattttgaatgatatttgtcatcttgtttaagcattgttattcctacttttagttttggattttgatttctttttaataccaatcagggtaattatatagcttcactaatatattaatattaaaatgtccttgaattcctgtgataaaattccatttttaatctgtttttatgttccttacaactatatttacaagaaaagttggtcaatatcttgttatccaatataataaccactagccacttgtagctcctgaggacctgaaatgtggctagtctgaattgattacatgttgtaagcataaaatacatgctggatttcaaacacttagtttgaaaaaaaaaaaagtaaaataccttaatattttatatggattacataaaaccagtcaggacattagaaacatctgtagctctcttataagatctgaaatagagtttcgatttaatctagtatttaatacaggttggccaatcctgccactgcctagcatttaaggctatatcctttataaaacaaaatcagagaagacttgtaatggaaaattctcaaaaacagagttgaaatgatttgtgtgtagtggattaaataaaatatattattgaaattaatttttttttccttaatgtggctactagaaatttttaaattgtatatgtagcttgcataatgtatctactggacagcgctgctcctctgtttctttacaaaatatctctgttaacatatttcatatcagcgttagatttgcttcagagaatcaactgaattgtgtgttgccttgtacagtctgaagcatttgctataaaatagcaatatgggccttgacagctagaaaagattcatccagattcaactctccctctaccccctgccccgcccctgtttttgagaattttctgttacaagtctgctctggttttgttttataaaggatatagccttaaacgccaggcactgtcagaattagccaacctaaattaaatactagattaaatccaagacctactggtagcatttcagatcttataaaagagctacagatgtttctcacttcttgaatggtttttattggaaatgtaataagcagctttttgttttagaagctctgtaaagattctcctctttacagcaaggtatggctaatacacctttgtgtatatgctaataatgtgaatagaaaatgttcatgctgcttttctgctcttgtgaaaaacccaccataccttttcagtctgggaccaaaatttaactcatcagatccaagatgatagactcactggcatcattaactgcttagagacgcatgagaggtatgcatggaagatgcacaggaaaggcctacgttgccccctctgacacctgaagtatgctgtctgaacaggtcagcatggggccggctgcggtggttcacacctgtaatcctagcactttgggaggccgaggagggtggatcacctgaggtcaggagttcgaggccagcctagccaacatgacaaaaccccatctctactaaaaatacaaaaattagccgtgcatggcggcacatgcctgtaattccagctacttgggtggctgaggcaggagaatcgcttgaacccaggaggcagaggttgcagtgagccaagatcatgtcactgtactccagcctaggtgacagaacgagactctgtctcaaaaaaacaaacaaaaactacatttgtaaaaactggtctgggagacctatatggaaatacaaactaaacgccaaaagtaaggtaaaggaaaagctttgagttagaaatccttcagattcctactaagtataatatgctgtttaagtgcacttaccacagtgtaatttcactggtataaatgggatatcagagtaaccatggtagcgttagcatgaagggccagagaaggaggtttgcagtccctaaaaatgatttgagaccaggcgtgggggctcacgcctgtaatcccagcactttgggaggccaaggtgggcggatcacgaggtcaggagatcgagaccatcctggctaatacagtgaaaccccatctgtactaaaaatacataaaattagcccagcatggtggcgggcacctgtggtcccagggaaggctgaggcaggagaatggcgtgaacccaggaggcagagcttgcagtgagccaagatggtgccactgcactccagcctgggtgacagagccagactccgtctcaaaaaaaaaaaaaaaaaaagatttgaagactagataagtaggtcccaataatcagcccatgtttcccattccgcacacatttccagcttgtcctttgtaacttggagaaggaagtttggtgcagtcttgccgtaccctgttgtttggtaacttgagcctccagtctgtaaataacatgtggttgacttcctaaactttacctttctaaatttccctctggtatgtgtacttgtttcccctggcaaacaaacaagcaaaccccaaaccccacactttgccttagctcttctgaaccaccttcttcctctcagtcggtctcccggtcccttagggcgtgtgccctgttcagatcttactttatcatgggctctctccctctctttccctgcctatccacaagccactttctgcatgcctgttgatatagttgaaactacccttttctttgtactactcccagtaacatctcccattagcataaactattttcttcaagatcagtggtggcccagtggccaaatccagagacttccagaaatcaggctaggcacagtggctcacacatataatctcagcactttgggaggccaagatgggaggattacttgagccctggagtttgagaccagctgagatgacataatgaaaccccgtctctttattttatttatttgtttatttttgagacagtctcattccatcacctaggctggattgcagtggcacgatctcagctcactgcaaccactgcttcctgggttcaagcgattctcgtgcctcagcctcctgagtagctggaattacaggcgcccaccacgatgcccagctaattttttgtatttttagtagagacggggttttgccatatttgtcaggctggtcttgaactcctgacctcaagtgatccacttgaggcctcagccctcagcctcccaaagttctgagattacaggtgtgagccaccgcacccggcctttgtctcttaattaaaaaaaaaaaaaagtgtgtgtgtgtgtgtgtgtgtgtgtataaaaccagagacttagataaatcagcatatattcctcactagggagatgggcctcatgtccagggagaattgtatagttgggatatgcaggcaaggagaatgctcttccttcagccctgcttttttacactgctttcatcatggaggcagcatctctccgatcgctgggggaatgctaaattagcatttattcttcctggcctctttacccatgtggtaccaggtagtctatattgcataatttgctccccttcctgatagtgatactttcttctctttacttttctggcttggttttgcaacccaggggtccaagtagaagtaatattcttgtaatctcagtctccccatcttactccatcttattgtgtcttcacccttttagctgaatgttctagaagttgttactgagttgctgaagaagaaatacacaaaagaaaaatttacacctttcaaggggtagctgccttaactgtaactgattgtcaggtctggctttcacagaactgtcctggagcttgggcacatgagttagctaaatgtagaatatcagtggcatttatctaataacttcttattctccctgagtgccgccctgggcaaaatgagagtaacaacaactccatttccttcacagaccttgagaagagaactctaacaggattggaaaaaagtatttttatttatattcgttccttctgaaaaataagataaaataacaatttgtttcagagaggatgaaaggaatataaatgtagatttcttttctgggacatgtgagttcccactttccattctctcactgactagctggaagtgaccccgttacacctgctgattaagaggctatggcaattagaacagaaatccttcaggattgcaggataagaatcctggaaatgtcaccaccttctccgcctgtctcagtactgtttctttccttggcaggaaagatttaaaccttaaaggacttctgatcatctctaggatatttaaatcctaggatttctatgtaggtattttagtgtcacagagatcagcggagaacaaagtttgtgtaggaaaacgtctgctttcccaggtgcccttcattgtctgtcctgaagtctttttgtttgtttgtttctttgcttgcttgcttttgtttttggtctctggggttaaccttaaaagtgtgtagcatgaggagtttctgttctttctggtgtcaatttcggtgtcggtctagcctaggactgcctggatcatgtgctttccctagcccggatccagaggcagcctctggaagaactggtgctgagctaggcaagcagggactgatctgtctgattgcctttccccatctggccactacgttttcagagccattggggtggaagcttgctcccaggaaattgcagtacgtgaggggttagttaaatgtctctaagccaaaagccagcagttaaagcttactgatggagctgttgatccccagaaattacaggtataaaaggctggttttggtgtacagtgttctttgaaaactttataacaaactggggatatctgtgtggataattccttcattctgtgagttggcaggcatttccgatgttgcttctgttgcaaggcagtgtggaggaatgaagtatttgctggatggtaccagaagtcagaagatacaaattgcagtctttggtcttctgttttcttgttctatgaccgtagcaagctacctgatctagtattcattttcttcatctataaagagttaaagtaatattcattaatttagctcccagttataacaacacccaagtgagaaaatgtatgtaaaaatccatatacagcaaagctccagtcaaacgaagatggtgctgcttgggcattgcaccttccatgtatcagggtacatactttctgactctagtctcctaattgcttagtcagaatgtttgactttaaagactcttatctgtttttatttttatccacaaaactaagtcgattttccttttgaattctagatttttcatgaaaagatacattctgaacattgttttttcattggaactgtgacttgtaagtgtggttttattgttcccaagtgtagtgatgaaactaggccaaagattacttaaaggcagtagccttaaagtagcgtctttttaaattgataccttgtgaaccccactggcagagctggcctgtgagacaccttctacccattcattcatgtcccatatatgggcctggattgagaattactggtgtatgtatccctgctgtagtagacgtgggaaatgtgtttagtaactattttaccacatattatctcagtctctaagacttctaaggtcttaaacgtgttactaccttctgtgggaatgtttagctttattacagtttgtaaacatacttctcagaaattcacaagtgaaatatgtatttagggaacaccttccttctgatctccggatgggataattgtcaaaagtatgaggaagttgctggtactgggctactcctaatcactacgttcccttttctccccacccccaccccccaatctcctttctcttgctttctgtaatacggtttttgatgcaagcggcaaaaactgattctgggcaagttaggcaaatggggcatttatggcaaggatatgaaggcagcttggaatggaccaagggccaggctctgagcaggcaggaatgtcacttttcacccagcattgctatggcttcactgatctccagtcattcagcctgccgtctctttttcaagtgatggtatcccaacagaaggagtcttgattggccaagctgtgggtgtgtgctcgccccttggctgtattgcagcagttaagagaagagatttggtagaagccccagggaccctctttggcttctgtagtggcagcacagctacctgctccacttagaagggagggcgctacggagggagcatggatgctggctaccccaatgccacatgcctgcaggtttcattctctctcttttctccatatgtgcttcatttcctcctacttcttcacctttcctcctctctccttagtttatctaggtgcccactgtgctgagtattgggttaaataagggggatgcggtgtcataagtaagacagatgcctataccagcatggaatttgccttgtagcttgggaggaccagagattgaagatgggcatgccacttgatctctgagctgctagagattggagcagaaaggaggccaagccacatcttgtagcacaagcttgtctagcctgcggcccaccggccacatgtggcccaggatggctttgaatgtggcccaacacaaattcatagactctgaaaacattatgagatttttttttgcgactttttctttttctttctttttctttttctttttttctttttttctttttttttttttagctcatcagctatcattagtattagtgtattttatgtgtggcctgtgacaattcttcttccagtgtggcccagggaagccaaaagactggacactgctgttgtagaggcgaagactccagccccattggttcactatcagggaaagctccattttagaaaagcacactgtaaatcattgatgaattgtttcaagtacttgtatacatttaatgttactgttttctctgtaagcagttactcagctttggtttcagtcatctgcagtttttcagtgaaaaatgctggcatcagatacggtatttttgggaaaacagcagttaaaaagtgaacatctaaagaactgcgataactgatttctctcaacttcttttttattttgttttttttttgagatggaggcttgctctgtcacccaggccgcagtgcagtggcagatctccactgcaacctccacccggcaagttcaagcaattctcatgtctcagcctcctgagtagcatgagtaggtgggactacaggcatccgcctccacacctggctaatttttgtatttttagtagagacggggtttcaccatgttggccaagctggtcttaaactcttgacctcaagtgatccgcccaccttggcctcccaaagtgttgggattacaggcatgaaacaccgcacccggccttagcttctttttttcccccaccatgtttaggtgcctaattcaccatcccattctgccatgttcaggggagaaagtgcttagccataaaaatcactggggcacttgttaaaaatacaaatgctgaagcttcagtctggagcattggatttcagtataaatctgttttccaagacccctattcctcaccctcaggtaattcttcagacccagaaagtttgggaaaactgccctagggaatacttagattacttgattaaagaacaattataatacctttcattttttttagggcctattcataagcagctaagttctaatagatgcctcactgttgtttatagcatctttgtaaattagtgttaatggttccaatttttttcattgggggaaatcaaggcatgtgacaaaatttctgggactcttccagatcctctgaccatttgaatcagctcttcatttaatcatatacatgactctctggagctccagttgtacctccataaaatctcatgactttctacttgcgctcttgtctgtgccaacacctccctgggtctctcatacattgccactgagctagatgttcagtaacttcctaacttgtctcttttcttccagacttttctttttactctgctccctctagcaactaatgagaacccttagcaatgttggaacctctgcctgttcataggaaggcagtgcgtatagttgttaaatgagcaactttagaggtagaaaggcaggattgaatcttagctccacaattttattagacattggtcatgttggtttttttctttctttctttgagatggagtcttgctctgtcaccaggctggagtgcaatggtgctatctcggctcactgcaatctctgactccctggttcaggcaattctcctgcctcagcctcccgagtagctgggattacaggcatgcgccaccacgcccagctaatctttgtatttttagtagaggtggggtttcaccatgttggccaggctggtctcgatctcctgacctcgtgatctgcctgccttggcctcctaaagtgctgggattacagatgtgagccaccacacccagtctgacaattggtcgtgttttttagcctcatttttctgacttgtaatttggagaaaaccacctcatataattgttaacattaaatgatagtgtttttgagccatttagcaaagtagcaggcacatagtaagtgcttaataaatgctcaccattgcactcattattgagccatttaaataatatggaaattatggtttttgataatttgaaaaacttcatccttagagttatctgggacaagttcttttattgcaattaattcttgggttttttccccccattttgtttcacagtcattgctctgttcagttctgctttctttttggatcaattttagtcctttgtatttcttagtaaattattcatttcattgagatttaaaaattactagcatgaagttatgtgtaatatgctttttaaatgactttattctcccaatccgtggttatatttgtttataatttctaaatttgagtatctgtagcatcatctttgcttgattagtttagccagagctttggctaaatgtgctttttttctttttttttttttttttttaaagcagatctaggaagtctaagtttcatgcttaaaagcttctagttcattgatttcttattttctcttgttattttaaaattttttattttaatgcttaaagtttattctttctcataaaacacctttattgtagagaacttgctcagtcatccccagccagccctggagcaagcttctggtcagctctcctctttccagcctgctcatggtcatccagtctcatctcgttcagaaaaccagaggcttccaaggaaagctgtgttaggacactttattactggtacctgaatcccaactcagaccagctcacataaaaagaggagctgagtggctcacgttattggggttcagggtataagtgcctttaggcacagtctgatccaggagtgcatgtggtatttttgggaacctgtctttttctcttaggtcatctgcttttctctgataattttatttttccagcagccactcctgtgtggcagagaaagatgggtcttgtctctttgggtttctcacagtccttgtagccccaagtgtcttaagttgagataacttctcccttcaaatactcatctctgtccctaaaaaaggattctgattgttttgcctgggtttactactattactattttgttgactattgcctgtgggttagaattgatggaaagactttgcttatgaaaatgaacagggtttacttatataaacaacgtggaagggagttagcatagttagaatacagacagaggtgtctgtcacattatctatgacagatggaggtacaagcgagcggtaccaagaatcctcactgagaatgctcaattgcagatgatacgatctgatggagaaagagggtaaacctcaaactttctgaaggtataactgtcaccgttccagccagatgttcctcatcagtcacagtgtgatcactgcccttcggtacctggcataaccaagcatgagcactcagtctcccaagcctgcttcctgtacactcctgaattcagtagtgcaggactggaagaggctggctccctgatgggtgagtcatgccagcaagccctgagatgagccgcagcctcacctgcttgaggtcctgcccagccgtggtctgggggagggacattctgattggccagcagcggtcacaccctttccccaactatcagtgggacttcatatggcaccagaaagaaatagatgtcaactccaacagtgtttgccacatcccatgaaacttaatgtgtgatagtcttgtttttcttatttcttcgtattttctaagtaatcttgttacagtttggatttcctcattgatacagaattattcaggagagggaggatatgagtgtgtttaatgtcctcacgatcagatatttagttaggtttggatttgaggtgcaaatcacctcttcaccaggtttttggtcaggaaagtatacaccaaagaatggagcctaatggggttaaaatttcagttttccctggtcatgacgagtattgagaacaaggcttgaatatcaggtcggagtgacggtttctgcttcctccctaattgatagtaactagtcccagtgagggaacgagttgatttacccacacggggacaagcagagaggtggaaagaggcctgacaggcttctagaaggctccgcctagtctgctgatcatgtgcagcaggaagcttactatgagcccttttcacccaagagcagatggtcccagagagaagagatgggcccactctgggttttttatgttaaagttgagcccaaaagattttgggctctcactgattgaactagaatatttctccaccttgagaatgagtagggggttgcttgtgggccaggaaaagaaagcacttcatgtggtgaggttaatggcattgtggtcaaaactgtgacctgaacaagcttttctttctggggcttaagattccccctttgttgtctgatgggctgctgatttttgtaaatattgagtaagtcctggaaaattacgagcactcttttttttttttttttaatggtagagattccttggcatagatattagccttggaaagtacattattccaatcttttattgtttccatttctggacgtgtttcctgaaaagcagctgcatctaattctcttttgtgcatgacctaccttgactgtcctgccctcctggccctaagtcctacagcctcagggtgagcgcctcttggctgctttttgatggggctgtccctgtacttggagagtcatttccaaattccaaattctgctaaagtgagaggggatccaagtgtgccgcccatgcctttcacttaggctgggattatggtttttgccactttctccagaagcccctgatagttgcttaaccaagtcctatatctgttatttgtaacagatgctcctcaaagcctgtgggatgtagatagcaccactcttagttttcattggtatttcagaagaggggaggttgatacccgggcctgagccagtctctacctggaagtccctcctggtcgtcttgcctgcctgccaatggcacttgccccagcccaccctgccctgccctggaagtagcttcccctttatttgttctcctctagcacatatctttatctttcattcatcttgttaatcaccatggtgcacattgtagtgttttgtataaatatttatttaatgagtaattctaggcataatttttattcatttatgtaagaattgtaaaaagatgagttttttttaagtgaacagtatttttaatttacacttccatttagaaagggaaaagttaaggcaatcagtaagtgagcctgtatctgtatttcgtaagtcaatttttcaaattgacaggtgaaaattgtatatatttaggtgtgtagcacgtcattttgatatatgtagaaattgtgaaatggctaaatcaagctatttaacatatgtgtaattacctcacatactttgtgtgtgtgtgtgtgtgtgtgtgtgtgtgtgtgtgtgtgtgttgagaacgcttaaaatccctcttagcaattttcaggcagttaccatgttgtacaatagatctcttgaacttatttctcctgtctaactgaaactctgtgtccttttaccaacatctcccccaacccccgcctctggtaaacaccattttactgcttctgtgagtttgactcctttaaataaaacatataagtgagagcatgaggtattcatctttccgtgcctggcttatttcgtaggactgcagtattttgtgtattaaaatagagtacatgagggcactttgaaaaaaattttctgaagacattaggagtaaaggaatctcagctcccaaattaagccacccctttccaaatagcttttctttttcttttttaaattgcagtacgaacacttcacatgacagctacccttgtaacagatttttctgtgcacaatatagtattgctaactataggtacagtgttgtacagcagatctctagaacttaatgatcttgcataactgaagctttgctttgcttttaagctttctaatagtcaaggcacatgagatataagtaagatttcttagttttgagcagctactctttgctaggaaaatgtgttcagattcatctatggatataaaatctaaactgttgactctctttagaagctcagctgcgtgcatcagggctttcatatttcagttattttaatacatcctagaatgagactgcgggtactgaaactccttgaacaacaaggaatttgtgttttcctcaccctgcttccttatcaccatgtaacacttccattttctttttctttatttttattctttttctcccttttccccaatttttttttctaatatttagatcaaccaagatgatatacctgttaaatacataaatgaccaagaaggcatttccctggttaaaatatcagaaatattattggcatttatgtaaccctaaatttaacaaagcttctttacagaaattttctaccaccttcgtgaaaaggatttgcccgagttataaagatgtgtgttatgaaaaaacttgagacttttaggaatttggacactctggttttacatctagatatttgacttggaagagtgcagtctttaatggtctatttaaagtaattagctaacatttgtgggtaggaggtgacaaaattggatgtactaatcctagaattatttggtagcatttttatgcctggcataacagttttatgaaaactttatatgtgaaaagccagtgtgtctgcttcagggtgagatgaattatgttgcagtagttgtaattataccatgagacatgtgaaagaagcaaagcaaaatagagaaacagctggagaacacaattctgcttttccaaggaaaatgaactgagcaatctgttgagcagcctctgacccttggacccaccgtgggcctaagtgcagcctcatgcaaatcagaaggatcagggaaatgacatcttcagggtaccctccttagagaatccctccgtggaagtgcaggagccagccaagaccctcagcatgctggggtcttgtgtggaatccttcttagggctctgactagaatgttctggtgaggccctctgggaaatagccaaaactgcaaactaacatgtgctgtgcccattttctctgtttccactcccattataatggttgttcctgccccttttagagaccagccattcctcttggccttgtctctcacccgaaccactgtcccagcctcctaactggcctgtctgtctccacttttgctcccctatagtctgttctctgtccaaagcacggtaatctttcaaaaagtaaatctccttacccaatcatggcttatttgcacttcgatgagagatcgaaacatcatatctgcctaccaggtgccgcctgctgtagctcatgtctggtcgtctggcctcagctcattcccagcctcactcacctccttactcttcttcacacctgccaagttattccccctgccaggactcccacacctgctgtttcctctgcccaaaacattctgccccaccttgcatggttgctccctctcagtcctcaatttgaaacctcctcagaagggcttttgtgaccaccctgcttaattaggtgccctctttcccagtgattttcaagatctgcaaggaatggctggtttgtaaatttccaaaccatttgtggattgaggtttttccaaactataatgaagatgccatagtaatgtcaaattgccataaaggttttcagcactcactcttgttttctgcactcttctcattgtgggctggtagcaaacagttcaggccaacactgatctgtagttgacactttgggtatcaagcagcattgctctgctgattaccctgtgtatgtccttagaaccaaccattctgcaaccctctggctttttgtgggtgtgtccccagtagcatgagctccgtgatgacagggattttagcttggacttgtcacttatccatccacaatgccacgatcagtgtaaacacacacacaagatttgtgtttagtccacgtggatgcttcagctccctgatgttcctacccagcacagcccagttcatgcagaagaaaatcataggaggcccaggttgcgtcttccttctttcctgggtggatctgcttcatctccacatcctttttcagtctctgagtgattttgctaactcactgcatgaccttaaccaggggactttaataccacttgcctccatctccatatctgtgaagtaggcatggtgttttcttccactgtaaaatgaagtagtgcttttggacacacttggtgatctccaaaatgctcccctgggtggtttctcagataggcattgattttataactaaaaagcaaaatccaatttcctccttgatgtttttaatgagggaaagtgcagtcagcaaacttcctgtaaagggccacatagtaaatattttaaatgttgcaagccacataagtctctgttggtttttcccctctagctctttgaaaatacaaaaaccattctgatctccagagccacaggaaagcgggccagggcgaagattgccaatccctagtgatagttggaattgtatttctgtgggactcagtaaattttattttctgtttaaatgaaatcagaaatgtgacctgtaacagttttatttttcttgaactggtcctcttgcaaaaatgttaattactgtattcatactttacatcccttgtctcttgtttttaaatgcattgtaatcaatgagctttggaacagtttgtctcaccacaaaatcatggttctgcagagtgggattggtggtttttgtaggggaacccaaagcattgttgcacatttgaagaccattgtgagcttggatgggcccttagagtttgatgatatatccaaaagtgaactctgataataatgcatttttccctgccattcaaagtatattatggtcttaatttcctgaagtttttccctgatgatttacttatttatagacatctgatgaaatcttctattgaatttaaagctgatacaatgttcttgtttcatttcttgctaatagccagatgtgaattactagtagccaagtttttatggtattgtcaactttttaactggttagttacaaatagggtgtgcttggatacaactcatcttttgtaaaagccccttttcctgccttcactaccagtatttcctgatggccatctcttgcctttcttataaaccatgttgctgatattcttctgcaatgccacttgtttcaggtgttttttgtttttgtgtgtgttttaagacagtctccctgtgtcgcccaggctggagtgcagtggcacgatcttggctcactgcaacctctgcctcccggattcaagcgatttttgtgcctcagccaccctgagtagctggaattacaggcacccaccaccacgcctgacaaatttttgtatttttagtagagacagggtttcgccatgctggccagggtggtctcgatcttctggcctcaagtgatccacccgcctcagccttccaaagttctgggattacaggcatgagtcactgcacctggcctccaatgttttttcaatgttctttggttgcaaattttagcaaagttctctgattgaaattaacatggtagtaggtcttacaaagccaaaatcgataaaatagcgcctgggtatccctaactttctctctttgactctgacttctcttgggatggccaggtgctgaataagaatcccggaaccatggcactgcgtaaatgcagattattggcagtgtgtgatctgagctacagtatagtgtgtttgttaggagcgtggatctgggagccaactctgccatctgccacttcctagctgtatgatgtcgggcaactttttaaccactccaaacctcagtttcccaatctgtaaagttggcctaataaaaggaccttctccataggattattgtgagttctaaataagttaatacttgccctgtaagcattagctgagttagtaccatgtaagcattggttgttactacatattaatcagtcacttggcaggagctgggcaggtatgaagaagagtaaggaggtgagagaggctggtaatgagagagaagaggcactggctaagagacaaagtgtgctttttctgatacatattagtggataatatttcacatggaaaattttatatttaacttgctttgtccattttaatttctccacaggcctttgtggaggcccagaataagattactgtgccatttcttgagcagtgtcccatcagaggtttatacaaagagagaatgactgaactatatgattatcccaagtatagttgccacttcaagaaaggaaaacggtgagactgcttttactgaatttcctttttattttcaaagtaaatgctttcttaaattgtaaaatacaaattccagataacttgtccttgtataagattaattcattataaggaattaatttctatgcctgaatatgagagtaatatttttgatctattaggtattgtccaaattgttaaaataatagttaagaaatttagtagggataggtcatataaagaaatctagattataggaaatcgtcgtcttatcggtagtaattggtgagataggatgattcatagacagcagtggaggtttgtttgcctccgaagttaattatctttgatgtatactacttggaaacatttaattctgtgtttttcttctgtcaaagaatggtgaaatgggtgaattcacttctcttgttcctgtcccgttaacacccacttacagatgttttcttgatcttttattaaatctctttggagccactatcacacatttactttagactttcttcagccctctgccattcttacagagatcggcaacgtacagtctgcctaccaaaccctggctgcctacctatttttataaataaggtctgattgggacacagccatgcttatcggtttacgtattgtccatagctgcttttgtgctgcagctacaggcctgagtattatagtgacagactgtatggctcacagagcttgaaatatttgcagtcttgccctttacagagaaagtgtactgaccttccaccctagcagccttgctagggaaaagaaccagaattttattttagaaaagtctgctttcttcttcatttaaaagaaaaagttactgctttatttgaatatcaatttttattttaacacataaaatggtctttatttgcctctactcggctaatgtgcaggattacaatacaggatttgaatatggaagcaattctgttaacaagctctaggtagagagaaatgatggaacctttcacccatgtccccacgtccctgcgatggccagattacagtggtacctttttaggtctttggttttgttttggtttttgcttgtgtgtgtttggttttactccacaaatagaaaactccacagctgaataaagaccatctctgttccccaggtatttttatttttacaatacaggtttgcagaaccagcgagtattatatgtacaggattccttagagggtgaggccagagtgttcctggaccccaacatactgtctgacgatggcacagtggcactccgaggtaagtgctacacagagaggcccgtggaactcctaagaccctcacttggagctctgaagttagtgcagttgctttacctctgaaatgccaggcagggtgtggaccatattgtggaacagatgcacatacaatatcaggaaagctaatttttgcacagtatatttagaatacatgaatagtcacattcctcttttccactctgatggcatgaagcagaactggaaaataattaacactggacccaaattagcttctagggcttctggaatcttgacatatcatcatcatttcctccaacatccctgagacctacctgtgattagaaaaaaataagtcgtcttctataagaagtttaagctgtacaaagattattccaactataatattaaacaggaaagaatgtttatcagatcagtttccctcttgggaaggaggcgattagagttttaaaaatctagttaattgtcaacatgttagaattacaagtaaaaacacacaaatcttgtagaaattgaacagctgggtatcctgttccctgaagatggaggtttaaagactaagtttgtccacagttgctgtacatctcctacttaactctgcccctaagataacctcctccgtaggccatagagaagattatccaaggtttctgcagtaagcagagttctagggtaaggaactaagttattctccagttctgtattttaataattgtaaactctacaatgataatgatgttatagatgacgttggctcagcatttctcctgtagtaccttctggttttatagaaaaaaccatatgattagttatggccctctagaattgagaaattgagacattgaagtcctctgtaatcaataagatgggagttatagagccccgttccatcagacctgtgcaaagacccttttttatacaaacacttctaaccatgatccagtcattcggtggtccaccttcccctccctctgaataggctgtgtatataaacaatgatcctttatcgaaccagtatcgaaaataagacatcaccagctcagattcttccatgaatctgagcttgtagttttcagtgaatttaatacactggttctgttgaagtaacatatcccatataggaattcatttagtttccacaaggatctatcttgcagcccatccagagggacagggtcttaactcccaccccgataatgcattcttctagtgacttctttatggaatgtttgctatggacaaagccttgatgggcgagaagctaaattaggcatgagacctgcctcaaacagtcattgagttttctaagagtggtattatagggaagttatcacaaaaggagtaaacattcagattatttttgtagtatatgatttttaaacatacttttcaaatcaaaatgttttatttaaatttttctgaaaattttctgatatatatatatatatatatatatatatatatatatatatatatatatatatatatatataaacaattcaaacactccagtgctatgtagaataaaaggtgaatatgtttctttttcctatcactttctagactcttttctgcatttacatacatatgagcctagatactttataggacctacaatggttaatgagtaggttctgtgaaattttaaacaaatgaaattccacgtaaaagaataggaaacctctaataatagttgagcttcttaaaattttcattacccaataacgtttagcaaacagcctaagaggaaatctctggtgtcagagtctccaataggaggtgttgtattgaatgctttacatacttcataattaaaaaagctaatatgaaacacaagtatttgccaggaaacattccatagtgattagaacattctgccagggccctaaaggactgtacatggcacgacagtctatagacatgttgcttttcctttcacaatttcttgtggaatgtgcactccgggcgccttcactgcaaaccctcaggctttatttacctaggcttgtaatggtcagacagtgtggacattgcacaggtaatgcttcaaaaatgaggctgtaacaagggattttagataatttggaatcaatctcccaaattacctaatgactacaatttagttctattatatggtatgtgtcataattcagtcattactctaaaagcagtttcctttttctccttattccctttagagtataaatgaaatatgacagaagtcccagatgagctctgcttttaactgaactgcctattgcattataaaaatttcaaaatgaaagcattttagtaggcatataatctaatatttcattttatagacaaattaagacctggagaggttaggaagcttgtctaaggttataagggtaattcctgtaaaacttgggctgagcccccgggattcctcactaccagattcctattccttttattgccacattctacctccgtgttatgaaagagagctttgttagatggcataaaggaccgtggagttgtgttccgtgtttgtcactggatgatttctcctgtgtcccataggttatgcgttcagcgaagatggtgaatattttgcctatggtctgagtgccagtggctcagactgggtgacaatcaagttcatgaaagttgatggtgccaaagagcttccagatgtgcttgaaagagtcaagttcagctgtatggcctggacccatgatgggaagggaatgttctacaactcataccctcaacaggatggaaaaagtgatggtgagtgaagacttcagatgaagcacatttttcacaaaatgaagtgtgacttcaagtgactgaaaagagatgctgaaccctacatagaggttgtgtggtccagaaccatgtttcctcaaaggatgttgtatcagttggctttgctgtgtaatagaccccaccaaaatgtagtagcttagaataataaacatttgtttttgctatgagcctatgggttggccaggtagttcttctggccttggctgagttctaacatgtatctgtggtcagctgcaggttagttggttcatcttggcttggctcttttacatttctgggccctcagctgggacgactagcagactagcctgggcttgctcacatggcaactcagtagaattgcaagacggggagctgaatgacacagccttcttaatgcctaggcttgctcctggcacgtcagatttgctgcattctgttggctaaagcaagccagagggccagccccttttcaatgggtggagaaatagatacagggaactgcggaaaaatgagatcattattacaatcaatcagtcccttatagatgtgttatatctcctaaggagattatggagaaggtgaatttttaaaccgaaccaagctatttgattatgttgagtgattataaaactttactgctacagtaatcgcatattctcctctgatcagaagttataggtcacctgttggttgccatttatcttgatacttttctccttgttactttctggacacacctttattgttcttctctttaattgcacaaagatcctgttgtgttcaaggggttcctccctctttgctccttcacttctaaattttcccaggcaggaagggctatgtaccttgtaccttactggtacaatgtgtcattttcttccttttgctaccccacatttcaacgtggtatgtagcattttcttgttatgttggttggtctttacaggtaagttttacaatccctgtgttagagattaggagcttgggcacagaggctcagtaatttgctggagggctgggatctggcaagaagcacagctactccagtgctttctgctgtacctgttgtccccttatcatgacttgttgtatctttgtcatctttaaatatccttgctttcttttctgtttttttttttcccccacaattgaattgagaataaggctacagtgtttttcatctcttggctatgtttagctttttctgccttttgattaggctacatcaagaccttttttataaattcgccaatgaattacaagatgagctaaaagtaggttttttattcaaggatgttggctaaagaaagatgtctgcgctctggaaacgaaattagctgcttgtgttaagagtgccccagagttagaaaatgttagttatttccaccttctgggaaacaaaaaaagtataactggccaattcatgttagagaacgttattacattaacttgtaaaaaacaaaagttattatttaccatcagctttcagtggcacaaaataataataattagtaattgtgatagatataagaaagccaacatctcagtagcctctcagactgtgatgggagccttacaaatgaagctaagcaattcctaccatgtgcttcttaccagtgtccctgaaagctcaatgacaatcacttaagtgccatgaagctttttttacattctggtattatcttatgtttttccctcccttgccctgaaagcttggtacgtcatcataatgaaaaaaagaagttcagcctcaaagaagcctccaaaatcagcaaatatgagttaattactttcagtttgatattcaaccaatgcttaaccttttttttttttttttttttttttttgagatggaatctcactgtgtcacccaggctggagtgcagtggcgtgatctcagctcactgcaacctgtacctcccgggttcaagtgattctcctgcctcagcctcccaagtaactgggactagttagcgccatgcctagctaaattttttttgtatttttagtagagatggggtttcaccatattggccatgctggtcttgaactcctgaccttgtgatcctcccacctcggcctcccaaagtgctgggattataggcgtgagccaccacgcctggccgatacttaactttttaaaaagtaaagtttagtttttagaacagttttaagttaacagcaaaattgagaggaaaatacagagacttctcatgtgcctcctgcccccacatattcattttacctctcttattatgaacattccccaccagagtggtacatttgtttttcattggtaaatctacattgacacatcattatcacccaagttcatagtttactttagggtttgattttggtgttgtacattctgaaggtctgaacaaatgtatagtgacatgtatccagtgttgtagtatcatacagagtagtttccctggccctaaaaatcctttgtcttctaacaattcattcctttctcaccccaatctttggcagtcactgatctttttactgtctttatagttttgtcttttccagaacatcctgtagttggaattagacagtatgtagccttttcagattggcttttttcgcttactgataatacatttaagttccctacaggccttttcccagcttgatggctcatttctttttagtgttaaatagtcattgtttgaatgtgccacagtgtatccattcacctactgaaagaatgctcagttgcttccaagttttagcacttatgaataaaacttctgtaaaaaatctgtatgcaggtctttgtttggacacaagttttcaactcctttgggtaaaggagcatgactgtgggatcatgtggttaagagtctgttcagttttataagaatcctccaaaacttccagagtggctacaccattttgcattcctgccagcaatgaatgagagttcctcttgttccacaacgtggacagcatttggtgctatcagggttctgaattctggccattcttacaggtgtatagttatatctgaattttttttttttttttttttttgagatggagtctcactctgtctgggactagttagcgccacgcccagctaattttttttttgtatttttataaatatccaggctggagtgcagtggcgtaatctcagctcacggcatcttctgtcccgggttcaagcaattcttgtatctcagactcccaagtagctgggactacaggtgcatgccaccccacccggctaatttttgtatttttagtagagacgggatttcaccatgttggtcaggctggtctcgaactcctgacctcaggtgatccacctgcctcggcctcccaaagtgctgggattacaggtgtgagccaccacgcccgaccatatctgattgttttaatttggatttccctaatgatatataatgtggagcatctttccatatgattatttgccatctgtgtatctttggtcagatgtttgtcaaggcctttggcctagtttttaatcgtttttttgtttgtttgtttgtttgtttgtttttcttattgctgagttctttgtatatttaggaattttatagttttatgttttacattcaggtctgtgatccattttgagttaatttctgtaaagggtgtaagatcttgtctggattcatatttttgcctgtggatgtctggttgtcccagcacctttttttaaaaaggctactaggctctctttcctgttccattgatctatttgtctgttgttttgctaataccacattatcttgatcactgtagctttataataaatcttgaggttaggtgccagtcctccaactttgttctccttctgtattgtattggctagtcagtatattttgcctttgcatgtgaactttagaatcagtttgtcaatccacaaaatatgtttctgggattttgtttgggatttcattaaatctgtagacaaaaatgggaagaactgatatcttgacaatgttgagtcttcctatccatgaacatggactagctcttcatttatttagttcttctacttctttcatcagaattttgcagttttccttagatagatcttacacatattttgttagatttatacctaaatatttcatttttggaggtgctaatgtattgtttctaatttcaaaatctacttgttcgttgctggtatataggaaagtaattgatttctgtatgttaaccttgtatcctgcagccagctacttgttaaatgtgtctagcattctgcaatatgggtggaattgattttcttaaaattatcaagtacatttcagtgtacatttttaactccttcaggcacagagacatctaccaatctccaccaaaagctctactaccatgtcttgggaaccgatcagtcagaagatattttgtgtgctgagtttcctgatgaacctaaatggatgggtggagctgaggtattgtacagctgtgaaattttacccccaaagactgtgtttcatggatgtgtgtataaatattcttattatgtggtgacctttatggatggcagaagtcccatgagtgaatattcttttgttaaaaatattggtattcagattgactcttaataatggaggtgataaacctttaactgcaatctcaacctattactcttaatattaaaagtaatactttgagggtaaaaaagtaattttacttctagtaaaaactataaaagtacctagtaaggtaaaacatgaacctttcaaaactcagaatcctgcctctcagaggtgagtgtggtagccttccacaaattttctttgtacatacaagtgagagtatgggggaaagagagtgtgtctttcccttttttatacaactgtgctcttttcatgcatattgttcacttgtttttacattaaaatgagtgtcttttatacattttctcatcaatattcatatattccttgggggtcttgacagggaccaacctcttgaagtgataggtttttaagttactggcctagaatttagtctgtattttgagaatcagctgtgaagaaacttaggggtacttggagtaaaattttgactctggttagttcattcctgtgtactaagaaatacttcttgttagagaagcattctgaatatgttttaatatgggtgggatgttattccatttttagtgggaatgagaaatgtactacaaactttttagctcattgagacacctcttcagttgaaaaacaattagcagtttgttaggaaagggacattttcaattttaacttacgttcctctgtctgcttcgttgggggacaaaacaggaatctatggtattttattccatgggaattgatcttccgtattccaaattgtccttttatttatttgggttttctagaccaggggttagtaaaaaaaactgctgccactgggctggatctggcctgctgcctgtttttgtagatggagtttttttgtggcacaaccacacccattttcacctgctttcaaattagaactgcagagttgagtaattgccacagaagtccgtatggctcacaaagctgaaaatatggactatctagacctttatagaaaaagtttgccagattttagtagaatgtgttaaaaataaatttataggacattttgttaccctaaaatttgtccgtttttctttttttttttttttttgagacggagtctcgctctgtcgcccaggctggagcgcagtggcgggatctcggctcactgcaagctctgcctcccgggttcacgccattctcctgcctcagcctcccaagtagctgggactacaggcgcccgccactacgcccggcatatttttgtatttttagtagagacggggtttcaccgttttagccgggatggtctcgatctcctgacctcgtgatccgcccgcttcggcctcccaattgtccgtttttcatgccttttctttcccatctaacttcccactctaccagcttttcttgtgcaattgctattgttgtttttctcacgtatttgtttttaatggcttttctgagatctatttggagactgtttctgccaagttttctatctactacatcttctcctcatacataaggcttctgcgtaccatagatatgaaataatgtacattttttaccttcatctgagtgaaataggattaagataaatatgctaccaaaatattatatgatatataatctcataaaattgaccattataaccatttttaagtgtacaacttacaaattgtacttaagtgaagtgtactttaagtgaacttacaagttcagtggcattaagttcattgacattgttgtacaaccgttatcatcaatcctcagaactttttcattttgcaaagtggaaactccaccctgtgaacaataactcttcatttcccccacccctctccacccaccactgccatcacctggcagccaccattctactttctgtccctttgtatttgactgctctgggtacctcatacacatgtcgtcttacagtatttgtctttttgtgactggcttagttcatttagcgtaacatcttcaagcttcagccatcttgtagcgtgtgtcggtttccctcctttttaacgctgaacaatattccatgtgtgtgtgccacagtttatttatccattcatccctgggcacttgggttgctttccacagcattgttatgagtaatgctgctgtgagcagctagtgtttacaaatagagtggaaatatatcacatgcattaaacatatgtatagtcacttctgctagctaggcaaataaaaagaaaagcaaatttaaatagttcagatgatccttctaccattctttcaatagatgtacactctgcgtatctcatccgatataatctttactacagtctgagaaggaaggaatgcataaagaaaataaaatacctactagggtaattatcttgcaagtccatgctggaactgcctgctgggtctgttagggtcacagcctgtatcttcttaaccactgtgtacactgtttccctgatcaagaggaaagggcacacaaaaattgagtaatgactttatttatgttttatttatttatttatttttgagatggagtctcgctctgtcgcccaggctagagtgtggtggctcagtctcggctgactccaacctccacctcccgggttcaagcgattttcctgcctcaccctcctgagtagctgggattacacaggcatggaccaccacgccgggataatttttgtatttttagtggagacagggtttcaccatgttggccaggctggtctcaaactcctgacctcaggtcatccgccggcctcagcctcccaaagtgctgggattataggcgtgagccaccatgcccagcctaagagtaatgactttaaagaatagcaataaataaagggatgcatctctactgcacagaagtaataaatgaagttgtttaaaaaaaaaaaaaagctaaaggaacaatataaagtgagtcctttatatttgatctttattggatcagggccctatttagtgaattacgcagaggaagtctgtaagaaaactcgtgggctccgtaaacaagaagtgggcgtagacttccctcaagcagtgttccagaacttgggtggtcttgttgtgactggtgtcatcccaccagttaccatggctggtcaggcaggtctggctggctaggtaagtgctccttccttcctcctttcccaacccagctgtatgtgatcttctgagcaaaaggaccatcttgctacatggaggagtactcttgtcacttaaacatgaactctagagttctgctgctgtgacgcctcagaagcctcaggtccaatctgaattgatggtccagttccaagtcttcactcagaaaaatctggatcatgaaaaaaatcttgaggtgggaatttcttgtgcccttcaagaagtgtgataaagccaggggagtccaagaagcaggtgcactgtagaactagctgggccagaagcacccatggctggtggacacattagctctcaggctattcactggaaatgaagcaatttcttaacagcctttatttagtgatttgcatcttagagaaaagcaataaatggaatcccactctgtcacccagggcggagtgccgtggcatgatttcggctcgctgcaacctccgcttcccaagttcaagcaattctcttgcctcagcctcccgagtagctgggattacaggctcatgccaccatgcctggctaatttttgtatttttagtagagacaggattttaccatgttggccagggtggtctcaaactcctgacctctgatccgcccatcttggtctcccaaagtgctaggattacaggcgtgagccactgtgcccagctgtagtcctctttataaccatgtaccaaaggcatgtgctgcaattgttgcttttatttaattgttgcttttgttataaaagtacttgcttttagtccagtcatagaacctagtatttagataacagtttttacagtgtctgtgatgagagagccagtgttagagtgggaggactgtactggaacagaaatttttattctagttcggtctgtggccttgggcaagtcacttaatctgttcaaggtcatttcctttatttcttccagggctttttcagctctgaaactggacggaggatttatcacagcatctcttagcctcctgggagagaacttagctgctgggtgtgagagaagcaggacacagggcaggatgcgggctttgtgggtgtgggtggaggaaccctgtgggcagagactggatgtgcttgtggacgtgtgcagatttctctggcttgctgtcgtcaacctccccttcggctgccgcagtccaagttcactgagaacttctctttatatcctagatgctgtctcctcgtgactcatcttccttcttcacagatacctcctctgccttcctgcatggacaggtctgtcttgccttgatcaggcagatctcaggaagttccaatcaggaagcagctttagtttccccactgttgccctccgtcacgctgtgacagcgtgtcttcccgggacgactgccttcaacctggcagaactccttgctttctggacacttttggttattggaactgctattaaaggttcattgcagtccagaacaaaatatcactctctccaatttacatgctttcgccctctacccagctcaagtttgccaagcccctctccttgcctattcaccctgttagttttcccagtagccactcagggaggaggagtaagacaagagaaactggagttttgcttattgggaattgtttgttggtctatcattgttggcctctcttggctgcttgcaatgaggatgtatgtccaggttccagctctccttatgccatccttttttcagagacatcccctcgattttaggaaactctgtactttgctgttccctgatgtgggttataaactctctggctgcccttttgcaccacctgcctgccccaaagcttttgatcccagaagcattccctcgagattcagacttctctgcctttccttcctccaccctttttcatcagggacctttcaagatgtctcaaggccagctgtcttcctggtagcttcctgggtacctcttgctccaggggaaggcatatccatgggttactctgttctggaggtacaggatgtgttcactgccctcctcactttcagccagggacctcgggaagcctcccacattcagtccctcctgcacatgtccaaaatgctgggctcaggaacaagagctcccttgtgcccctggggtgtaacatgaaacagctgccattgggctttgatgggcagaggtgccagttatttaatatagactgtgaggctttacttgaaggacagtttcatggcaggagagaaattgtcaggttctattggaccaaaaaaacccaaaaacccacaaagctctgttttaaagtgaattgtgagcatctggggagaaaaaaaatcctaaagaaatcaaacactttgtggcactgttcccagcagagggtgctctagaatgaagattgtgaaaatgcatcatccctttagaaaggattaaggaaaaaatgcccagcttctttgtgattatctccctaaatcctatattgagaacctaattctgttatacctaattcttgaaaagtttttttttcaaaagtaatcctgaatcttagtatctgttgtgtctccataagccatttttatatgttcacctgtgaaccctagtaattaaaaacatatgtattacacatatattaacatataaagtgtgttgcctgatgcttgacttatagtaggcatgcagtgaatgttaatttccttactcttcccatgtcccctgtggaagttcatgcacatgaagaccagcagggtctcaccttccagaacagacacagaaaagtccagtggtgttcctggtggggggtccctgcctcctctgccccttgctggttggctgtttttgacttggaccagtaattgctcagtagccctcttcccagttggcacagtccatatttattccccaagtacttagcccttgccttgtgtccaccactgtttcattagcactgccttatgtgataatattcaccgtgctgataagcacacaggaaaatctcagcagcatggttgggaaggcagaaaagtcagaaagccaagctagagacgtggatgtgagtaaagcaagaaggctgtgccgctcttcatacataaaacaatcctgcagaagagagttgtttttagtagacatgttggatttgttgatcaatcgcttttcttacagaacacttgtttttctcagcaaggaagaaaataagacaaaccgtagatactttctttgtgagatggagtctcgctctgtcgcccaggctggagtgcagtggtgtgatcctggctccctgcgacctccatctcctgggttcaagcgattctcgtccctcagcctcccgagtagttgggattaaaggcgtacgccaccaagcccagctaatttttgtatttttagtagagacggggtttcaccatgttggccaggctggtcctgaactcctcacctcaaatgattcggctgcctcggcctcccaaagtgctgggattacaggcttgagccaccacacccaaccccaacagtagattgttgaataaccaaatttatcaaacagacaaccagctaacttagaaacagtagtgcctatatcatgtcaagtcctacattatttattttattttgtacgtgttttgttttcttagaattttctgttttatcagtttctggcataccgagcaacacaacacacagtatttggattgatttctttttttcttctattgctgttgtaccacactgtactgggaaagctgggtaactttatttgttaaaattattaatgcatactcacatgtgcttatggctcccctgtatgtctgttactggcattgccccttatttttattacaaatccataaatgagtttcatatatgaaaagtcatcattgtaggtggttagttttaaaagttttcctaagtgttagaaaaataatattaaagggatgttgccatgattcacaactattatgaaaggaattcaaaagatttatataaaataaatttgataaagtctcctgctctgagaatagcatgattaactctcaaagctattaaaatccattttcactccttttgttcatttccaggacaatttcaagtgtcactgctttttagaatgctttttttacgtgcaactaattcttttattataacatataaaagaaaataccttcctcagtttgaaagtgcatgtagattcaaataatgaaaaaactttctttgcctttttttggttaggttctaagagaaaaaaattatactaaagaaatttcatggccatgaaaatttccttattaatacaccaccacacgactggagtgtagttgctgtagcataaaatagcttttgagtttttctttgaaaatatgtttgatgtaagtccacatatcctgtatatatataaatattaggttttgtgttctgttgtttttaaggacaaattacttcatacatagttaaattattgagagtttaaaacatgaaatgcttttctgttaattgtctcttaatatgaagaaaggcttgtttactttggtcatttggaaagctcaggtattctttgcattatatggtattgagactgaaaatagccagattcagtttaatattaataatataggtttattgtttaaaatatatacccattttccagagaattccatattgagatgttagtatctatttcatacttaccctgaagactcatacatgtatggtatgtatatgtgtgtatatatatgtgtgtgtacatatgtatgtgtgtgtgtaaagccttcaaatgacccagtggtagagccgatgaccttgtgaagtggaattgtttgatcaagactctggtctgagtgaatcacatcacacctaggtgaggcattaactgaagacattttgtaaaaacatttatttgggactagattcccttaaaaagactccagttgctacttgtccctctaaattctgtgatttttataggagttattttcctgaatatgctaagttgtccgaattacacgtttatcagacaagtacatgtgaacctaatagagttaagtataaaatatgtattttatacatatactctaacaatttgaactatgtctagtgagagttttcttggacttccttagtgtagcctagaaccacagtatacacagtagaattgttaatggattaatgtggcttctttaatgaaactataaaatacaatacccccataccttatgtcctaccttttgataaatgtaagttagaatgatagctgttactgggtttcgtcttcaaaagtagaagccaagacttaaaaaggtttcctcaggctagcataaaatatgccagggtaagaaatcaccaagatggaaggggaacacttctttccccatttttctgacctccctgccaaggaatttcattgaatcttggtttctcaatgactagaaatgagagaggttgggagttcacagattagctgactcacagcacaaagccacattcttaagtgtgtacttattcagcactaaagttgagatctcggttctccatctgttgactcttgttctgtttctagttgattcagacctgaggcggagagaagtgaactgtttgttgggcctggcgaggacactgagtggaagaacagtggccgtgggctgtgttgtacacactgcatatttacaggatattagcgatgccttacatgctgtcacagatcagtttccctgggaagcagactctgagatagaaatttgtgtgctagaagtttgatgggagagctttcaaaatctctgcctgtgtgacgaacgatcgcagcagagggagaacttcagctgtgatgcaatcatcacagaggtgtcagacaatcctacaggaaccctcaagctaggtgagcccttcagcattgtcctaacaggagggagaggggtccaggcctttataaacctacattaaccagttgtcatatgtggatgaacccaaaagaatgcatgaccttgggagaggtgccatcttcaacttgaggatgagacctggagagattctcgtctgagagctgtctgctcccaacacccatcagctgggagatgagggcttcagccctagagggcagcccagcacagcacccactacacatgctgatgtctgtcagtgagatatacacttgagaatgaatgtacgtacttgaatatatgttaaacatagctctctgtaccagataacataaaccagtgtagcctttgagttttaagcatggacaatttcaagaaactaggggaattctacttctttaatcatcatttaggagtcatcacttcccaaaagccttctcagaactcatttttccgtccagctcaccaccctgtagatgcccctctctggcactcacatcatacattgtacttcttgctattaatgttctacaacatggccttttctgtgtgtgtctgtatcctttagtgtatctgtctctcccacctgagcatgagttcttgaaggttctagcctattgatctgtgtgtgcctgagcctgattcagcagccagcacttggtagactcttgataaatcttgggggaatacacaccccagctgtggctgccctgaatagtggactgcagtggttgatggcacgtgttaaattgtgtctttgttatgggaggtgagaatttggctggggacaggaagttgaccgaaattttcctattaagatcagccacttctggtgatagtagctttgtccaacctcatccacctgggcacaggaatacacttttatgaaaaggcttttgcccttgagcctgtggtagttgactcttttggagaactgggctggaccacccagaagatccattttacaatgacgaatggcataaccaagtacccttaaccaaagcaagctgagtgacttccccctttcattgacgaccttgattccactctggtggaaagagaagttaaattcgaggaaactttgccaagaaagagtagccaaggcaagggggaagagtgaattactccctgaagcctggaggtgagtgctcctcccaccttcaggagacatgtctttctgccagccaccagagaagaagcatgggggtgtggcttttggctgtttttttaataacctcccaggttttgtctgcttatagaaaatgaaaggcttagtaccagtgaatgaccaaatgttatttagcccatctgtagaataccacactctctctacatctagattttttcctctttccaaatatatttatcaatacagatgttagtactttcttctcttttaatattttctaattatatttaatcagtactctaaatataattcaacaggtgactttgcagaagtagactgtcagagtaacctacatattaaaaattgacagtaataaaaatggtaaagagttttaaccttgatgtttattgttatgattaggaatgcaagtaatggatttaatatcagcaatgtaaatgtttcatttatagtaattcttttaattttgtttttgttaatgttttatttacataaatggtagatttttatgaagttaagtcatttttacttaaggaaaatttgtttaaaataatatagatttaaaatagaaggaagccatgaaagcacaaatttaggaatttgtaaatttaggaattatttcataattggtcaggctaatattattagtttttgcaaaagaaaaaatcagtgcttgcaaatcagattaattgcttctggagagcacaattattctagctgggatatcattatcacttagagaaaaaaaaaaaaaaacagtattgttgaaccggaattcaaactgttccacgaaggcctaatgggctcttggcttgcctgcttttctacttttctttttttaaatctggcttttaggaaagtaactttattctgttcacagtcacatgccctccacatcaacaggatttatgtcttcccctcccaatgatttacaaaattcatcttttaaattgccttgaaatagtctgggtgtggggctgtcattaagtgtgtgttgtttaaatttaagtggaagaaggtatatttttagtctgtacattttggggcaacagtgacttacaaatgattttgaggcttgtgactttgagcatttgaaaatgcaacgttgttttcagtttagcaaattttagtggctatggagcaactccagattgtgatgaagagaattataatgaagaggactgacttaattggcgttataacagcaatgtaccttgggactgcctgcttcagattaagtataaactgctacagctatttagcacagctggaaatgctgagaaaaactcattagatgtgcttgagacagctgtcatcaaaggtttggtgtggttcttgcagtgaatgttactgccctatctttctgatgactgaatcactacaactgaattagccatcatttatgattgatgtaagctgtaaagagtctgtgtttatttaaaggacaagagaacaaaagtatgaagtagtattaatgatgttgctttcaattatattaataagattataattgtgaagttgtggataatcttaatataggatggtttaaaaataagatggaaccaaaattctgaacagttttgttagccatgtatattaaaagcttaaggataatagaatgtataattcccaaatcaaagaaggaaaaatataatacaaagaggaaagacaccggggaaagcaagataaataaaaggttcaaaatttaaaatgtggaagccagtacctcagcaataaaaattagtggatatggaatacagatttttagattggattttaaagactagatgtgttcaaattgtgttcatttgcaagagacttgtttaagacataatgatagatttttgcttctggacatgatgatataactggtactggactagtcctcctgctgtacacagctaggaaactatgcaaaatagacaaagcagctgttttcagatattgatcaataggctgccccagactgatccaggaaagaggtaaatcctacagttgccccagctttctgcctggagttattttttggcctctggcacaaggaggaggagctcagagtatcgtagtctcactgagctaatgatccaaagattggaaatcagggagactgaagccactggaatttgcagggcagaataacaaaaggagggaactgcccactaagagtttcaggtatctgccttggaatcccctcatgttttcggctaactgttaagcagtgtgtacgctgactgagactttatgattcaagctaagaactactagggggctgtaagctgacaactcccaaaggtttaaaacagctgggagacgttcacattctgacaagtcagaggggaaagactttgtgaacacccagggtattcacttagacctcagagaagctatgccttagcagtggggctgtataccttacccaacaaacctttgaaaacaagtcttgaatggatcaagctgatccgccaatgaattaactgccgcaaaatgttttgcaggcagaccagaaaataaaagaaatccagacaacattcaaaagcccagaatccagttaaaaaataaatagttattaaaaaagaagcaaaaaaaatgtgactgatagccaagaggaaaaatagtcaatagaaacagatccagaaataacagagagtagaattaacatataaggacttataaaaagctatcataaaaaaatactttttagagatctttactaagtgttaatataatgaacaaagaaatagaaaatataaaaatgaaccacatactcttctagagataaaaaataaaactctgagatgaaaaattatctgtttatagcagtttagatgctataaaagaaaatgcaaaagttgaagacaggacaatcaaaactaaaccacaaagagaaactaagacaaaaatggacacatttcattgacctgtggagcagtaccaagttatgtaacagtatgtatttgaagttctagaataggggtgagaggacaaaaaatatatacatgagacacaagtggccaaaaatgttacaaatttgataaaatacagaaatcaacagattcaggaagctcaattaatctcaagcagggtactacatcaaagcctgttacagaataatcaacgttcagaaagccaaagataacaaaatactaaaagcagccagaggagaaaacacatattgcatatagggaaacaaagataagaaatgacaccaaattcccagtggaaacagtgcaagtcagaaaacagtggaaagatgccttcttaatggggtttaccttgattgccatatttaaaactacagccttggctgggcgcagtggcactttgggaggccaagatgggtggatcaccttgaggtcagaagttcaagaccagactgaccaacatggtgaaactccgtctctactaaaaatacaaaaattagctgagcatggtggaaggcatctgtaatcccagctactcgggaggctgaggcaggagaattgctggaacccaggaggcagagattgcaggttggagtgccactgcactccagcctgggctacaaggtaaaactccgtctcaaaaaaaaaaaaaaaaactacaacccgaccaccatatcctgtctcccttactcagacctgttcatgttttccatggcatttatcataatatactacataattccatatttatgtattcctctctctgaatagatgtaacattttttcttgatttgtttactgatgtacctttaatacctagaaaaatgtcttgcacaaaataactgcttagcaagtgtttattgaaggagcaaatgaaagaataacagctattagtcagggtttactagagaaaagagctaataggatgtgtgtatgtatgtatatatatacatagagaggatttgtttaaggaattggctcatgtgattgtggagccttggcaagtcctaaccctgcagggtaggcccacaggctggagactcaaggaagagttctagttgagtccaaaggcagttggctggctgaatccctcctgttcagcagaggtcagtgttctgttaaggccatcaactgattggatgagtcccacccacattatggagggtggtccgctttactctaagtctgctcatttaaatgtaatcttatcttaaaaaaaaaaaaaaacttcacaaacatctaaactaacatccaaatatctgggcactatggcctagccagattgacatataaaattaaccctcataataagggtatggaagaacaggaactctcatacggtattgctaagtaagagtgtaagttggtacaaccactttggagaataatttggcaacatctcataaagttgaatatgtgcatgtcctaccactgagcaattttacttctagttatatacactgggaagcattttaggtcacaaacatgttcaagaaattttctaaagaagtatgtaatagtaagaaaacaaataatatagatgtttatgggtaggatgatggatcaactaatggtggtatatttctggattgtaatactatacagcagttaaaatgaatgaactagatttacacatatcaacatggactaattataaaacattgaatgaaaaaaattagttgcaaaagaatatgtatagtttgataccacattttttgtcaactcaaaacaataatacattgtttgtattagatttttttattaggattctttttgctacctaacattctgctgtttatactaacaaggaaagtctctgagcctaagccattcatttctgagatcttgcagtagaagggactaaaaatatgcataagcagttgttcagtagaaacttgtcaatgtgaccagtgtgaaccatagtgaatttcttgcgtccatacccattttgctaattctttttttttttttttttttgagatggagtctcactctgttgcccaggctggagtgcagtggcaccgtgtcagctcactgcaacctccgtctcctgggttcaagcagttctcctgcctcagtctcccgagtagctgggattacaggcgcctaccaccacgcctggctaatttttatatttttagtagagacagggtttcaccatgttggccaggctggtcttgaactcctgacctcaggtgatccacccccactcggcttcccaaagtgctgggattacaggcgtgaaccactgcgcccggccccattttgctaatttttattgagaacaacaaactttaaattatgcaacccatgaggaaactttaaagtcaaggatattatattcaaaatgatggatttcacatattttcagtttaaagaatagactagaaattaaaataaaaattacattgaagttatgacattcagttacctctactgatattttcaactaaaataattcactgtgttttgttaaactgtgattatgggtgaaataagataaaattgatgttcatctttttattcagataactttcttatcagatcatgagtttggggcagagacactgcctttgaaaattaaccttaattttttaacttaatattcaataatgttctcacaaaaataaattctaattagtcccctgcactatttttttttcttttttagttatctgatgatggccgctatgtcttgttatcaataagggaaggatgtgatccagtaaaccgactctggtactgtgacctacagcaggaatccagtggcatcgcgggtgagttattttttcagacacagatagttattccaagaaacttcatttaaaaagtattattgtggtctattaattgatttcccaagaccctcttccattctaccacatcatgtcagttcatctgattttttttcttttagtactattccataaaatgagggaaaatggaatgaaactgttggctttagcattttctctgtagattgagattagccatactttctgcacatagtgtgaaaatatcccgtgagtattgcacatgaagagcgtgaaggagaagctgatccttttggtctgtaactatttagatttaatggtgcagccgggcatagtggcatcatacctgcaatcctaggggctcaggaggctgaggcaggaagacagcttggggccaggagttggagaccagcctgggcaacatagccagaccctgtctttaaaataaacaaaaaaggcgtaatgttgcaaactgtcacaggcaagggttattagaccaatgggaattggctagattaacgtaatcagtagagtggccctcagtacttaggaaaagaacagcctgtgtttgcttgccaaagccttacatatcatgataagcatagaaccagccagttacaaattctggagatggcttattttaaatgttgttctcttccaccatctctatcataccagcactatcatcaagcacaaaaacttttcagctgcacaatttactatgctgaaaattcccagacccagaaatcctatcagacatactggcaccccgataaggacagacactaagctaattacattatcttctagttaatgcaaaataaataatattttagagagggttgacctagattttcaaaatactaagtgcatttctgtaataatgtatttacctcattattagtttctaatctgtgttacattgtgatacgaaaatatttgtctgattgagcatcgcgccatttttaaacttctctgagcaagatctgcatcctaacattagatactacagagcaccattcacacacatataccagggtgaagtcagcaacttttttcctagagttaaatatatatccatttaataaaactgagtatttttttctattaagaaaaagagatacatccatcttggtgtcaagaaaccagcattggccacatcagtgtttgcattctctgtcagggcaaaccaccatccaggaattgtttgcgtgagttgcaagcataggtcttcatagaactgagcaaaccttttaagattgagcctgaacgaatcagtgacatcagacattatggtgctgttatcctgcacacatgttccaaatatagagaataaaattctgtccacatatttatataccagactgctattgctatatctgctttaataaggcgtaataatattttgagtgaaactttcaagtgctggcaaaactcatggaaaccctctttgttttcccccaacctctcggtccttatctttcccctgcaacccagttattttattattgcagcgttagcatttagaaaagagagtactcaagagattgggattccaaaaggaagacagtacagaggtgcactaggctctcaaaaaccaaattctagatagtgtagctaagaatgaatatgaggaagaataaaggggagcatctaagaaactcttaatggccatgatccattcagagctccagggaagcctcagctctgctcttaaggccttccaactgattgagtcaggcccactcaaattatccaggataatctctcttcattaaagtcaatggattatgggccttaatcccatctacaaaatactttcacagcaacacctatatttgtgtttgattgattaacgaggcatactagcctagccaagttgatagcaaaaagaccatcacagtgagctcatggaacaaacaagtccagtggtactaacctgatctgtcagtgttagggctttactgatgcgtttggcaaagtatgtcatatcctgtggaccagaaagcagaatatgaagagaataacataggataggtggatttgaagctgttgagcggcatactgatgaattggatcagcattctccagtggtagcttctgggttccaggtgtagcactgagcccgttatcttttttctgattattgctttgctagcattatgtttgtggataacataaacttcagagtaattcttttgaatggtggccctgggattctgaaagttctcaacaattgcagttattcaccaagtggatatcagttttcattcttaggttcaaaaatcaatggtgcgggacagggttagagaactcttgtttgtttgctttttaattgatcactggtttcattttgaatcaatgatcatgactatttagagaaacaagtattttgtgtgattgttttactattgaaaagattaagtaaatttagtctataaaaggggagacacagcagattcagatagggatcattaaattaagaaaaaaaatggttcctgttagttacagttggatatattgggataataaccacagcctttcaaatcagatttgaattttactctcagctccgccactaaataactggttaccctgttaaagttttttttttctctcccttaatatttccatgtctgcaaataaggaaataatatctacttcatagggaattgtgaggaataatgaaaatgcaaagaaaaggacttagcagggtttctggcatgcagtgagttctcaagtattccttctttttttctttgtttcttgactgaaagaggaatatttagaatcaccgtactttagttttaggtagcttagaaaactagattgaggacaccaaaaaaacaaaacaaaaaaaagtctatctgcagattcaaagctgctctaaatacagattttcaaattaacttgttttctgcaaagccagattcataatcacaaaagagaagactgtgagggaacatgtctaattgtgcaggttggtaattgaaaattcaggggtctgtatgcccggttgatgaccatgactaactcctaggatcttttttgcttttttttttttttttttttttttacctgcttccccaattttgttatcctctttacactaaaaatagaataattaacatttaacttaaatgctaaatgcactagttaacttgaatgttagatgacttagacctgaacaactggtgcctgaaaactcaatccatgttgtgaaacctccaatttcatattactaaaatctatacctcttttgatatcttaaagcctttctgctaggattttaagctgttttcccttaaagccagggggaattatcagcatttttgtataaattaattatttatatatttaggataccactcagttgtcttttttgaggactaaagaatttcacttgggtggctcatgtcacgttgccatcatctgtgtctcccaagaaaacctgcccacgtgcattttgaaatgagagcacaaaaagccccctgaaaaaggccaatggcaatttaatatctttttaaaaagcacatagggagaaaaaactaaattagcaggatagaaaatatcttagcaacttgaaagttaaatgcgatctgtatgaattaaaactggattcattttgtcaaataagtgtggacttctgttcttttgctgccttatgggagtgctgtctctgttgttctctgcctctctttggacaacctcatttctgccatttacatttgcagtattttcacttaagaatatgaacacatttgttgcaagctgtggatcacatcctttacccagtaactgcagttgaggctggcaattgctccttcttaccttttctgaacaggtaatttccatgactcacctcatgcatcactgtatagaaatggaattaggcctgtcatctgggctttagaagcttatatataataatttttcagctgttcagaacagctaagcagatcgtctccaaagagtcatgtcctattctccactggcttaccagagaaatgtgtggagttactaccttcttgctttgggagaagagaggtccctgtcaggggctaccaggcttccttgtacttttttttttttttttgagacggaatcttgctctgtcacccaggctggagtgcagtggcgtgatctcagttcaccgcaacctccacctcccaagttcaagcaattctcctttctcagcctcccaagtagctgggactacaggcgcatgccaccatacctggctagtttttgtatttttcatagagatgggtttcaccatgttggccaggctagtctcgatctcctgacctcatggtccatctgcctcggcctcccagaatgctgggattacaggcgtgagccactgtgcctggccttccttgtacttttgatagatacctttctctccagagttgccccctctcctcctttcccccattctgatttccatttctctccatacaaaagcactttgtgtgaggatccgtgagctgcatgagattagagatgttgcctgtcttgttccccatggagttgccagcacctagagcagtccctattggactcacagcaggtgtgtaccagcttgtctcgaatgacgtgtccctttagggatccttgtgctcaggtggccttgcttgataagcccccctccctctgtaacggttactgccttctgagcattttgaatctttatccctgtggcttcctaaatattttttcattaaatttttgtcctttattaagcactgagaatgatgggttctttttttcattcctttatattgtgtgagcagaagatttttgattctcttattctgttgcttaacatcaaaagtgaagaagtatcaaggtaacattaaagacaccaggctagcatgacgttttttagttctggagtagaaaagacagctgagtcttgactcctatgatccttgatgtggttcatgcccacagatttgttgaaattaattatcctgaaccttacaagaaaataatttgtctggattttcttatattttctataccttcctaatcaatattatttattttgaagtatgtatatactttgtttcctaagtttgctataaccctattttatttatttactttatttaaatataaaatagagatggagtctcactatattgcccaggctggtttcgaacacgtgggctcaagcagtcctcctgcctcagcctcccaaagtgctgggattacaggtgtgagccactgtgtctggccttatttttaatatataaaaagttgccttatatactttagttacatagacaaaattcagaataaatttttgaatattttctgcagtatgggtatcagagctcagagctgtctcttttctctcaagtctgtggactttaaaaatttacatgaaaacttaagtttctgccttaaaaatataaatacatttaactcagggatacatttctaaataattttattagaaaagcagaagatactaataacttctttaaaatttaactttggttacttttgttgtctacattataaacaactgtatgtaaggttcagtttaaaatgtaggagtacctaaatcatatatttagttatgaattagacatgcattaatgtcctaccctgtgccaggcactgtgttgggcacttgtaatgacacgtggtagcccctgcccttcaagtgctccccatctgctggatggtaagatgtggatatcatcagtttgagggagtgtctgacgggctgtggcccagcgcacagatccatgctcagacttcctctctcttctgttttctttctttttttcattttcttttctctttggttctttaattttccagtagaaagtcaggtactttattccctgctttataggataatagcagcaaaaaaggagctgaccattagtccctgttctgaatacattttttttttctgcaccttccgcctcctgggttcaagtgattctcctgcctcagcctctcaagtagctaggattataggtgcctgccaccacacccagctaattttgtatttttagtagaaacagggtttcgccatgttggccaggctggtcatgaacccctgacctcaggtgatccgtctgcctcagcttcccaaagtgctgggattacaggcatgggccactgcacccgacctacatttaaagttaattatatcagagatttttaatagaattcttaagaagtgattgttaggcaaaaagaaccgtaagtctgaaatcttttttgttagtaacttaacaacctccttcaatataggcatccttaaaacgggcctagagcggtcttttctcatgtcacagcatttatgaggagtttagggagaaaaggtgcatggtggtgacatgctgatttctataaggaaatatcagcttacctgggatttgcccagactttcactaacctgtctgtgctttttcctttttttgctaaaagtttgattgttttagattgataaagtattcagtacctaccatatttttattttaaggcttttgtgtcattaaagaaaattggctttttcctgcattaggaattaaatttgcattacatgctaacacataaccataaaaggaaatctggtatttagcagacatgtagattggtcatttcaccatctctgactaatgcagctcttatttttaggtagcagagatgatactgactcttttgttcttgcctgacagggctggacattctttgggcgtagagtggaaaaggggagataaacattcgagaagctttaagcaaaggagctgtccaaagcttagcaaagtcatctgagtgctaaaagcaaacctctctgaggagggcctcagagagaagacagggagtttgtaggaaatctgtgtgtcagagtgggaatgcagaaaaacgaaaaagaattgggacatcaaaagacagtataaaaacaagacccaaaataggaaatctgatataaaagacaaaatactagtgataaaatgagtatttatactaattttaaaatgttcggtttacttttgtcacttgaacactggggttatttggaataatagttaatactgtttatgtaacatttcctgtgtgtcaggttctgagctacaaatgtaggcctctcattcagtcttctcaacagcttccgaggagcacggattattatccccaggaaactgaggctggtgaggccaactagctttcctaatgccatttaaagatttggatccatgtcagcttaactcccaagcctgtgttctaactgttaatcatgtggcagactgagacagaaggaagtcattcaggacaacagcagcccatgcgccctgcagcctcagtgcctgaccactccttgcatttgttgtcgtgacatgtccagcccttagagtttttgtaaagtataaaagcactttagctgccattattagggagcttgcacagcattttctatgacatgtagttaatatagtttagttgatgatttttcaaagaaagtaataaaagtatgactttgctctaggaaaagcataagacaatttattttaaactaatcttcactcaataaatgaatcagtccccaccaagaagcaggtttataaaaagtaattttaacatttgaatgcagagaggtttgggaattgaaatttcttttggcttcagagtgaataatgccactttatagacaaaagaacctcagagaaggtaggcaaaaaatgaaatggttaaagagttaaatcatgtttctttttaaaaagtaattttcctgttttccatttaaatcaacagtgttctaacttgtgagtagcaaaaatgaatgagccccattgttgaactgaaataccttttctcttgatttatttctctaccaaagccctgtagaacaaggtttcaggagagcaaaagaatttcaagagctctcatttaaaacatccggccctgtgagggcctatactttggactatttttccaattttatagctagacttttgtgaatccagccacattccttattctgaatgagcttatgacttgtagtatgtatttatggctaaggttaatgcttcagaatttggtggcagacaataatgtacaccgttctgttgttttttgttcattggagcttgaatgatttttttttactttttattaaattatactttcagttttagggtacatgtgcacaacgtgcaggtttgttacatattcatacatgtgccatgttggtgtgctgcacccattaactcgtcatttacattaggtgtatctcctaatgctctccctcccgcctcccccaccccacgacaggccctggtgtgtgatgttccccatcctgtgtccaagtgttctcattgttcagttcccacctatgagtgagaacatgcagtgtttggttttctgtctttgcgatagtttggtgagaatgatggtttccagcttcatccatgtccctacaaaggacatgaactcatccttttttttttttttttgagacggagtctcactctatctcccaggctggagtgcagtggcacgatctcggcttactgcaagctccacctcccaggttcacgccattctcctgcctaagcctcctgagtagctgggactacaggcgcccgccaccacgcctggctaatttttttgtattttttagtggagatggggtttcaccatgttagccagatggtctcgatctcctgacctcatgatccgcctgcctcggcctccccaaagtgctgggattacaggcgtgagccaccgcgcccagccgaactcatccctttttatggctgcatagtgttccatggtgtatatgtgccagattttcttaatccagtctatcattgatggacatttgtgttggttccaattctttgctattgtgaatagtgccgcaataaacatacgtgtgcatgtgtctttatagcagcacgatttataatcctttgggtatatacccagtaatgggatggctgggtcaaatggtatttctagttccagatccttgaggaatcgccacactgtcttccacaatggttgaactagtttacagtcccaccaacagtgtaaaagtgttcctatttctccacatcctctccagcacctgtggtttcctgactttttaatgatcaccattctaactggtgtgagatggaatctcattgtggttttgatttgcatttctctgatggccagtgatgatgagcattttttcatgcgtcttttggctgcataaatgtcttcttttgagaagtgtctgttcatatccttcacccactttttgatggggttgatttttttattgtaaatttaagttctttgtagattctagatattagccctttgtcagatgggtagactgtaaaaattttctcccattctgtaggttgcctgttcactgtgatggtagtttgttttgctgtgcagaagctcttcagtttaattagattctatttgtcaattttggcttctgttggcattgcttttcgtgctttagtcatgaagtccttgcccatgcctgtgtcctgaatggtattgcctaggttttcttctagggtttttatggtttttggtctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatggatgtagatgtgtggtattatgtctgagggctctgttctgttccattggtctatatctctgtttgggtaccagtaccatgctgttttggttactgtagccttgaagtatagtttgaagtcaggtagcgtgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtatcctcttttatttcgttgagcagtggtttgtagttcttgaagagatccttcacatcccttgtaagttggattcctaggtattttattctctttgtagcaattgagaatgggagttcactcatgatttggctctctgtctgttattggtgtataggaatgcttgtgatttttgcacactgactttgtatcctgagattttgctgaagttgcttatcagcttaaggaggttttgggctgacacagtggggttttctaaatatacaatcgtgtcatctgcaaacagggatattttgactttctcttttcctaattgaataccttttatttctttctcctgcctgattgccctggccagaacttccaacactatgttgaatagtagtggcgagagagggcatccctgtcttgtgccagttttcaaagggaatgcttccagtttttgcccattcagtatgatattggttgtggatttgtcataaatagctcttattattttgagatacatcccatcaatacctagtttattgagcgtttttagcatgaaaggctgttgaattttgtcagaggccttttctgcatctattgggataatcgtggtttttgtctttgattctgtttatatgatggattacgtttgttgatttgtgtatgttgaaccagccttgcatcccagggatgaagcccacttgctcatggtggataagctttttgatgtgctgctggattcggtttgccagtatttcattgaggatttttgcatcgatgttcatcagggatattggtctaaaattctctttttttgttgtgtctctgccaggctttggtatcaggatgatgctggcctcgtaaaatgagttagggaggattccctctttttctattgattggaatagtttcagaaggaatggtaccagctcctctttgtacctctggtagaattcagctgtgagtccatctggacctggactgttttggttggcaggctattattgcctcaatttcagagcctgttattagtctattcagggatgcaacttcttcctggtttagtcttgggagggcgtgtgtgtccaggaattaatccatttcttctagattttctagtttacttgcaaagaggtatttatagtattctctgatggtagtttgtatttctgtgggatcagtggtgatatcccctttatcattttttattgcatctatttgattcttctctcttttctactttattagtcttgctagcggtctatcaatttggttgatcttttcaaaaaacgagttcctggattcattgatttttttgaagggttttttgtgtctctatctccttcagttcttctctgatcttaattatttcttgccttctgctagcttttgaatgtgtttgctctagcttctctagttcttttaattgtgatgttagggtgtcaattttagatctttcctgctttctcttgtgggcatttagtgctgtacatttccctctaaacactgctttaaatgtgtcccagagattctgctacgttgtgtctttgttctcattggtttcaaaggacatctttatttctgccttcatttcgttatgtacccagtagtcattgaagagcaggttgttcagtttccatgtagttgagcagttttgagtgagtttcttaatcctgagctctaatttgatttcactttggtctgagataccgtttgttataatttctgttcttttacatttgctggggagtgctttacttccaattatgtggtcaattttggaataagtgcaatgtgctgagaagaatttatattctgttgatttggggtggagagttctgtagatgtctattaggtctgtttagtgcagagctgagtttaattcgtggatatccttgttaactttctgtctcgttgatgtgtctaatgttgacagtggggtgttaaaatctcccattattattgtgtgggagtctaagtctcttcgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaaccctgctttttttgttttccatttgcttggtagatcttcctccatccctttattttcagcatatatgtgtctctgcacgtgagatgggtcttctgaatatagcacactgatgtgtcttgactctttatccaatttgccaatctgtgtcttttaattggagcatttagcccatttacatttaaggttatattgttatgtgtggatttgatcctgtcattatgatgttagctggttattttgtctgttagttgatgcagtttcttcctaatatcaatgatctttacaatttggcatgtttttgcagtgtctggtaccggttgttcctttccatgtttagtgcttccttcaggagctcttttaaggcaggcctggtggtgacaaaatctctcagagtttgtctgtctgtaaaggattttctttctccttcacttatgaagcttagtttggctgcatatgaaattctgggttgaaaattgttttctttaagaatgttgaatattggcccccactctcttgtggcttgtagagtttctgccgagagatctgcttttagtctgatgggcttccctttgtgggttacccgacctttctctctggctgcccttaacattttttccttcatttcaaccttggtgaatctgataattatgtgccttggagtttctcttctcgaggagtatctctgtggcgttctctgtatttcgtgaatttgaatgttggcctgccttgctaggctgggggcgttctcctggataatatcctgcagagtgttttccaacttggttccattctcctcatcactttctggtacacgtgaaaaatcagaccacatttgatcttttcacatagtcccatatttcttgggagctttgtttgtttctttttactgttttttctctgaacttttcttctcgcttcatttcattcatttgatcttcaatcactgataccctttcttccacttgatcgaatcggctactgaagcttgtgcatgcatcttgtagttcttgtgccatggttttcagctccatcaggtcatttaaggtcttctctacactgtttattctggttagcccttcatgtaatcttttttcaaggtttttagcttctttgcaatgggttcgaatatcctcctttagctcggagaattttgttattaccgatcatctgaagtcttctgctctcaactcgtcaaagtcattctccatccagctttgttccgttgctggcgaggagctgtgtacctttggaggagaagaggagctctgatttttagaattttcagcttttctgctctggtttctccccatctttgtggttttatctaccttttgtctttgatgatggtgacgtacagatggggttttggtgtgggtgtcctttctgtttgttttccttctaacagtcaggaccctcagctgcaggtctgttggagtttgctggaggtccactccagatgctgtttgcctgggtattaccagtagaggctacagaacagcaaatattgcagaatggcgaatgttgctgcctgatccttcctctggaagcttcatctcagaggggcacccggccttatgaggtgtcaatcagcccctactgggaggtgcctcccacttaggctactcaggggtcagggacccactttaggaggcagtctgttcgttctcagatctcaaactccatgctggcagaaccactactctcttcaaagctatcagacagggatgtttaagtctgcagaagtttctgctgccttctgttcggctatgccctgcccccagaggtggagtctacagaagcaggcctccttgagctgtggtgggctttacccagtttgagttacccagccgctttgtttacgtactcaagcttcagccatggcggatgccccttccccagcctcgcttccgccttgcagttcgatctcagactactgtgctagcagcgagcaaggctccgtgggcgtgggaccctccgagccaggggcgggatataatctcctggtgtgccatttgctaagaccgttggaaaagtgcagtattagggtgggagtgtcccaattttccaggtaccgtctgtcacggcttcccttggctaggaaagggaattacccgaccccttgcatttcctggttgaggtgatgccccgccctgcttcggctcatgctcaatgggctgcacccactgtctgacaagccccagtgagatgaaccggtacttcagttggaaatgtagaaatcacccgtcttctgtgtcactcacactgggagctgtagattggagctgttcctattcggctgtcttggaacctccctcttggagcttgaataattttcatctgtgccacatcttcaggcttacctgattagacagcagtactgaaggaaatttctactgtgctttgcctttggtgcatactttagtgactttgggtagggaggggtcataacaaatatcactggctccaggaccttgtcaggcagaaaccataaggtggttattttgtgaaataaaggtttcacatcaggaaatgctttattgttgggggaacatttaaggaatctgacatttcactgagccaagattttgcgtctacaaatgtcatagtccagaaaattgtttcattgttcttattataaacaaatgtacatttcttattctcttcaaattttgtattaccagctagtattttacttaaattgtttttcttttaaggaatggggatttttttttaaagcattgttttatgtacaccaagatgaattacctttgagtggatcacctgctgagtagtcttttgaggttagtagtttgtcactggataaacaaagttaattgcaactcagatgcagagttctatgaaccttttttcaagttagttgaaaattagttgtaacggtgtctgtttctcagagtttgacagcttgtatactctgaataacctcccagttgaaacaactgaaatgtaaaaaatttataaagcatctttccaaatacattgcttagttggcatgaaagaagggaatccataaagaccaaagatgaaatgaaagcaggaatgctggaatgtgagctggattgtccctgaatgtttctgctggggaaagaggaaaagggggataggaaataaagcataattgggagtcggctgagacatactgtcaatgtaaggatgactgataaaaataaacttgccagtggagaggctggggatggggagtgaacagtaaggaaacttgcctatctttacctaggcactaggaggggtcggggaagacaggatgtgaattctcctaaaacatgagaaaggccatcacatgagttcaggttgacttggttgtaccaatgaggtccaaaatcctcatgccaaggatttaattatagtgctgtcaggttggttgcatcccaagaggcaagaaaggaaatgtgcatctctgaaagactgctacttcaacccaggcctccaagaatttccacaaataatgtttcaaggaaaatcagcagttcacagtaaagtcacaaatcagatgaagaaattcaccagcatgagaaattagagccagcagaaacactggctgctggccagtcaaatgatcagattcctagtgaaaaacgaatacggtaaatatacttacacagtgtgatgcttcttttaaacaataaacaagaagcttggaaggatgagaaataaataagatactgtaaaaaatgacctgccagattgggaaaatgactaagtagaacttctggaaattaaaaaaaaaatgattattaacattaaaaattcagttattaggctaaggaggaaatcagacacagccaaagcgataattagtgaaatagaatatagatatataaaggaactacctagagtacagcccaccacgaggtggacaaacattgagtttatagacctggaagtttataggcacagaaagagcagactctttccaaaaatgataaactacagattgaggcaaaccattttgcagaagacaactagaaaagctggggaaaatgcctgtttgaaggcatcacatagctaatgagaaagtgaataataactggtctaagatactaccatgagaatgctgtagctattttaatatgaaagtagactttaaagcagaaagcatcactagagataatacttcaataaaaggttcaattcagttttatttagatgtgatacttctttgtatatctaacatcatgattacaaaatacagggagcaaaaaataatagaaatatgagcaaaaacagacaaatccacaggcctagagaaacattttttaatagaccttttatgtgactgacagaatggctaaaagaaatcagtaaatatatagaagatttgaacaatctgattaacaacctaataggcatgtttagcatattgacacccaacaacttcagaatacacattcttttcaataacatatgggaatattttattttatgtatattttcttgagacagggtctcgttctgtcgcccaggctggcgtgcagtggtgtgatctcggctcactgcaacctccatctcctggattcaagcaattctcttgcctcagcctctcaagtagcttggattacaggtgtgcaccaccatgcctagctaatttttttgtatttttagtagagacagggtttcgccatgttggccaagctggtcccaaactcctggcctcaagtgatccacctgcctcggcctcccgaagttctgggattacagatgtgagccaccatagccagcctcaaatcacttattttaaatttgagtttttattaaggggaaggtactgatagttacttttattttttattttattttttttgagacggagtctcactctgtcaggctggagtgcagtggtgcaatctcaatcttggctcactgcaagctctgcctcccgggttcacgccattctcctgcctcagcctcccgagtagctgggattacaggcgcccaccaccacacccggctaatttttttgtattttttagtaaagacggggtttcactgtgttagccaggatggtcttaatctcccgacctcatggtcttccggctttgtcctcccaaaatgctgggattacaggtgtgagccactgcacctggccctatttttatatttacctattattcctagtttacagataagaaaatgaggcttagcaaggaataaagagattgctcaaggtcacccaactaaatagtgttagaactggggttttaatccaaacatatatgaccacagaactctatggtggaatttatttccctgttaagtttaattcagtaacaaattatatgaagatatgctgcagagatgaatgagataatgaatgtaaaattgccttgagagattcaaggaatggaaatgaactacccaaattagtgtagcaatttcactgtgaaattaaaagtagataattggagaatagctaagatcagtcattgccttttagtagtttagaagtcatagaacttttttgtttatagaacttttgaggtgttctctgaacatcatctgtgtcaaacacatggtaaaacagatgtttttccaagggattttagtggtttcaactttattaaaagtggcatttagtgagctatttaaatgttgatgatacggacgtattgaagatttactttagtgatgatcatctctagttcttagtattaaagactggaaaatgtcccttttatgccatgcaagttttattttgtatgtttcaagttacctgccactcagttttgtgccaagtgtgaaacagtgaatgaaaagacaaaaaataagccaataaacacataattgtatcttaagaaagagctgggtgctaggttgtgtacgtgtagtcctggctactcaggatgctaaggcagggaggatcttaggggcccaggagttggaggttgcagtgaactatgatcatgcctgtgaatagccactgtgttcaagcctgggcaacatggagagaccgcatctctgttgttgttgttgttgttgttgttgagacagagtctcactctgctcaggctggagtgaagtggcgcaatctcagcccactgcaacctccaccttctgtgttcaagctgttcttctcttcagcctaccaagtagctgggattacaggcgtgtgccaccatgcccagctaatttttgtatttttaatagagacagggtttcaccgtgttggccaggctggtctcaaactcctgacctcaagtgatctgccttccctggcatcccaaaatgctgtgattacaggcatgagccattgcgcccagccgagagacctcatctttcaacaaaaacaaataaatgaatagatcttgagagaagctctgtgaagaaacaaactgggtgccgattaaaagtggcatctaataaaggccaatgccagtaaaggacaggaagtgaggcaagtgttggaaccatctgcagttggctaagtgggaaaggactgtagcatgcaagaccatgggaaggaatttggattttatttcaagtataatggagaagtcattgaaagtttctaagggcactaacatggatcactttaaaagattgagatactgtggtggctgccatactgagaaaatcaagagtgacagtgggaagaccaggcaggaagctaatgctatagaccaagaattctcagacttggcactgtagacctttttagctggctgctaatttgttatagggctgtcctgtgcattgcagcatctctggtctctaccctttaggtgccagtggtagccccaccctcaagttgtgacagccgaaaatgtctccagacattttcagatgttgcctgggggtgaaagtgtctgtggttggaagccactgctgtagaacacaaagacttgggagggagacgacgacgacttggaatggtgtgatggcaggagaggtggagagaagtgcccagatttgaggccggctcagttagaagaggatttaccagatcttgtgggggtgatgggccgggaagagaggtccttcattcccccgtccttgctgggtttttcaggggctccttagcatttttcaatttactcacaactggttcttgctccttttcatgccctagatcttccaaatatctctgctttatgttttgaggataagaaagatccaccctcccctccctacacacaaagcaacaccatttttaaacattagagagatgatgagaatgcttggtctcttgccaggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttaggtgagaacacatgtgacttgaaaattgtgctcttgtttttgatgagaacatcaacaagttagtgcgtctctcattctctagtgatctgttacaaggtaaaaaaccttcaacctgtaatcatcaggaatgaagtgtctaaatagttcatccaagttttcattgtgtgatatctttgtagcttagtactatatcatgtagaaatgcaaggtcttcataaaaattgtaaagataggatttcagacttccaaagtactgctttttaaacaaatatatcagttgtctttgtatacttaatatctggtaataatcatgaacatttaatttttaaaactgtttagatttagaatccttagctttaagcttttgagtaacctttggctatttgcattatccctgttgttgatcttagtgtggatttagagccctcttattagaaaagggaatagactattgtcagattgaattgaaacccttcgcagttgctgctttgtgcagtgaactacattaacctcttgagaacgtcacttccgtatcagtcgtgtttcacagagagcctttttgttcccttttattcattctctgtgatttttccaaaaatgatatgctgctttataaattatttattgcatgaaagttgattttgactacagtaaaactcattaatttggggtcagttttttacacaaaagaagaattcagtactattaggccaatgaggttacttggtggtggtgaactgctgctgctgggtagattgaggataaaataggaccatttagaaatgcaaaatatatggtatataatgaggaaaaaaagtcccctttgagatctgcagagtggccctgtctaagataaagcagtcctaaaatgtgtttttccgtgaattaaagcacaggtcttagagtcaggcagatccacgttcaggtccttgatcaataaggaactatttctcccttgctcaaggtggtatgctttctgtgcctggaaggtatttaaacctagcgttgcttgggggtggcaggggagcagctgattccagctgcttctctcggggtcacaggttgctatgggcactttctgctggtcccttttttctgcaggtcccttggccctgaagaaagcactcctgggtttttcttgagagtctgttcagcccctgggcacctgactgcactcttcaaccctcttgtacttagatctccacacccctgtaggcagttctgttggacaggacccaagacaactgcatgcctgcttgaaattcacatctgtaaccctgagacagcaacccattccaggctcttcctctgaagtagttggccattctcctgccttttggatttccaggcacagtcccgttaacttgcaggtttggatcaggcaccgatactctgtctgtgtcaggctggggttggtagaaggtaataatcttgtcaccctcccatagggtgggggacttacaggcaagaacaagaggaaatcttatcacctgtctcctcaaaaccctctgttcacattctgacccttatttatatttggacgagggacccacgagtcacagaacagatttttgaccatttatttcagtatctttgtttagtgaatctgtttctagtcactttgatagcctgatggcttctgtccaaactgaggcagggatgtccccctaagggtagttacagccagcagttagtgagggcttcctgcatgccaggtacagcactctgttcatcatgcactgacctcatgcgttgctgcatccaaatgagacttgggtggcataagtcttcatataggtgctccaggagttttccggcacaagtcaggattaaacagtgattcttgtataggacaccatcatggatgttgtaactgtttcccaaggcatctgaatttctgccatttaaagccaaaagaggggttttaactatgccttaaggtgacatcccatcttatagatgtaatgaaatgcaaattaatgctaggagattttgttgggggggtgatatatttgtataaccttccttctgaaaggttataagattttcagactggaaaggggaaaccttcagtgttcactagaactcatcaatttaaagagaagcatggttgaatttgaatgtgccatatatcattagcacagagcgccctattgagaataaaaactagagatgagtcataaagtacagcggtaaagtcagagcttttattaatgacagtctacaaatcaccttgtccttttgttattcacttctgtctgttttataattctgatgtgctcatagttaatacagattgattattctttgacagctataatttacttcatttttcccccatactttggtctctttaaaacattaagccacatgaaatatgttgcctgattgaggttttttaagaaagtgcattggagaatgagcaaattacttttggctgtatgagttcttctttatgtcctcacttgagaaaacaaagtttgccatactaatctcagcagcccaagatcaaggcccctggtgatcctcagagttccctctttccaacatcttttcatgtgggtaaattctagcatcctaaaaacatgaactgctagtttcttgggttataaaaataagcagtgtcaagaaccccccccttccacatgaaacccaagaaaggcttgtctgttcagcacatgtgacctgtcccctacagccctgtcctcacttccacttgctgcggtgtctctccctctgggtgacctggccctacctcaggcagacctctgtgcttgcccttcgttttctcctttcctcatcacctctcactcctgctctcccagctctgtcactgaacgctgtcactgaaagttgcagccctgggagttaagaactcatttctctaccttactctccatatccctgcaggcatcaagccctggctattcttcttgggaaatacctttcatttgttttctttcctgcccagactttatctcccgcttgatgtggtgttctccccggcttgttgcaatagtgctcttactcttctcccctccgtagacttccattgttctgcattcagctgttagacacgtgcatcctttattaatgccatctttatgttgcccttgtgttcagacagtggctccacagtcacaggtaactaaactgctctctacctggctcactggatggcctatcaggccaccaccagcatctccatctgccccaaactgaacaacacttcctcttgaaaacggatctctcgtttgttctctttaccagtcttccttctgtcctttctattcctttcccctctcctcattcctggctgtggccttcatgccaggagtggcctatcttcctgcacctcatccagtaggatgctgtgcttttcttgctagcacccatttcccctccatctccacactcctgcacttgagactcaattcagcccttgctttagggctgtcatttgttttggatcctcaacccaccagtcacttatccttgtttatggtttattacttgcatttttatatgattttgtctcacgagcagaatcgacctcatcttactacttgtctctctagcactttgcagggaatctggtggataacaagggcttattacatttttatctaataaacaatcctgtcagacatgaaccgtgatttggcttttattgttttcctccttatagctcctatagcatgataataggcacaaaataggaaggcagggttactattccacacattatctaggtcatcaaaagcccctggcccaagagtattttatttccttgggaaataaaacagtcatttattaaaggaatatgttgagaactagataaatgattaaaaccaattataaggctgggcgtggtggctcacgcctgtaatcttaacagttttgggaggccgaggtgggcagatctcttgaggccaggagttcaagaccagtttggcctacatagtgaaaccccgtctgtactaaaaatataaaaattagccaggcatggtggcacacacctgtaatcccagccacttgggaggctgaggcaggaaaatcccttgaacctgggaggtagaggttgcagtgagctgagattgcactactgtactcaagcctgggcgacacagcaagaccctgtctcaaaaaaaaaaaaaaatgtaaaagtgactttgcaagtctcattgctgcatagccctatgtgtagctctggaactgttgctcaattaaatgtgttttcattaattttttaaattgcattaggttttttctcttcttatcctttcagaatggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtaagtgttttttcactgttgctgttcactttaaaaatccgactggtgtttgggtttctttggggaaatggaagtataatgctatgttattgaaaatcacatatgctgtattatagccaaaattacttaatgggaataaaacggtagaacagatgcccagaacaaagggaaatgtaaacgcctaaaatggcactctcattaatcttatattccaagtctctgttcctctggaggcaggaacagctaacgttctagattgattaaaaattagtaccaatgggccaggcacagtgtctcactcctgtaatcccagcactttgggaggccgaggcgggtcacaaggtcaagagattgagaccatcctgggcaaatggtgaaacccgtctctactgaaaatacaaaaattagctgggcatggtggcgcgtgcctatagtcccagctgctcaggaggctgaggcaggagaatcacttgaacccgggaggtggaggttgcagtgagccgagatcgcgccactgcactccagcctgtcaacagagtgagactccatctcaaaaaaaaaaaaaattagtaccaatgaatacaacatttgattcagtctttggtctatatgcatgagaacacagtgcagatacaaaatgtaaaatctttagctacatctgacaaaaaatgttttctggaataagctgagaatcaattctgctgttgttaaactgaaataaaatgtaattctaaaagtatagtcttacatcatgaaaacatgggtgttatttggttctagtaggaaagggaaacacttgttaagttgtggttttacatttcatggtacgggttaattttccccaaagtaaacatagctctctttttaacttaaaaaaaaaattggtcacattcattttgctttgttttgtttttttcctccattctgtccatctgcactgtttttgtagcgtcatggccatacacacactgatttgtcccaggagtctggctcagttagcagtttgcagttgaccaggcagaccctgtcctaaaagcaatctggctgaaaaaagtctgcactttccttatgcacatatgttgaactcctccaaagtgctttttgtcccactcagttttgctgcagtcgtttggtcattagacaaaaaaagcagtcttaggggagagcaaggcaggtgctcaagtggccctgtcctcctcttgggatttggccagttgacagtgatgtctcatcactgttattttgagcctctgagtcacagagcaggcaatccataaggaatcttatagtggtggtaggttgctgtcagggttattaaaaccaaaagaatgatgttctgtaaataggtctgatagtataccttgaaaacctagccaggctttactttcccaagcaccttgcagcggatcaagagaagctaggaaaagcacccacaagaatgtggaaaccatgcaagggccagaagccaggaagtgaccgttcgagaattcgacttcagggtgtcctgcacctccccccattccctcttccccctagaacctggagtacagcagcagccagtggacagatgaggaaaatcatttcttctagatagccattcttagcccactgctgcagggcccacagttaatttcctcaaatttacactgggtacagaagttttactttggaaaatttcgtatcttaaatagtttaaatggataaagggcaatgaggagggcagtgagggtgactcacctgctcttaaaaaaagctggagtccccaaaggcctgtaaacctccttcagtgaccgcatgtgaccatttatgtcaggaacaagctcatcattacctggggaagaaagggcttattgtccaagtgtaaaatgctgggttctgtgccaaacaatgaaatattacccgtgactgtggctgtgaaatttgaaaagagaagtgtgttcctcgttctgtactgccaggcattttctgaccaagctttaattttctgaccaagctttgtctgtctccttttactagttttgcctccatttttctcttttctctgccgaatgcaatttgatttctaaaaccagagaatggggcttccggattcagatcttgtgagaccaaatgcaaaaacagccatcagataattagattagatctcatgaaagcatggattgtcagtgtgggtatatacacataggctcacaagtagtcttgcactggtgtctgaaggctagctgttcactactacagtaaagagcagaggtactcaattatatgtaaagccccagggtcacaaataactgcagctccagcttcctgctgcagacatttgataactctggcaggtgcacaccagctgactttgttttccttggaggtacatggtgaaaacacatcttgagcccaagccatttatgacttactttggcaccttgagtcacatttggaaaaaaacaggcagccatagcagcttagagcacagtgcacttattctctgtggttcaaaccacttagtggttgaaccggtgaactctgtacttgtggaaccttggagagttgcctagggtgagctccagacctgcgtgttgtaataatccagtagagcagtcccatatgcatggctctgggagtcaggggtgagaaatcatagaaaaacctttcacggatatcagggaaaggcaaaactttttgagacttgtttttgtttttttctttgaataatgttaaaacccaacctaaaatcagttaaaacaaaatctccatgggttacaaagtttgccgcctttttacatacgtgacttttcggatcccctgattcttgttttggtaggttctcctagagttgtctgtctttctcctgactactcctacttctccttacatttatttcagattacactgggaacataccaactgatctccctgcctccttctcaagtccagataccttctctggccttaagggacttccacagttcagttctcttttttcacccttaaactttgaaatttatttcctagcgatcacctgaccaactctggtttatgagtctaggatgttttcttcaaaccccaccttccttgttcttatcctctgagccaaatcagatgggacacaaagcatcattagattatagggattcacattatgctgtgaatatgcaatgggctaacctagatggatctataaacagaaagtatcgataaaatatattaagtgccagtaccttcaggtttaacacagcctccttcaaggtaccacttctggtgcacaggacagaagaatagggaggtcaggcatttgaaactctttccgtgtacagtaaccagcccctgttgcatatttatttcattctgtggttagatttgatgtctcaacctttctagataaacaggcatttagagtatatttcctactcattgtctttcactacagaacttgcattctagtactttggtgccttgtctcaggtcactgagctagcaactttcagagctgggaattttggctccctaggcctttgtcatttgctgtactacaggtcgtggtgatgccagggtgaggcaggtgctcaaatggtgcatgcttggtctgcacgttgtctttttgttgttgttgtttgattatttatactttttttcaaggattcacatgctttttgtgtttgtggggggcaccgggtactgatcaagaagctcttaaaaattaaaatataccacaagagatagccttttaccccaagattacatttatttaggcaagtacagtattcattatatctggtaaattagaatacatgctcacagaatgcaattggaagtatatataaaggtatattctaacaaatatccaagcataacttaaactaagaaagtcaatacttgagtcatgttatacatcttactgtcagcgttaatcgtataccctgttatggtaaccttaaaacagtttgtctgcaatcatgagaattgagacaacattcataaggattagcagctgtgctgttcacggatctaaatgtattactcctttccggtcgggggcagcgtattgtttcccagctgttagtgaagtgcatacacagaggagtcgagaagaaagaaaggactgacattttaataatgattattccatttaaatgtgctctgtgggagtaccgtttggtttttggttttccagcaagtactgatgggatcactaaatcaatttttcatatacttgacagcatatgctcaaagtattatgtggggaggtgctatttccacaccagccactctgtggatgactaattctgttttataaaccacagcagtgtcattgttttcaaacattaatgacttgtcttattatttctttgatttagttcttaaatgttagaaagtagtagcattaaatttgggaaatgtttaattagtgttacatacgctggaattcttagtatgtatattaatcattttgtgtcgtgcacaattactgggacaatccaaattggaaaagcaattttgaaatatctactgatcatctttggtccgtgattgctgtccacatgagtgtccacagataggtaggtgccaggtagcaggagccccagagtgtttgtcaagagacccctgactggctcttgaccctgggcaaatcacttgagttttttgtcagtcacctcccaggtcaaatggcactagatgaagtctaccatttttttgacctgcattcctaagtgacccagcttggggaagacgagttaaatttctgcaattaggtttctcaccttttctcatattcacagaatgcattagaatcttctaaaatgtatatacttactagtgttataaaaaagaaggctgcatgagatggtgatgatgaggatgaacacttacatagcacccctcatgccagactctgttctaagcacttgtctgcagtgagccttcgactgtggtggggattaaccaagtccctgataaatgatcctctcttgccattgctggcatttggttgtggtttgtgatccttgccccctttgaatctagtgagtcccgtagactaaaccaagccttattctactttttaggtatcatttatcactgtgatcttaccaaagaggagctggagccaagagttttccgagaggtgaccgtaaaaggaattgatgcttctgattaccagacagtccaggtatggagaatatgatctcattaatgtgagagttaggaagtctgactttcaggctgggccattcacactgtagcttatcagaagcagtggaggtaattcatgacaactagtattttgtagcccccacggttgacggtcattgagccaaacactcaggattcagcagtgagctggcatagtcgctgccctcccatagcctgcaggttctgctcctatggctgctactcttgacaggaagctggagttctttctcttggggctcctattgtaacatttctgtctgtgtcaatctgcttgcttgaatatggtttgtgttctagctcaggtcttttggtgttgtaaataacatggggatttgctctatgtaaagtatggacttaagtgctgtgagtcagtgtttttagtctgaagttcatgtgcatttctgcatgacacagagtagacactcaataaaacatttgaatgaataaattaattaattgtcatgtcaccacaagcttcgtctttggccaccatcttttcaggttaagaatctccttttttgttttttcagctccccaagggtactgagtcttccagaaactgaatcactggttgattgatgatgacgaagaatgtctctgttcctttgcaatgagaggtcaccaatagggcaccaggtgtttatcaaggcccctcccacctggagggctggaccacacaggccacagattaggaatcagaacattgtttgtgaaggaagatgagaataaagagcgctggatgttccccacaatgtttctgtgaaactagggcattattatagcttggtgaattacccttcaattgtctagaaatggtctagatgataggctacatctagatcatgaataaagctttgtttactaaaacaggtggtgggctggatttggtgtagagctatgatttatcagcccctgttctacatcagcagttggcaaactggcctcctgttttattggagaacacatgcccatttgtttacatattgcctgtggttgctttggcacttagagtggttgcaacagaaactctatgtcccagaaggcctgaaatatttaatatatggcctttaagaaaaagtttgcagaatcttcatctatgtaaatagcatttaaaagtacaacattcttgatagacatacagggccgagaagacatacagggtcaagaagctctgtcagacaggcctgaaatccacgtggggcaagtcatttaacctttctgccacagttttttcaactgtaaagtagagattgatagtatctgttttttaggattcctgtgggattattaagagataaggtatattcaagatctggcaatagaatataatctatttttttcaatcaacgttagaaataaatgtaacagacttttagtttcctatttatttggctgctgcttattttgttttcatggtgagccattgcctggagggagatcctgtaggggcctgtagcccctgtctggtattttcatggttcataaattcaccctcatcctataccaattttctaacatctgttcacttttagtctggcattctttgctcttttttttcctctaatttgtagaaaatgtgtccctatcagttgtgacatttggttttctcagggccttgttctggtccttgcctgggtatccccagcaaggataggtgtgcctctcctatcaggaatgtcagggacacccaggcagcacccagcaagtgttctctcctctgctctcaagagcacactctcagctgccctaggtaggacggggtagggttgcacgagagagatcctaatcttctcatgtctatgagggggctcagctctgtgtaaaaaaagatactgttttccccttttttccacttcccacagacatttagtacccaagtgtataattgcctttggagtctgggaaagggaaggacccctataataatgacaactgccagggaggccgcttcttccagggaaatatctcttactgcttagtatgattggggtgtttcctctattagatggcttttttttcctattctgataatggtaatattctttatagatgacaagctagttaccacctaatatatattgttttcatttacaaatgaaaagataaaacatggcagctaagaaagtgcttctgtggaatacaaacctaacagccacatacatagcagcctggaatgtccaggttaaaccgtggagaacatgcgcttcggcgctgccaggtgcctgtggcactggaactctcccagaatttccctgtacctggctctccacttcccaaacaaaagttccgggcattgagcctcttaaatacttacagttttttatttgtactgctgtaataggaggaataaaaagactcatgataaatatttaaacagtacctggatagtacagatcttaatgcgttgctcttcatttccatatttagaaaatgcaactttgcccataaacagggtatagcctgtatgtataatgccaatagaagatttgtatctactgattatatacctcatacacgtagtactgttattaaaatagaattctttcgttgtgtaaaaggtgcctttgaagcacaatatgatgtcacaacatcattgacttgtatggcttaaaatctgttgtgcagtggtttagattcaagtgtatgtgtgcagcagagctttgacatgcaatgagagcgtgacagatgttctcacattttgattaggctcttggcagtgttgccaacaatgacctcccattgtaaaaagcagactctggagagggatttgtggatgaatggaaagcatcctaaaggtgtgtaatagaagccacatttttgcttctattacattttattttcattttcaattactttaggataatgttacttttgattccacttgaccctggggtttgtatttacctcataggtgacttgaaaagagtatcttatctcccaggctatgtttcatttctttgttcattccgtgaggcatattatcattttgatgtgaatactgcagcacagattactgtgcatggttagtcaacactatgaccaagaacctcttttaatggcactgcctacctggtggtgtagctgataaaatagaccagccaaggagaaggagaagggccaaagaaacatggctaaatgagccacagagtgctcctctttgtgtgatctgttaatatattcccttaagaccctgagcatctcgactgggaaggtgagggatctggtgtcatattttacagacagacacaaaacagagctgctctctacacagccttcatccattcctgattatagctgtgggtagaaaattgatctgtaccagaaatacagttttgaaaatctgatcctagaaacactgtcagtttatcttccaatctggaacacagataagaattcagttttagataggtttatcaaatctgcaattgattcatctttttcctgctttttattgtgaatgatacaaccacgtaatattgattaaaatttgtgtgccattgtcttttaaaaagaagttgaaatattgaacatagaaattatatttgtaaaacagatttggtggtaagtgaatttacctgaaaaatctgtctacatttacagtcagcaatatgtttcattttaaacaaagtgaagtaatagggaaatgatagttaaatgttgcctatcaataaatattcatagtatgatatgcaacgccaggtactgtttgaatacaaagaaattccagacataagcactgcccctgactagaaagttgaaacatacagatgtgaaaagattgaagaacccaaggatgttatcacagtggtcaggggaaaggcacaggcttcggtcagtgctgtggtggtcagaggccatcctggcttgggtaaaggaggaagccttcacaggagggatggaagttgggcagggctttgagggaatgggtgttttttaatgcccagttccccactgagattcctgaacaattttaccactgccctttgttcaaagactgcttctgcttttttgttacagtaaattcaagaaaataataatcctactctcagtaccctgtgcgatggttgcctggggcacttctcagttgatggaatagtgtactgtggttgaatgtggtgtcacaaaggaatttaatgtagcaaaaatacactttgattcctcagtgtttcatcattgttcagccagctagagattggcttttcttcttgcaaaatgaaagacaaaatttatagacctgaaaagaacacttaactgagtctataccctgaatcaactccattaacaagcatctacattttataaaagtcagtataaattaagagaatccaagtactcatattttaagaaggggagcaaacttaatacaaaggaaaaataataaagattttataagtagttaacattgattttattatctttactgttgttctcttatacttaataggaatttggcttttctggggattacctgctatagtacatatgaaacatcagtaacatccctaaggcggtttgctttgcagccgagccaaaatgctaaagtaagaagaatctttggctttaccaacatgccttggggtggagggagtgggattttttttccctttaattcagatttttctaatcttagtgatagctgatttgtgcttgctagcatataggctttgccattcaaagaacatattttcagaacattaattcgtgtttcaatactcattaacttctgcgccaagttcatgacacatgcagcttttgagtgttgactcatccacatccttggtgagctgactagtgaacgagtggcagtgtcttcccatagcagcgtgttcgtgtgattgggtataggtcagaaattttcagaacgttttagtgaagagtgaatggggcagcattttcaaaaagaaactttctgaggggtcactctattttcatatggttaggaaactgcttgaattggtatcggttcttgctgatttattgcctgagcatttgtgttatttctgatattacgcttcatggcaacatattttactttagaatttcccccatcatgcaggcattctagcttgagagcgtagtgttcatattcagagtgtacatacttgtatccctttctccttctctggataccagctgtgtgactctggaagataagtctgttttcttgctgtcttataatagagaagtaagttatgtggctgaagtctgtagttgctgcagtctctgctccactgtacataaattctctaccatgtctaaaagaggacattactctgcagcaacctgagactacataacctatgatatggtgaatgggtatgtgtcagctggcttataaagatgtttgttaggaagtgacttgcatcctctatctgcttatgtcttattggtgaaaacatactcacactcggttgcaaagaggttttgagatgtagttttattcccagaaaaaaaaaatgtgactagctaaaaattagggcctttttatcaaggaaacaggaggaatagatagatattgcgggacaactagcagtctgccacacaaggcaaaaaaaggcctttggcaagagctttttggtgtagaccctgagatcagggcacccaaatgccacctggtggccaggtacctaaatctcaggatcaggattggaaaaatgaaggctcctaaaaaatagaattttcagatactgtaattgttgacagcagaaatcacatactacaaagacagaagcacctgttaaggaggcactcctcccttggagaaagaaatttaatactgtttctagaacatgaagcgtgatgcaagcgtatgggaatatttgggcattaggatggactctgagggattgcctggcacggtgaggaagctgtgtaagctagtgtccagatggctctccaggtgtttgattctctgctaagtcagcatcttgcctggggtgaccaactcccaactgccctccttcacagtccctgagcaggatgtggacacagtccatccttgggcctggtgtttggaatggaagcatggcacgaacccacctacagaaaggtaatcaggtccctaatttcatagctgcctcctttgctttttcctaggtggtatgtttttccactaatatgattctggcctcaggacaagttatatgccttccaattgcacgtacattagagttcatctaatggagccctcttattttacagacaaggaaactaaaattcagtcagtgtaagtgtattaacagaggttacactgttaacagttgacagagccaagactagaacttacaactccagatctatgctaatcctgcacattttgttatcaagataagttattctcgctatagctcaggatttttttttcacctcttaaataaacatgttagccaggcacagtgccttatagctggaatcccagcactttgagaggctggtgcagggagatcacttgagaccaaaagtccaagaccagcctgggtaacatagcaagactccatttctacaaaaaaatatatatatttttttttaattagccaggcacggtggtatacaactgtagtactagccactcaggaggctgaggcaggatgatcatttgagcccaggagttcaaggttacagtgaactatgattgtgccactgcactccagcaagaccctatctctaaaaaaaaaaaaaaaaattaattagactaaatggcctctaaatccctaagctttcttacctctaaaaactatagtttctacaccatgtaagtatcttgtgattactttgtagatccttacagaacctattagataacaatactcagtgtaaaagggaagacaatgagggaccacaaatttatatttttatgatttgtaaatatgatttatttaatgacttgttttataaatagttttaaatactaaatattttataatgaatgttaatgttcacttctagtctccttgttacatattaatggagattttactgccttttccattagtttatttatgtcatacaggcataactcgttttattttgctttattgtattgtactttgcagattcctcgttttttaaaaactgaaggtttgaagcaaccttgtgttgaacaagtctgttaccaccattttcccaacagcatgtgctcagttcgtgtctgtcacattttgataattctcacaatgtttcaagctttttcattattacatcacagtgagctttgatgtgacgatcgtcattgttctggggcatcacaaatgcgctcatagaaggtggtgaacttaactgaaaaatgctgtgtgtgttctgactgctccatccgtcagctataccctcatctctctccctctcgtcagaccgccctattccctgagacataacactgttaaaattaggccaaataataaccctacagtggcctccaaatgttcaaatgcaaggaaaacatgcacatctctcactttaaatcaaaagctagaaattattatgcttagtgaggaaggtatgtcaaaagccaaaataagccaaaagctataggtgcctcttgcaccaaacagccaacttgtgaatgcaaaggaaaagttcttgaaagaaataaaaagtgctatgccagtgaacacatgaatggtaagaaagcaaaacagccttattgctgatatggagaaagtttgagtggtctggatagaagatgaaaccagctgcaaccttcccttaagccaaggcctaatccatagcaaagccctaactttcttcagttctgtgaagactaaaagacatgagaaagctgcagaacattagggagctagcagaggttggttcatgaagtttaaggaacgaagccatctgcacaacataaaagttcaaggtgaagcagcaagtgctgatgtagaagctgcagcaagttatcctgaagatctagctaaaataattgatgaaggtggctgtactaaaacattttcaatataggcagaacagccttctgttggaagaagatgtcatctaggactttcatagctaaagagaagtctgcctggcttcaaagttccaaagtttcaaagttccaaagttccaaaggacaggttgattctattaggggctaatgcagctggtgattttaagttgaagctagtgcacatttaccattcttaaaatcctagggcccttaagaattgtgctaaattagctgggcacagtgactcatgcctgtcatcccaatgctttaggagaccaaggcagtaggaactctcgggccaggagctcaagatgagcctggcaatgtggtgcaatcccatacaaaatttatctacaaaaaatttaaaaattagccaagcatggtggcatgtgcctgtagttctagcttctcaagaggctgagacaggaggatcacttgagctcaggggttcaaggcttcagtgagccatgattgcaccagtgcactccagcctgggcgacagagcaagactttgtctcttcaacagaaacgaaaaaacaaacaaaaaaagaattgtgctaaattcactctgcgtgtgctctagaaatggcctggatgacagcacatctgcttacagtggtttactgaatctgttaagcacactgttgagacctactgcttagaacaattcctttccaaatatttactgctcattgacaatgcacctagtcacccaagagctctgatggagctgtacaaagagatgaatgttgtgtttatacctgctaacacaatatccattctgcagcccatggatgaaggagtaattttgactacatttgtaaggctgtagttgccttacaaatggatggatctgggcagagtaaattgaaacccttctggacaggattcaccattctagatgccatgaggaacatttatgattcatgggaggaggtcaaaatatcaacattaacatgagtttggaagaggttgattccacccttcaggaatgactttgagggattcaggacctctatgggggaagtcactgcagatgtggaaatagcaagagatctagaattagaagtagagtctgaagatgtgactgaattgctgcaatctaatgaccaaatttgaatggatgaggagttgccttcttgtgaatgagcaaagaaattggtttcttgagatggaatctattcctgctggagatgctgtgaacattgttgaaatgacaacaaagaatttagaatattccataaactttgttgataaatcagtggcagggcttgagaggcttcacaccagttttgaaagaaattctactgtgagcaaaatgctatcaaacagcattgcatgttacagaagtctttcatgaaaggaggagtcaaccagtgggcaaacttcattgttgttttaagaaattgccacagcaaccccatccttcagcaaccaccatcccaatcatcagcagtcatcaacattgaggcaagatacccctccaccagaaaaaagattacaactcactgaagacccagatgatcattagcattttatagcaataaagtgtttttaaattaaggtaggtacttttttttaagacataatgctattgctttgtacactagtgtaaacagcttttatatgtactgggaaaccagaagtgggtgtgactttcttcttttttgatacttgctctattatagtggcctggacctgagctacagtatctatgaggtgtgcctgtatagacacacacttagatttttatttaagtcttagtgttggtcaccatgtggcagcttgaacccccacttgaaatatattcagaaataaaataaaactttatttactcttttgcttttgtcatcttatctctggttgacttctctcaggatcatattcagggattggcattcatgccaacgctggcaccagccaccttctaactcaaattcagaagaatattcacagatctgttttggaaattgtagcccaagacctctgccccttgtgcggtgagtctggatggccacttctgtactcataaaagcaggtgatttttctacctgcagggttacatctgtcccagtgtctctcaccctatttctgcctccctaataggtgatggtagacaattaataggattagcaggccatctagaaacacaactgtgatcattgtttagatttgctctgcctagagaaggcttggcagaaaagagttgggggtaatcttttcctgcttttcttaaacccccggggcaacattttagtttgccagcaaaactcaactgtttttggctttctgccatactgttttagaacaaaaggagaggagagacaataggagcttcgtgtgggctgtccacctgctacacagatttcttccctcccctcccctccacttgctttgcctggagttacactgatggtcgacgggtgatgggtgagtaaaaatagacccagtgctggggatattccattatctccctaaaggaaaaaccattactggcattactgtcattggtctgtgaaggagggaggaaaaaatttccatctccacaagtgtagtcttttgatttggattaagtgtaccttgacctggttttagggaggtagactggattattctctgttcaccctctgtgctgactcaatgtaagatatagacagaaatgttgtcatagttataaaaatggtagtaaaatattgtgaagtggaaggcattgtgagggtacctcatagaaacacatgcaagttccttgtcattgtctgtgttgggtacatgctcctccacacaacttttgatgctcttcttcatacagccgcgccccagtgccgccccgtagccccggaccaccatactcagactcacctctgcctcgtttctccatgacccatcctggttctgctcatttttctttactattttctgaaattccacacatctttcaatattcatccaaacgccaactgtcctgtagaagcttgtcttcttgctcctgcccctgggagctcagtgtaaagcagaagacggggaaagaggacattcagctgttagttgaaaatacagcatggatgtgtgctcatgttcttcgtacataaactcattgcttcaaagttgaattgccctgagaagtggtgctggcttctctgatcaggctgtcacaattaaacagttgagtactctgaggtagttagttctgggtcttcatgcagaaattgatataaaacactgtggctttgttaagacactagagaaagcttcatcatttatgttggttcatgtctcaaaagaaaaatttaaaccatcttctcaggctgaattgacaaatgcagcccattttaattctgtctttaagagcatctaccagttagttctgaatcaagtaatagatgactctttgtttcctcctagcctctatgtgtgtacatttgtatacatatgcctgtatagaagtagccataaacattaatatatgcatacaagcatgtctttaaacagcatgcttttttgatctcagttcaggtagagggtgattgtgaaattggctttcaaatagaaaatcatttagcctgcaagtaaaaaatcattatatatgtgctacctacatctggagcctcaagttttctgttttgcctaggatatatctaattcaattccagaatttaatatgtatatagctaatttaagtatttggaagagacttagaaagagtataatctgaactgtggatggcatgttgtttaagaatctgcagatttgattgtgtttggaaatgctttgacaccattgctcagaatccttagaaataagagcaacgaaggagtgttctgggattcctaaagctcacctgtttggatttacaattcatttatgtctatgtatggctgcctttccttgccttcatcagaaattctctgtcagcattgatgggtggaggtgggatggggaagaacccctttcattcatcccgtcagtttgtttttattgagaatttgccatgtgccaagcattgttgtaaacactgggaatgtagcagcgacgtgaagagatgttgtctttgcccttatgagaaatacaggcaaaaacaagtgaacagaaaataaatgtcagcattgcaagttgggagaagagctgtgcatgaaataaacaaagactgcagccgagaatggcagaaggccctgtgcagttggagtggtcacgggaagttcccctgagttttcacttgaaacctaaaggctcagcgggagctaaccaagtgaaaatgggggacaggcggcccagaacgttaaagcaaaggccctgagaacaaagcacttggtctcagagaggacctaagagaagcccagtgagtaaggggggagtggatgaagggcagggggaaggcagagagcctcatggccgtgttagggaatgtcagattcattccaagtgtgatgggagtcactgcagagttttatactggagagagacatggttttgatgtaagaaaatcattttccgttttgtgaagaacagattagagggggtgataaggaagcagagagagcagatggacattggtagcagtagaccagataagagataaggtggcccaggctagagtggtgactgtggacaaggtgggctggtgagtttggaatatacctagaaggtagaattgcgaagacacactaagggattgcatgttggaaggctgagaaaaaaggatgcctgaggaatgactgagattttgaatctgagaaactggtaccatttatcagtgagttggcagtgggttgtgtaggatgagattaggaggataaatattttggacgtgttaagtttgtggtacatgttaaatatcatccaagtggcagtgtcaaatagggagttagatatttgagtctcatgctcaaaggagagatctgagttagagttttaagtgggaatcttcagcataaatatgttacttaaatccagggacaagggcaaagtcacatgcagagcatataaagagtggagaaggctcaggactatgcctggggcagccccacatctaggggggtcagttgaaggaggaagagctagcaaaggagcctgagaagcagcagccagggaggtgagagctgaaccaacagagacctcaccaggcagagcaggaagtccacgaaaagggattaaaaggagggagtggcaggcaacacccagtgctgatggttgggcaaatgaggaaggaagaggagttactggatttgacaaggtggattattggtgatattgataagagcactttcagtgagtagtagggctgatgagggctgaacagggtgtatcaggaaagacaagagaggaggagatagacgctcttatcacaggtttctttatggatgggtgtgattgaagatggggagaattagctatgcttttacatatttttgtattgcatttttgctagttaaaataatcttgtattaatggtatgatgtgaaaagcttattaaaaatatttaaattttttaagaaaaatacaatccctggctacgttaatcacgcatctctgacttttaacagctgtggtttacatcttcccactctctctcttcttccgattacttttcaaatttgatgttttcttcctttagaataacttgtacagctgtgctaagaaaacctataaaaaaatcaatcttaattacataaaactttaccaacaaggctttccatagcttttgtgtcattaagttcaggacccgggagaaggtaggagaggggaagaaaatgggctccagacaatgaaaagttgcatggggcatatgagttcaatggcatgttaagtgagagaaactagattgccttggtgcattgatagtttggttctagagggagagaatcactcagaaacaagttcccttgagaaggggaagagagccacagccataagaagaaggattggccttcaaaggagaaggagcgttttctccattctgccaggagggaatgagtgtgcaagagtgtctgggggcgtcagtgcagggaatccaagcaccagctccttgctctccttctgtgagacctctcaggccttgaattctccatttgcttacttattttatcttgagtttcaactaaaaaataaaaaaagaaaaaagaaaaaaaggtagttttccagcctggccaacatggcgaaaccccatctctactaaaaatacaaaaattagccaggtatggtggcacacacctgtagtcccagctactcgggaggctgagacaggagaattgcttgaacccgggtggcagagtttgcggtgagtcgagatcgcataaacacattacacccacaatattgagagtttgtgttggtgtcagtttggggaatgatttatatcattcttgatgcattagtgggctgacatcctggctggggtcagtgttagcaggcagggcagtcagttctgagatcaaaactaaaacagtagggactcattgccattttttcataggataaagtggctacttaataaatagcctagccctcgtgatcacatttggctgccagtttgaccagccttgagcaatgcccttgagaccccaccagcctggcccctgccctctccctcactcatctcctgccactctccctcacccgcctgctgcagccgctctggcctccttgctttgcttggcatacatgcatgtactcacccactccacccctcccctctgcctggactgcccctactcctggccctccatcctctactatacagagtcacttactctgcatggatcagagactccttcgctctccatcctgtgtactatagcagcccttccccactcacttacccgtatctccattgcactcatcaccagctgacattagattttcattcatgtgtctgtctgtctcccctttagaatgtggttttccccactgctgtgtccccagagtccagaacacagagtagatatgtttaagtacttgacgattgaaagtggttgtgatagatagagtctgaaatgatctggttgttgccagaaacctataaaagtgaaactttttttttttttaatatttctgtgttggaccatcttcctctcctctggtagggtaatttgtccactagaaatggacaaatgttgccagaaaagtgaatgttgtactacgagttttacttctgtgaaattttttgtgtgatctagcctttaagagttattttaggccatagtttataaccaaaacagaaaattatactatgcctcccttatagagcatcaaagtaaatttgtctattttcctagcatgcttttattgtactggagccctccaactctaggttgttgcatgtgtacacatgtttggaaatcttttagacaagttgaccagtaaaaaggcaattctactgacatgtaaattcagttgacccattccgtattgtgttttatgagaatctaggatcattagtttgtatttatttttttttcagcctctggacggtcaaatcttcattcttttagtggcttttggcttttttaacatcatctttttaaaaaatagcttctttcatgcattcaatttccttttccttcttcacttctcagtatttgtattggtttatgtgcatgttttcttcattgtgtttcttgtaatgtcttgaatgctgcattagtctaagtgaggccccagaagtcaccgtgccccataaagagaccaaaggatgctaaagatggtgatggttgtactgactaatcctaatttaaataaaaaggaattttcaagtgagaaatcacagtaagtgtctaagaatgactgagtgtggccgggcgcagtggctcacacctgtaatctcatcagtttgggaggctgaggcgggcagatcacctgagatcaggagttcaagaccagcctggtcaacatggaaaaactctgtctctactaagaatacaaaaattagctgggcatggtagtgggtgcctgtaatcccagctactcaggagactgaagcaggagaattgcttgaacccgggaggtggaggttgcggtaagccgagctctcaccactgcaccccagcctgggcaacagagcaagactccatctcaaaagaaaagaatgactgagtgaaaacattgcttaagcaaataaaaataattatttcacagatatttattaagcactatgcactggtggtgtgcttagtaaatatctgtgaaataattatttttgggaatataaggcaggttagagtttactagggaaaatggagatgcaatcaagcatttccagcaattcagtggagggaaaaccatattaataagctgctcacaggttctgtgggaacctggagaaggagaagcatctaaggctcctcttggaaacaaggcctcctggaaaggagctttgggcagatggaaagagcacaaggaacaaataatgaagaaaagaaatcatacatacaaattcatacaaatactgaggagtgaagaagggaaaggaagttgaatgcaagaaacaagctacttttaaaaacatgatattagaaaagccaaagccactaaaaggatgaagctgtaagcatccagagtctgaagaaaataaatccaaagtaatgatcccagagtctcataaaacacaataaggactaggtcagctgaatttacaggttagtagaattgcttttttattggtcagcttgtctaaaagctttccaaatgtttgtaagcatgcagcaacctagagttagaaggcaccaatccagtggaaatgaatagcttgtacaaaagcaaaggtgtcctcacagtgctgcagataagcaagtagcctggttggagccccatagcatgtgagcctggaaagggagacagatccagacccttaagggcctgtgtaggattcgtatcaggccatctacctaccaggtgcttagagaattagagtcaggttccagggaaagttgtgaagggggtggtgggggcggggatggtggtggtggtggaggagcccatgggcacagccgaaaactccaacagtgtgtatggtgggagaagaggaccacagtctcacattttagggacacaggaggaggaggagccacaaaagctggcatcacagaagccagaggagaagagtttcaaggaggatggtgtggtattgcagagaagtcacaggggatatagactgggcagtgctgggattggctgtgagcatttgactatgagaggggccagtcaatgtcaggtagcagtggattgaccatgtgaggggtcaggaagcctaactctgcttctcatgaatgaaggggttccttacagcccaggacatgtgtgctaattaccaggtagtagaaatattactggaaatgcgctgaatgaacgttcttgcactccacatacagactttgttgccagcctttgtgtatgcaccccagtgcttcataatcatcagtattccccatccaccatcctgaatgccgtctatcatcagtaaagtataccatgttcttttctagatctttcgtgaacatgattcagttagtcatcttcagctttcattttcttgattactggtgataataaaaaggtatatatagggctgggcaaggtggctcacgcttgtaatcccagcacattgggaggccgaggcaggaggatcacttgagcccaggagtttgaggctagcctgggacacataggtgagaccccatctctacaaaaaattttaaaattagccaggcatggtggcacatacctgtagtctcagctactcaggagacggaggcacaaggatcccttgagtccaggagtttgaggctgcaagtgagctatgattgtaccactgtactccagcctgggtgacagagtcagaacctgtcccccccaaaaaaaaaagaaaaggatatatctgtaagattaaaagtatatttctgtgtttagaaacaaaggaatatgcaaaaatctgtctatgatgataatgctggggctagagtggtgggaggcatgtctgggctgtcaaaaaagatatatatgatttgactgataagatttctgctactgttattccactgcacaaatataaaacatttcacacagccaagttcagaatataaatcaaaaagaatttgttcttttaccttcacagcaggatttctgctttgtgatttgccttcatgtcccccctgccccgtttttccccaccccactagtgagttacttcccagtagctatttgtgataccgcctctacgcctctagttcagtctcttctaattgaccacctctttgcaaaacaaaaaaatggtattgaacagttatgccagcttcctgattctaggacttctgttgatgctgtccttaattcggggccacactcagcttcatacagtcccatttaatcccccacactgccatgaactgcttggttgcacaaacactgctctgctttttccccactaacatctgcctctctttagtagttcacccttttaaggggtgaatagttaccagccacaaatttttaaggctgcacagttctcttctgttctattaatgaacattctgaccagagtttgtcttttcagcattttggttattaattttatttttctacttacaataaaacaagtaagtggtctgctgtagttttgagttaatgaggatttgaaatggatttcacatatccttgttgggtttttattatgcaggtgcaatctcatgcagcaaattaccataactaaacagtttaagaacccataaagctcctctgccctggcattgccaaattaatagattaacagctacacataaggaaaatgtcagatgttaaatatttttcattagtaataagttggaaatttgtgacctcagaaagcttatgtaatctcttaagtgcctgaaccagagttaattttatcttattatttttcaacttacaaggattttcaggcaagactctaggctgctctgtataaatttttttttaatgaaacaccattcaaactaccttttctgatattatttaattgaaatgtagggtccagtttgggcattaatttatgtcttgatgtagcatgttttcaaagcacctactgtcttctgggtaccttgctggatacagaggcaaatagatgcacaggcctagaacggggacacatgggagcacaatacagtgccatggtgagttcaggaggggcccccagaggagggggaggggattggctgatttcctttttacagtggctaagagcatacagtatggagccagaaagcttgggttcaaattctgactccatagtttacgagatgtatgacttgggttccttacttaacaatttatctgcgtcagaatgaccccagctgaaaagtgggggtattcgtagtacattccacaggggattggttccaggacaccctgtggataccgaaatctgaggatgttcaagtttgttatataaaatggcacggcatttgcatacagcctatggttgtcctcccacacactttagattatctctagactgtgtataatacctaatacaaagtaaacactatgtaaatagttgttatactctcctgttctttaaattttttattgttgtattattattttttgttgggtttaaaaaaaatttttcaatccacaattggttgactctgcagatgtgaatcccatggatgtagagagccaactgtatagacctcatatttggattaaaatgagagaatatttttaaagcccttagactagtgcttgcttgttacatggtaagaactaaataagtgttttaaacaagtcaagtaaaataaataatgtgaattttgaccaaagtatgaactaaagaaaactctgttgtgaaaaatatagaaactaactggcaggtattttaacatttgtttttaaatgtatggaaactttagttgataattagcttgcaaggttctgtcactaggttctgtctgcagaaccttggctaacttttgtttcttttggttttggttattttaacattttcaggtaaggaataactttctaacagagaggctccaaaatgcaatgaatggccatttgtgctgttttaagtttctttcttgttactagaaatatttaagcaaaggatgaacctgcctgagatgtagctttgtgggtgtctgcattggataggggagggaggaggaggtcaaacaagtgaacttctaagagccaatagattttttttttttcagtcatgatttggtttagaaaggcatgtgacattgggattggggctctggagatgcgaaacagcaatatcactagagaggctggttgaagttgggaagaactgagagaagttgaaggcagaaagtggagagctttaattgctggtctaaaacgtggactttggatgggcttggtggttcacaccagcacttcgggaggcccaggcaggaggattgcttgaggctagcaggttgagaccatcctggacaacgtaatgagacccatgtctctacaaaaaataaaaaattagctgcatgtggtggtgcatgcctgaagtcctggctactcaggaggctgagccaggaggatgaggattgctttacatacatacatacatacatacatacatacatacatacatacatggacttcattttgtagagaatggagaggcattgcctgttttgaatagtagagtgacttagattaaaagggaggttttacatggattaatctggtaacaggtgctcagattggaagcaggagtcctggaagccaaggcccctgtgcaggcaggcagggataagatggtgtgggagaggtagctacaatgactttgagctccggacctgaggtaagctggtataggtatttgagggtcaaaaagagagtatttagccctcggagcaggcggcgggggcggcctgtgcagcaatggctaagatcaagtctcgggaccttcacgggaaggagaaagagttgctgctcaaacagctggacgacctgaaggtggagctgtcccagctgcgcatcgccactgacaggcggcgcggtctccaagctctctaagatccgtgtcatccacaattccattgcccgtgttctcaccgtaattaaccagactcacacaaagaaaacctcaggaaattctacaagggcaagaggtacaagcccctggacctgcggcctgagaaaacatgcgcctgcgccactggcccagcaagcacgaggagaacctgaagaccaagcagcagccgcggaaggagcggccgtacccgctgcagaagtacacagtgaacgcctgaacgtcacattgtcaataaaagagagctggccgaagagaacaaaagaaaagtgtgtatttaatatgcaattctgtattcattcaacaaatatttattgaaggcaaacaatgcagaactcataaccctctgatgatggactcatcatgtggttctcatgcaggagcaaaacacacagcatatgccttccatgtgcagcataaatcccattgcagtgagccatgttacagggcagtttctgcctgtaccaaaacagacgctgctttctctgggcctccgcgtgtagcagggttccttcacttttaatgaaaatgtctgattgtgtgtcttcattaactacaaagagatcagaccagtggaactgaagatggctttgatgttctacaatcaagtcagatttattcatcctagccctgtgtgtctttctacctcaaaacaccaggttactgctaaaatccaaataaactcatcaaagtgccatagcacgagatccagctgtgcctccttcactgcccttctttccttgtattcagaacttccactttctatttcgcttttggcttcacagtttgagactgggaaaaggcgtattattccaaaaaacagatggctgagccttagagagctggtgaatttctgcagagatgatcagtatagcacttagcacattgttggtgctcaagaaatgtactaaaagttaaaacagattttaaatagactgactttgctgtaattgaggtatcctaagggagcttttaaatccccagtgttaccaaaatgcccagccatccttggaaaaactaactaaagcagtctggaatagactttccttctgtattttctgcccaaagatgactcttaaactcctctctactccccaaaagttaaatgcctggaacatagacaagatgacaaccttctaatgccaggctagcatttttcaccttagtacagcacagaaacatgtaatgcctccctctaagtcctaggaagttcttcatatgctcatgttacagggtaactgaagcacggagtttgcccgcctactgtccagttcttttggtaatggaatgtcttgttcctctgcatgctgcctgtggactcagagcagttctgctccttgtcagatttatttggcacacgtagcacagaccacacaagtggcctctgtcaactctgataaaaagggggagctcaacacccttttatgaacattctcctttaaacctgtcaggctctaaaattaggcaggagttgctatcaccagacattcttctgtctgaaggggctgccctttgcagcctaccttcatctttcatagatgagcacatctcatgactggcgataatgggagtcctggcatttgcctcagatagctcagtatctgaactgcatcaaatgcattactgaagattgttttcaggaacctaactgattgcacattcgtgcgtcttaacacaattgattttattactaaatgtacgcatctcaaggagaataataatttcaagagagacagttgatctttgcacaactaaggtcattgatttgaaggaacagtaatgttccattgatttgtcatatttacttctcttttttctttaaaggaagatattcttttttttttgaaatcagatttacatgttaaggcagctagatgtgtgtttagtgattgccctcttgtgctaaaacatgcttccagagttaaactgctttatcattggtgatgcctctggaaagttgtgcttgacaacagagatgggatttctgaaactttagacttatgtactttatataaatgtacaccatttcttcagtagttttttttttttaacataaagcattcagctcaaggatctgtgagttcttatctgttaaacaattattcttagaatatggttttaaatgtgcaaaatcagaagctgctttaaatttaattgattacttaaaaagttgggatagctttatgatttgctcaagcatttttttatttgtgaaatgaattgtgtctgttaagccttaaaaaaatactattgaaatggaatttttttggtagaatggccatggcaagatatagtgggatttttattgttttaataatctgtcttcaagatggtaacactaatgactgtgtggagaaggatcatctttctaagctgactcattttgctaaaatagtaacagcagcccctcttgtatctggaatatcgcttttgaaatgtttgagtgagtctcctttttaagaaaataacaaaaacagtctgggcgcggtggctcacgcctataatcccagcactttgggaggttgagatgggcagatcactgaaagtcaagagatcgagaccatcctggccaacatggtgaaaccctatctctactaaaaataccaaagttacccgggtgtggtggtgcacacctgtattctcagctactcaggaggctgaggcaggagaatcgcttgaacctaggaggcagaggctgcagtgagctgagatcatgccacttcactccagcctggacaacagagtgagattccgtctcaaaaaaaaaaaaaagcagagaagcaaataagggatagcatctctggcagaatgatatttgtccccaggattccctagagataggtggtcattgtcttggggaagaagaaatgaatgtgttaaatctataccaaaggctctaacactttcaacattttgtataattgcacccaataaagatatttacaaggaagtaataacttgaagttaattactttgtgatatagtaggaaaaaaacactgaaacagggacttgggagaccttggtagtaatgtgccataagctggcagtgttgccttggcgggtattttttttaaagacagagtctggctctgttgcccaggctggagtgtaatgacgcaatctcggcttactgcaacttctgccttctgggttcaagagattctcgtgcctcagcctcctgaatagctgggactacaggtgtcctccaccatgcctggctaagttttgtatttttagtagagatggggttttgccatgatggccaggctggtcttgaactcctgtcctcaagtgatctgtccgtcttggcctcccaaagttctgggattgcaggcatgagccactgtacccaacccttggcaggtatctttatcttcttgaatcttattttgtcatttgtaaaataagagaggactgctagctggatgacagcctggagtgacaacctctccctatatctgaaacattttaaagtcccagaatttactattattatcttatatcctcagggctgagaaagaactgacaccagcttttgtttaccaggtggcacagtcttgtggctgctcagaaaatacccttctcagccctctatcaagaatcagtgtgggcttcatgaagggtgtggttccttacagccttgcggtgcttaatgttattggtttgggatgtggaataatattgttatgctgctgtgcgtctccacaatgaagaatttaaggttttttggtttttttgaaggagaattttaagtacagaaactcagcagtatatatttaacccagtttagtggcaagttctttgacctctgccttttgccacttggcaatgcaagcctcagatttatgaccccagacattgcctccccggtgacagtgatcttagcatacccattattgtaactggtcctggtagcttcctccagcttagccagagctcatttgtcttccaagttaacctgtgtgcaggcaacactggtgcaggtctccctgtggactagatgtcccagtctggccgttcctttgatgatgtagtagggaaccccctttcatgatacagggcagatgggaagacagcctgctggaaaggatccatgtcgtgcgcagtcaccaccagttgagccaccttgttctcccacaaggtagcaacagtgtcaacccctgcaccaaggacaggtggtctccagtggggacctcccctttgctggcagctttcttctcagcccgggccagcagccatcagttcttctcttgcactgtctctggtcagtacctgtgagccagcctaggcagctgagtgctgttttgctgcccaaggcctggacgaactggttgctcatgaaggcactttcagccatgtttagaggacagccctttgtcaccgcagctggatgtagcagggtcacttgacaaagcaggtgaggtctcttggggccagatgtcctgcaagtgccaacatttctgggtctctctcaggtgattcatcaccttggctgcttgcttcttcacaacagggactggggccaccgtctccagctgcccaagatgccaacagagtctaacgtttaaagaagaagaaaatgaaattaaggaaagaagctttcttaatttagcatgtaacttcggtcagccgcgggctggctcactaatgcttagaactaactgtgagtttgaatcactgtcgtaatgtttggttttatcttctgtgtccctcatgaaggcttcatatcgatgtactctaagatagtcccgcttatgagatcttaccgatgcttccaaagacaatcttatctgttcattgtggattctttggtggtgcttgtagtctgttaaggtgaaagggggtgccaggtccaggctccttgttgaactggatctattgtacaactcatttactctgctgttgacaagaagaaggaagacagggctctgtgtgcctcacatgatgagctgttagccctggaagacagacagacttttcctattactcaagtgggcatctgttagatcccatgtgagcactttgttttcctgtccattgagggtcccataaaagctttggcatcccactacagaactgtgtgcacagtggacactcagaaagaatggaggtgtattatcagctctctcattggttacagtatgggaaaaaggaaaaggaagtaattttgtttaacttgaacctgagtactgtggtagcaataaactaccaagtaaagaaacaacacgtgcatttaagctttggcaactgtctacttatcaagcactaatggctgttatatagatgtataaatgacattttatatgttactaataatagtttaaggttctaatattcctaccacaactccactgtagccgatgagaggagtcagggagactggttagtcatgatgctagtgaagtagagagctctgagctggtttgtctgtataaatgacagagaagacacttgcttgtgaaaccaaatgaccacatgggtgcctgggtgtagggggccttggcacaagatgatcctgagggttgaaagtagggtggctgagaagagagtgttgctattagcccaagcaagaggcccatggaggagcatgtacacaggtgtgtctgggcacgttgatttggagatgtgaacaggccatctgccacatgagatcatgaacccccatagcctaggcaacttgatgggcttcttaaccagcccctcacaggtgacttccaggaaacacatgtctggctatgggcctgcagatgtggacatggaggtcctttgcatagagcagattgttggagctctctgagatggcaaagagggaacttgaaaagagacagccaagtatagaaaattgcaaaacagaaggaagaggaggcaataatggatcaattaggaaggttgaaaaagatttcgaggaatgaagaagaaccagagaaatactccacccaggaagccaaagaagcagttgccatatagggattgaaagggatgagacctggaaaggaaccattcaaaaatgtcatttctgaacaatgagaggaaaagaacagattctccaataaatggtgtataatagttggccatttggggaaaagtagttagatcccagaccatatgtaaacataaaatataaatgtaaaaaatcaagatgaaattatagacaaatatttttataacttggagtagagaatgttttataagagaggaagctaaaagggaaaacagatatttgggtacataaatattaacaccttcttgcacctcaagacaccacagagaaagttaaaaaaaaaaactgttggtgtactgggacaaaatataaacaaagcatgatagaaaaaaggttactacccttcaatgtaagataaatttctgtaatcagaaaggagaagtaacagaataaaagagcaggtatactttgttctccaaggacaaaatataacatgactatgaaaatgtttgctaataaaaaaaatacagtaaggaaatggcagtgtttgcctattacactagtaaaaattaaaatccattttaacatccactgctgatgaggcatggacatttaggcaaacattgtcactgggcacctaagttgttaagttctctttggagaatatttggtccaaatttattgaatttttgggtgcacgtatacttcgatttagcagtatcatgtctaagaatatatcatacataaatcataccacgagaataccagatttatctaaaaggaatttattccatcattaccaatcacagaacataaagaatagcctaaatatcaatgagaaaatggttaaatgtgtgtgcatctgtagaatgaaatattaggcagccattttttaaatgagataaatctgggtgttttactctgaaaagaattccatgataaattgctaagtgaagaggagagagaatgaatcatagcccagtattagcccgattccatttatcactatataataataactcctatgtgtatttgaacatataaataggcgtgtctctatgcaatcatgaaaatgttgggaaggacatacaccaacaggatagaggcagggatggagaggcaatgagaaagacagaaacgttcattgatgacctttgaaagagcaggggtggggataggaatcaatggggtgggaaagtggtgagctgtgagtatggggtactcgggattaatgattaggaagatggagatgtagcttaagaggcagacagggtgatacataaggttttgttggctaggataggagaaatttgagtctatctgtatgccaaagaaagggaaaaaatacaaaaaacaaaagctgtaataattgaaagagcacagtagtagtggaggcagtaaggaatggaatcaagacagggcgatcctcctttctctggggttgcagaggctgaatgaagttagcagaagctttaccaggagctacaagcagatggaccctgtgagggataggcaaggccagaggcagagagggatgcaaatggtggtgtcagaaataaaaaaaaaaaaaaaaggaaaacattggaaactactcttgaattgatttaggtgggaaaagatggaagactttgaggaaggaaaagacataagacctaagttcagagcccagctgagatcaagtattcatttgtaatgaagcaagttgccatttccggagtgtccagcagcctgggggaggagaaggaatccaatgggttagggtcagaattagaggagttccggatttagtaacatttaaagagctgtccaagggtcccaagctgggcaaggaaagcccaagcgatgctgacagcctgagagaatataaagaactgaacgtcttcataagagttttttaaaaaaataaaagcagatattccaggggtaaggaaatgacagaagtggcgaaagagcaagttggagctacaaggtgggttgtcctagttctttgcagaagaaattcaggctctaagggccaaggtataaccaaggtgatgggtgagcgttgtgctgttggtttgtctcaggagactcttaagtcccatgagggcagggattatgcagctcgccttctttacatctctagggctgagtgcagtccctggcacataatagacacacagcaaacattggagggaaccagcggctagggtagggtggaaactaagatcttggtgttgaggcattcaggtatctctaaggtgaggatgctggacaggtttcactgttacagtcactgagggaaatcacaggagacctaggtaaagagaagtatagagacttgtattaaaatgatcaagaattgtgggaaaacttctggttttagttgatattaattggtaaggaaagaggaagtgacaaaagcagatggtctgaccagtgttttgagcccagatccacctgccacagagtatgtaggatatgtattaaatctgcacgtttgggggctctgccctagacctgtcgtatcagaatctctggggataaagcctggaaaactgtatttttaacagtttcttcacagatatgtaggcccagtcaataaggctcaaaaaccactggtgtagactctgatgtggagcttcttggccaagtgtgggaagcaaatggaagcaaggagtttgttagcttcttctcctgacccagcaaattcaggacaatgagaaaggaaacactcccaaagcctcttaaagaaaagctttgaaagaaggagcttctttgtacccatgaaaatacaaagggggaaaaactggcttcaggaggaaaccagttttggttaaatcaaagaagtagaaagtacgtgatggaaaatgcctaggctgttttgaatggctgtttcgaaaatgtctacatggattccttccatagttatcaaaagactcaggttatttgcccttctattgaagagggaggtttaggtttagtctcaattaccattccatcaatggaaatggcagaaaatactgctgagtgtgtgcacgtgtccatagaggaatttgataaaatatttatacgtatgtatattgtatgtacaggcatactttattttactgagcttcacaaataattgcattttttttttttttttttacaaattgaaggtttgtggcaaccttgaatcaagcaagtctgtcagtgccattttttcaacaacatgtgcttattcatgcctctgtgtcacattttgataattctcaaaatacttcaaagcttttcattattattgtgtttgttatggagatccctcatcagtgatcttcaatgttactattgtaattgttttgtggtataagaccacacccgtataagactgtgaacttaattgataaatattgtatgtgttctgattgctccactgaccatttcctgtctcactccctctccttgggtctcaattagggcgattaacaaccctccagtggcttctaaatgttaaaatgcaaggaggactctcacatctcactttaagtcaaagccagaaagggttaagctcagtgaggaaggaatgtgcaagaggcctggctagcttttggtctgtctcagtacaagttacccaagttgtgaatgcaaaggaaaataacttgaaaaaattgaaagtgctacttcagtgaagacatgaatgataagaaagcaaaactgccttatatctgatatggggaaagtttgagtggtctggatagaagatcaaaccagctacaacatttgccaaagccaaatccatagcaaagcagtaactctcttcagttctgtgaagactaagagaggtgacgaagctgcagaagaaaagtgtgaagctaacagaggatgggccatacggtttcaggaaagaagccgtctgcataacataaaagtgcaagatgcagcaggaagtgctgatgtagaagctgcagcaagttctccagaagatctagctaagatcactgttgaaggtggatacactaaacaacagattttcaatgtagacagaacagccttatattgggagaagatatcatctcagactttcatagctagagagaagtcagtgcctggcttcaaagcttcaagggacaggctgactttcttcttaggggctaagccagtgttcatttaccattctgaaaatcccagggcccttaagcattgtggtaaatctactttgtgctctagaaatggaacacaaagctgggtgacagcacatctgtttacaccaaggtttactcaagattttaggcccactgttgagacctacttctcagaaaaaagattcctttcaaaatattactgctcattgacggcacatctagtcacccaagaactctgatggagctgtacaaggaggtgaatgttgttttcatgcctgctaacacaacatccattctgcagcccatggatcaaggagtaattctggctttcaagtcttattatttgagaaataatacattttgtaaggctgtagttgccatacgttcctctgatggatctgggcaaagtaaattgaaaaccttctagaaaggattcaccattctagataccatgaagaacattcatgattcatgggaggaggtcagaatatctgcattaataggagtttgaaagaagtgattgtaacgctcatggatgattctgaagggttcaagatttcaaaggaggaagtcactgcatatgttggggaaatagcaagagaacgagaattagaagtggagcctgcatatgtgattgaactgctgaaatctcatgataaaacttgaatggataaggagttgctttttaggagtgagcaaataaagtggtttcttgagatggaatctactcctggtgaagatgcagtgaacattgttaaaatgacaacaaaggttttagtttgttccataaacttaattgataaaacagtggcagggtttgaagggattgactccaattttgaaagaagttctgctgtgagtaaaatgttattaaacagtgtattggtcagagttctcttagaaggacaggagtttattaaacattaacttatgatcacaaggtcccacaataggctgtctgcaagctcaggagcaaggagagccagtccaagtcccaaaactgaagaacctggagtccgatgtttgagggcaggaagcatccagcatgggagaaagatgtaagctgggaagctaggcctgtctctccttttcatgttgttctgcctgctttatattcactagaagctgattagattgtgcccaccagatgaagggtggatttgtcttccccagcccactgactcaaatgttaatgtcttttggcaacacccacagagacacacccaggattaatactttgtatccctcaatttaatcaagttgacacttagtattaaccatcacaaacagcattgcatgctacagagaaatccttcatgaaaggaaaagtccatcattgtggcatacttcattggtatcttcatttaagaaaatgccagtcactccagccttcagcagccatcaccttgatctatcagtagccatccacacgaaggcaaggccctccaccagcaaaaaaggttatgacttgctgaagtctcagataaccattagtgttttttttagcaataaagcattttttaattaaggcatgcacattttttagataatgctattgcatacttaatagactacagtctagtgtaatcataacttttatatgcactgggaagccaaaaaatttgtatcacttgctttattgtggttgtctggaaccaaaaaatcaatatatctccgaggtatgcctgtatgtttatttcaagactaaaataaagaaacttcttgtaaggagttttcttgcccacaattaagtcatcttcacaatgtcctttcattttggaccgctttcaaaatattgtttttagcattagaaccacaccaacttaaagcttggatatatttctgcaactacagggataatgggaactttgtgctttcaatggttttctccaaggatgcctttgtcctggagtcagataagagagttgcaggctggctttcagatactggaaatcttacagatggtagcaagaaaagtgatatgggaggaggaagttgaattgtcatgaagcatcaagagagcactttgggaatgatggagggtctgagagtcagctgggatgaggagtgtatcagtccagctggctgcatgaagatcagggtacatgaggaggggtcagcctggggagaattcagctggacctggatttgaaactagatgagaagctgggggtagttggagggaattcggttttttgaacagatgatttttcgaacagtgaaggtagcatcatgtgagacggtttgctcgcttgctcattgatgctgttgcctctgcgggtatagtgctgtgaattctaactcttgagttgaaggctatgtattttagctcactaatcccagccagtcccttggaacttgttcctcttactccgtgtttacttgtacctacccacacagttacactctgttggtggctgctaactggcactaaataactttaaataaaactgtatcccctctgataattttgaactctgaagtgtattctccatgattcgtcagatgccaaatttaaatgtatatctcagtatttctctgcagagtccgaaacaaatgctttttatgttactgtttcttggcaggtttcaaaaagctaccagattgcaggcgtttatcatggtcctataactcctatctctaaatctgcatccctgccactctccccctccgcccttcccccaccatggttatttctatggactttgtggcaactttgcgcaacagaactgctaccttaaaaagctatggataaaatatggctccaggtcacatgaagtgtaaaggcttatgcccatgactggaacgtaaggtcaacaagatgattccaaactggagcactttccaggggttgtttgggggtaaaaacaccatgtttacacaaagagaaagctattcacagcttttccttttgggaaaaaaagcattatcagctttttgtggcttatttattctatggcttatcagttgactagcttttaatgttcccttccttatggctttttttaaaatcctttatccaaaaggataaggagatgtttactttgaacttgccagaggtagcccagattcaagaaggctttatgaaccttaattatcaatagtggagagaagggtctttgtttaaccaggaataataggatttctatgattttcctcatcaactttctaagctaataaattttgttgctgctagcatttgtttagtagttcagcatagaaaaatgacgtcttgagcatcttaacatttagagaggaagttgaatatgaaatttgttttctggaatataagtctcactaggttgagttgcttggcaggatggcaaatgtgcccctcccagcactgagagggatgagaaggagcagagaatggaaagcctgttttctgtgtgccccgggaaggcctggagaggtgggcacgatggccacatgtggggatgcagaattgaggctgggagaggataaacgatgtgtgaagggcatcctgcaagatagttgtggaataagaattcaaatgcaggtctccctgttttcaaacgcagcctctttaaactgttctacattctctccataaaaactgaaaggtgcttcaccaaatagcccttgagaggtactaggttttcactgtgctactgtacatcatgaagagagaatttactatttttcccatttaaaagcacgcagtatctactaagtaatgctaaatcttatattctgctttcttatattctagattttctaccctagcaaggatggtacgaagattccaatgttcattgtgcataaaaaaggcataaaattggatggctctcatccagctttcttatatggctatggcggcttcaacatatccatcacacccaactacaggtgagctcggaacgcactcagagtgccagtattttatcttttccatatagtggaaacaaaccagagtgctctactaaatcaactttctaaaatacattactggccaggcgtgggggttcacacctataatcccagcaccttgggaggctgaggcaggcggatcacctgaggtcaggagttcaagaccagcctgaccaacatggtgaaaccccatatctactaaaaatacgaaaaatattagctggacgtggtggcggatgcctgtaatcccagctactcaggaggctaaggcaggagaataatcacttgaacccaggaggcagaggttgcagtgagccaagatcacgccactgcgctccagcctaggcaacaagaacgaaactccatctcaaattacagttctacaaaattcttgctgcttgttttcatagacgggcaggattatgtgttaactatctgaaatgttgaccaggaattgaaggatcatttcaagctaatcttgaaaaacaaccaaaaatgtcctcagtgtaacaggttgtttgggaactggattgggaggctatggctgcgtgactacagaagatttgtattaatcaaggtcttaaaggaagctcctttcttcagtgtttgtcatttgctgccaccgcactaccttcagtattctcttcagagggaatgatttcttagctgatgatatttttcaccagcagagtcttaaaatagactgtcttaacgttcagccataaatgttttctgtatactctgttacatcatctattttagactattgtgtgctgtttctgtgattatttcccagataattacgttcagggagaaaattctacatttatatgtttgctattgttggtataaatatcttctctgttatttgcaaacttgattttaatatcccattgctagtataaagtggaatttgctttgagcacttttaataaaaacaaggagtttcccaccagcaagactagctttgagccaacttctaaatagaaccccatatgaaatctgattcacagattcatccaggatcttttctgtttgggaagagattcatggactggtgactaccaggacataaattcagaatagattcaaccatctgtcctgaagttggatacaagaacactggtactttgttttgagcactcaatatctgtagaagctcattattttagatttaatgaagtatgaaatatgatgcctgccctcaagtgatttataatgaaattgtagacctcgaatatctggcagaagagtttgcatttatccttttgttagcaaggagctgatgggaggtttttgtgtaaaatcacgatgtagaacaatattttcgaaagatatatgtggcatcatcatatgagtaaatgaagggaaactagttagaaaagtgtcataacggttgctgttcattcattctatattgacagcgccatataccaggcaacattccagacatgaggacttcccatctctttccaaagtttcccaggcaacgagatttgttatcattgtaataacaaatatgtaatattaacacattggtatctatgtgttaatattacatgccatattattctttgtgattattagtctaagaatgcaagcctcaggtagagcaaccttgccccttgaaaaaaagcaagacgataaatgttggggtttattatattaacctaatccttatatcactcaaagtattaaaatgcaggcttcagttttaactcacagtgatgctcgagtgtggggcagtgaacacgtgtttcatcagtggacaatgagtcaccttgagccccattcccttggtcccagcaggtggtccaggatcaagacaacactgattcctgagtggatcctgttgggattcaagagatgagtcccggggccattttcatcccagaacccagtgcatttaatagtagtctcaggagagaccatcagagatgcatgaaagtcttgaagagaggaccaagtgatcaaacatcaatctggctaataaggtgtggttggatggtctgatacatctaccctaattcatctgacctttcctgttcatcctcaatattcaggaaattagcattcaaaccattgagaaccttcagtttatagaagcccatggtttccccagttgctaaaagagtgacacagttctcagaaatagttctcaaagcacagttaattttagttaacagcatgtcactcagtacttttagggtcacagtggaaagagaagggggaaacaaaatccaaattttccaaaggacttaatgctctttcctagagggtttgtgctatagtttcttctgcttatctcgagaaaatatcctccagccctgagaactctattcctgatctcctttacctcttgcacaccctgtgttggctaatttaccatagaaatttctgtagaactggaatacatgtttaaaaatccatgttccagaaaaagctttttcttttttccaacttaaaacagtttggagaaagttactcaaaaaatgataaaaggaaccattatcaggtcctcctgtgagcccagcaccattcatgcctgggctggcagtgttttgttttttctctgtttgtttatattatgaatggtgtagtgaaatatttatcaacgtagaaaaataagacactgaatgcttgtgagaacatattagctttgcctgagtgcagtggttcacgcctgtaatcccagcactttgggaggccaaagcaggcggatcacttgaggtcaggaattcaagaccagcctgaccaacttggcaaaaccccatctctactaaaaatacaaaaattagcaaggcatggtggcgcacacctgtaattccagctactcaggaggctgaggcagaaggatcacttgagcccggaaggtggaggttgcagtgagccatgattgtgtcactgcactccagcctgggtgacagagtgagactctgtctcaaaaaatatgtatatatattagctttgcagttaagtattaacaggaagttatgtgtttttcactttaatcaagcaataaaagaaatgtcaagctcctattgagatgatattactcagagtgttgttgggcatacacttttttgagatggagagagagggcatggtcttcactaggcagttaatggaaggttaactgtttttactgcttctcagtgtttccaggcttatttttgtgagacacatgggtggtatcctggcagtggccaacatcagaggaggtggcgaatatggagagacgtggcataaaggtgaggtgttttctctacagaaacacaagtctgacataatcaaagctaaggttgtgctgatccttcctgtttgaatgagctgaaggggtttggagcaggaaagctttttggctagacgaatgaaaaacaaggatattatcagacacaggcaccactccccccttaaaaacaactcacttttcacattttattttcctttgttataataaatagatgaagtacatatttttcagaagcattccttgttattttggggttttttaacaactcataggttgtgtttttaattatcactgtcaggagtgaatctcggagagctttttggtatttattctgtctcttgttagccttgtttttatagttcagcattagttgactgtcttgaaacagaagtcaaggcaggtcattttctcttaagagaaaggagcaatcttggagctttctgttcccagtgtgggcatcctcctgctggttttctcagatcttcccggcattgctgaggaatctcatcctcctagcattgctgctgtgactctgtcgtgcattagttttagacacaaaaacaatcatttttctagttttattccgtctccattctgtggcctcctgaagcatgtattctagctgattgactaatacccaactttataccccaaatggtcacaatttttttgaatgatcgtctgtattttaaagctgcatctcttccatttctttctatgtggagcacccctcacccaggcttttgtgtatctgaaattgaattcatagactaaccagtggtctgaagaggttcttcacttgtcctgtgtctttgggggagggaggacatgggaaagcaccttcacctccatcagctctatgcttcccccagtcttttcagccatcatttatcataaggcctaccaggaccccagtgcttggggctggtcagcagctccaggtgagaggggtctcctcagcatcagagaccacccttaagatatctgtacctctcttctgtttcccatgccatcccaaaccagaggcctgaggctctggattttttttgcatcaaatcaaatcagcgaacatgagggtaaacctgttgtaaagagatttccattaagtacctgttaggtaccatatgcaggaaaggcttagaaatgacccccgggcatccagcatgcaccccaggggctgacagcagactcctcaagtgcaccttagtgaaagtgagtgcccctggccggccatctggtccatcgttgccagttatcatccccagaaactactgattgtgactgtctttgaaactgcaaagaattcattgcataattttgagctgatattagagtttacactaaaatcatactgtgaaactgatattaaaagatgagtgataagaggataaaatttctgtataccatatgtttgatcccaaatatgtatgctaattctgaaccccttgactcacctgatttcctatttaaattgtatgtagtttatgcaccataccccctactcatggtcccctgatcctgggatcctctcctgaaataactggattattctccagaaaacccctctggtcatcagatgtccaccatgctctgagagggaagagtaatttggtcctagtctgctctctcattttttattagttagaaccaagttattttccagtcttgggattaggcaggttcaagattgactaaggctaacagtagactatgtttagactgatttataaacttcctcaaaatttaggccatgatgaaaggaccagaaatagaccttttccagttatagcctaggatatgatacactggtaaatctaaattccattctgttaattgactttaaaatttaatgctctttttaaaatgtagtcatatacccaaaatattgttattcctagtaactaagtaatcctagctgttctaaattcactggtaatttcttactgaaatcttaataacatttgttttgatatgaaaaacatttcagtaggactgctttatctttaattaaatttcagcagaagtggttaatctcaagtatctaattagatctgtgtctgctctttgttcatttcaaaggccgttatttcagacatctgttcctttgaggacatgcttttgacttttggcctttacttatagatatttcatggccctgtaaatgtttctccaagtaatttgtttggtttaatacactggaacgatttgcagatgataaagcccagattctctggggaaacgttgaagatctttcattctggaattgagaaaacataatgtgatgctctgccgcaacgctacctcaccacccaattccttttgttctttccattaataaccgagggcaagactggggaatttctttctccccatcaccgaccatgtcagactcctgcagaggtggggtgggaagcgtgcctctgcagagcgcttccacctccgtcttcgcggggaggggagacacgagcactcccacagccagctccggctcgggtgctgggtgcaacctagaggactaaacactgctgcaggtcttgctttatatttgtaagttcagcttcccaaaatacaggttccttgtgatgccatgcttctatcctttcattatcatacatctctcataaccgaccatctgttccctttggggcatttcccgtttaagttctagaggcttttagaaaaatacagatccaccatatggattagcattgtggtattgatgatatatttccacagtgcataacagaacttaaattgaggcttttttttaaatgcagtgttaacccatggtttttaagttaatcagtatttgaaaccgtgctctatcatttgaattcccattagattaaacttatttttatgttttgttaattaactatcttccactttggcacactgtaggtggtatcttggccaacaaacaaaactgctttgatgactttcagtgtgctgctgagtatctgatcaaggaaggttacacatctcccaagaggctgactattaatggaggttcaaatggaggcctcttagtgggtgagtactggattttattcattgcacttactagttagccctcttggggttttcagatacaccatctgtaggcagctcttgacttaactttgtggataggaccacaaagtggtataaggagagcaaaacccatttgtaccatttgtatttgggtatctgataaatgacatacgaagagaccctatttattttgccttgggcaggtcctgagatcttgaacaagtcccttaatctccctcatcactgtgaaagcaagtggggatgggaggaggggatacagggtttccagaaagtcctcaagcttttcaagattcactttggggagtaaagctccattactgatgagaatccccaccccctctgacagatctcagagtgggtggggagctttggggctattgggcaggtgatttctgatggtttcctcttgtgctctggataaatgcaaccagggctctggaagcatgtaagtaagtattgccttgccttgtttatgtagatgtttaatgatagactgcctcccttttctttctacgttgggcttttagctgcttgtgcaaatcagagacctgacctctttggttgtgttattgcccaagttggagtaatggacatgctgaagtttcataaatataccatcggccatgcttggaccactgattatgggtgctcggacagcaaacaacactttgaatggcttgtcaagtaaggttttattgacatatatatgttgttagtggtttgatataaagttgaacacagtcacagcaggattagtgcttgagctttgtcactgtcagggtcttgcatttgcatataatctgctggagaggagatgggactacctacttgtctttcttgatttaatatggtcttgaacaaaagcaacaaactacaaaaaatgtggtagggcagaattctacagatggcctcccaagattcctaccctggttattcaaacacttacctagatactgcttgctgtcagggagcaggatattcatctgctgctctttggattatctcttgaggggtcccaaatcacataaacccttaaaggctgagcacattctctggctggagtcagggatgcagcagaaagggaggtcagagaaattggaagcttgtaaaggattcagcctgccattgctggttttgacaatggaggaagggggacctctagaacctgagagcaacccccaaccaatagccatcaaggaaacaggacctaagtcccacagccgcacaaaactaaattctgccaacatcccgagactgcaagtaggttttttccagagtttccccgtaagagtccaaccagccaacaccttgactttgaccttctttgaccttggaagacccagagcagagaacccagctgagccaacccagactgctggcttacagaactgtgagataagaagtctgtgatgtttcaagctgctaaaatttgtggtaatttgttactgtaacaatcaaaaggtattattatactttatatcaaatatatgggatttccttttctaaattaagtaaagaatatatgctcctgaaatggcaggtcaagagtaggggaagggggtgttgagtatggtggctcatacctgtgatcccagcactttgggaggccaaggtagatcacttgagcttaggagttcaagaccagtccttcatgggcaatgtggtgaaatactgtactgtctctacaaataattagctgggcatggtgatgcatgcttgtagtcccagctactcgcgaggctgaaatggaaggatggcttgagcctggggggacagtgagccaagatcacaccactgcattccaagaccctgtctcaaaaaaaaaaaggaatatattcaaatacaattaaacttcttttatgctcaatatagctacatatgtttgaaactgcaagttgcattattgaaatcttacacaacttccattgtatcctgcaaccactatgctgataacaatgagtaaacagacattaaaacttctttttggcccttcattccccatatgtaagagttttatttttaatcaccagtgtttggctctcagactggcacaagaagcctgttcctcctattagtaaactacaaattttgatgaaaataactttagtttctaaagttttgtttttttgagacagagtcttgctctgtcacccaggctggagtggaatggcgccatctcggctcactgcaacatcgcctcctgggtacaagcagttctcagttctcatgcttcagccacctgagtagctgggacgacaggtgcgcaccaccgcacacggccaagtttctaaagtttgctctttcattttgtttgctttttatggctagcctctccagtttgaaatatacttaaaatgactgaattttttttaactggatactttactaaactctattctctaaggggaaacaaagttcactatgaaagttattacttttcagtacatgcaggcctcattgacacacattggtagaagctatatatttgaagaaggaatatctaacttagagaaaatttgcacgtaaggaaacaagtcctatttaaactcatttgaaaatactgagttaattgaaggcaaaagaatattagatgacacctaatactttcaaacttaatttaaaaacaaagaaagttctaaatatttttctccatgatgttccttcttcagttttcaaatcttgctctcacagggctgcatttcacctgcggctggtaaaatgagcatggaactcagcccacactagctaggaagggtcctacagggagctcctcaagcccagcacacctccccgccccctgggctgtgcctcatggagcaccatccagaattagtaaaaggtgtttccccaaaaaaagagctagagctccaagtttgaatggctgggcgataaataaagcctaatgtattttttcctacagataatgtataaatattgcatgtgaatctccaagggggagattgttattattaacaggcagggttttccaaacttgtttctttttagaactaacccatatttggaagaatggggctggtcaaaagacactcttaaatgagatcagaaaacagatctccatcttatctggtgggaaactgagcccaagaatgttttggcctcacgttggttaactgagcagaatttttactgttttcactatttacctacccttcaaaataaaactctactaaaacaggtgattttattcattaataaatattaaatacattgaaaaacatgacacccctattaggagaatgtaaagaaaaaatatccagatatttcaactattatcagtcactgttaaaatcaacattacttttatacttaacaccctttttgttaacttacccaggaaacttgcctggtacttcggaaggtgccctcctcctctggcaaagtctgttgctttctgccggactgagagccagcaggaggctcaacagcccatccaggtttctcggtttacaaagaaactaggcccagagaggacatgtgcttttcctaagattgcaaaactgagcctggaataaaggctttatagatgttattaaaggggcagcaagcccctttatactgtggatttcaagtttctcaacaaaagaaaggcttggactttttttgaaccactgagtgtggttataatgacaattattactccactttgtagcagtaaaaaaaaagcctagagaatatgaaactactcaccttaagagacagtaagcatgcctgtgatttgggttgtttcaacagacctgtgagcttccttcctacagtctttcaaagttggagccacataaatgacacagctccccagtttccaggagcccttgccagtcatggcctaaatggtaacgcataggcacagtccatggtggtcactcacgtactagttaactgcagtcctcactgctaattaactacctaggtccctgtgccataaaactctactgttgctctccagcctcacaaaggtgtttttgccttccagatactctccattgcataatgtgaagttaccagaagcagatgacatccagtacccgtccatgctgctcctcactgctgaccatgatgaccgcgtggtcccgcttcactccctgaagttcattgccacccttcagtacatcgtgggccgcagcaggaagcaaagcaaccccctgcttatccacgtggacaccaaggcgggccacggggcggggaagcccacagccaaagtgatagaggaagtctcagacatgtttgcgttcatcgcgcggtgcctgaacgtcgactggattccataaacagttttcgtgcttcctcctgacagcgacagaaaacctcaagggctttcccacgttgacaccaagaaaccactgggcataatgcttccccacgggaacattattcctgcactcacaggctacagttgaacagaactgccgtgggaattttatcttttttaggcttctcctttttagcaaggccttggtgtttctttttccaccctgtctaggcacatgtggttttttggtgttttttttaagggcatgttgggataaatagctaaatggcaacaaacacattgtgaatattagattgctgaattaaggatcatagtcgggcatacttatctatatccataacctctatatctttaaataaatgtgagaactgttctcatggagaagacttctttgcaacaataataaatgttatttaagaatgacaggcttttacttccggtttcttcatattgaggggcaactccagaagtggagttttctgtgagaataaagcatttcacctttctgcaa

SEQ ID NO: 36543 - DNA, 3883 bp, Homo sapiens
cgctgcgccacatcccaccggcccttacactgtggtgtccagcagcatccggcttcatggggggacttgaaccctgcagcaggctcctgctcctgcctctcctgctggctgtaagtggtgagttaggggcttccgtggctgcctcccgggtccctgggctcagcttggggcagggcagggagtggggtggaacgagagaaccaaaagtgggtgttgggatgggagcaggtccccaacctcccaaagcctgtgggtttctcccagagcccaagcccccaagttttgtcgtccgctacaagcaggggagaagagacatctaagtgtgttgccacaggacaagttgtgcagaagtaacgcacatagtccggtggcccagacgccagccccctgagtcccgccagacacgctctcccccttgctaacctcttggctgtcaggatccaccttccctggcttctaaacttgcctcccccacccccgtcataactctgtgcctcagtttaccttctttttcctcctcaggtctccgtcctgtccaggcccaggcccagagcggtaggcctagacccagcagtccctctctctacctcccagagacctccctgtctccgtctctcccacaccctttccaaacctccctgccgctgacccccctccccacagttcccagcacacactgacctcccctgacccctgtgctgcagattgcagttgctctacggtgagcccgggcgtgctggcagggatcgtgatgggagacctggtgctgacagtgctcattgccctggccgtgtacttcctgggccggctggtccctcgggggcgaggggctgcggagggtgagtggggctagcaggggacatcctgaggacttgcctagatgggggtggggggctgggtaaactcccagatctcaaacatccaaagggatggtaatggaggtgctgatttggaatgacaaaacaccctcaactcaccactctgcctgtctctgcaccccacaacacccctcacctccagcagcgacccggaaacagcgtatcactgagaccgagtcgccttatcaggtgagaaaaccagactgtcctcctcacatttcactcctgccagggatatctgccccagatactccttcatgccatcagagggacctcaaagccactctgcctaaagcacccccaaaccttgaaggcacatgggacatctgtccaaaactgggccgaatgatcaaccacaagcttatggtcagcttaaaatgtgtgaagaggggctgggcacggtgactcaaacctgtaatcccagcactttgggagacagaggcgggtggatcacttgaggtcaggagttcgagaccaacatggtgaaaccctgtctctactaaaaatacaaaattagctgggcgtggtaacgcatgcctgtaatcccagctacttgggaggctgaggcaggagaatcctttgacccaggaggcggaggttgcagtgagccaagatcacgcaattgcactccagcctgggcaacaagaggaaaactctgtcaaaaaaaaaaaagcgtgaagagttaaaaagaaaaaaaaaagggtggctttgcctttgtaagtgtaaacacaggccttgccagaagtcaggccaggaattttctggaagaaacccagccctaggacgactgatttctgggagacgctctcagtagggcagagaatgtcattcagccctaccttggtaactctaaagagaggagtcctagaatctcttttttgggtttgaggacccttcatccctttgagaaactaagaaaatctagactcccagaaaaatctacacaaaaaatacaaaattgtgcatataatctgagagcagtgtaaatgttctttataattaaaaaaaatttttttttggccaggcatggtggcacacacctgtaatcccagcactttgggaggccaaggtgggtggatcacgaggtcaggagttcaagaccagccaggccaggatggtgaaaccccatctctactaaaaatacaaaaattagctgggcatggtgtcatgcgcctgtaattccagcttctcaggaggctgaggcaagagaatcgcttgaacccagggggcggaggttgcagtgagcctgggcgacagagtgagactccatctcaaaaaaaaaaaaaagacaggggtctcactatgttgccccagctggtctcaaactcccagtctcaagtgatcctcccgcctcagcctccgaaaatcttgggattacaggctcaagcaaccatgctggttgagtattcttgaagctcttttttctttctctactttaatttttttttttttttgagatggagtctcattctgtcacccaggctggagtgcaatggtgtggtctcagctcactgcaacctccacctcccaggttcaagcgattctcttgcctgagcctcccgagtagctggaactacaggtgcatgccaccacacccggctaatttttgtatttttagtagagatggggtttcactatgttggccaggctggtctcaatctcctgacctcgtgatccgcccacctttccctcccaaagtgctgggattagaggtgtgagccaccgcgcccggccttaattttttttttttttttaaagtagagataggttctcactatgttgcccaggctggtctcaaactcctgggctcaagagatcctgttacctcggtctcccaaagtgctgggattataggcatgagtcaccatgcctggctgaagctctttttaaaaactatagagtatacaagagaatctagtcatctatccccctctctgtcaatgttcctttttaaccctttagggggtcatgagattctctaagacctctcccctgaagaatgcacgcccagactagtcatcatatatgattttagggtttctgtctgaggcctgcccctgggggccacatagatcctccccctaccccaagtgtgaacactgctgtgtgaagtctgatatattgtctgcaaccagctttgcctattcacctcacttgtggataaagtttctttgtgaagtctaagaatctcaggtttggctctgtgatatccagaagaccgaggggcccttccagttactggtggcagtgaaattttagggcaaagcattacccggatgtatttattccctctgtggatgtgtctagcacctataagtgctaaatgctggggacacagtgacagagtttatatcctagttaagacaaacttaaagcaaatgaacaaataaaataattttgggaggcacagtaaaggaaataaacaggcttttttttttttttttacagtggctggagtgtggggggaagaaactacagaggggaaattgagaaatgcctctctgaggaggtgacgtgagctgagacttgaagggagaggggatctaggggaacagagttttaggcagaggaaacagcacacgcagggaccctgaggctggggcacactgatgaggcagaggagaagggggaacattgaatgtacttgaataaaatccggatctctttcatggctataaggctgaagaagctgccaggggccttgcaggccactgggagaaggctggattttatttggtgggtcccttccactgatggcccccattcctttaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaac

SEQ ID NO: 36544 - DNA, 24282 bp, Homo sapiens
cggatttaaagagacaggcgctccaaccgtcgtgggctgcccgcggcctgtaatgagcaagttccgaggcctacggtgagcgccggagccggagaggcaggtgaggggctacgcggcgcggcacggcgcggcggggcccggcgtggggaaggcagcgggcccggggcgaggagctcggcgcggccggggagccagccccccggctcctcccccgcccgcctgcggagccccggggcacaccctccgtgacgtggcggccctcccgggagcccagggggaggctcgcggctccccgggacccccacggggccgcgtgaggcggggaggccggcgcccgggctgtgttccctgtggaacccacggggccttctcgtaccctggcccggcgtgcgtcctcctgcgctgaaccgggagcgctcgggtgggactcagggagccttgatcacttcccgcctgcgtcccggacccggtggaggagcgctcctttctgcctcgccgggggtcgcggcctacgccgccgaccccactgtccccgccactctccgacagcggcgcgggaagcccttcgagaaaagcggcggcggccaggcctcagcgatttccttctcgggcccctgggctgcggcagttgtgagggtgcggaacgagggacagacgggtttcctcaaagctgcattgtgcctcctcgtggcccagcgcctcccgagcctccctcaagtccactcctttcattattggggccctagaggttgctctgtaaattgatcttctaggaaaagtgttgaaactcacttgttctgacctccttttatgggtctgccgtacttccacttacctcacctctgtggttcttaaactttgggagttatatagccctttgtgaatatcacgaaagtgatagacctcctccaaaaaaccgtgcatttttatcgaatgtacattttgtatacatttttagagagctcagaacagcctccctcccccacaaccagcgcattcatggattccttgtaattttcccaactaccctgtgaggtaggtattatttaccctgctttagaaataagaaaacagatgcagataaattaagagttttctccgaggtaacagtcagtaaactgtacagtcagacttgcactcccatcccttattccaggtccaccagctttccttcacatcatgttgcactacagtaagcaaagcctgctttttattataacgtgacagcaattttgcttcacagcgtgtgcagactgaacataattccagtatacttaaaactaggactataaaatgctttagaaaacatgaatataagaagatgctgatataatctttttccatttggattgatttatgagttcctgtgagtcttgctgcccagtgacttcagcattctctgattcaagttgctgaatgataaacaggttaattgcacatcggaagcctcttcttgaaagataacgacgtcaccgatcataataggagctgacgttaatgagagctcttgctgtgtgcccaactgttttaagggttttactcttagaacagctctttaagttaggccccataattagccacattttacagataaggaagctcaggaacagaggtaagaaacccatcaaggttatacagctggtaagtggctgagttaggatttgaactcaggcagtctgattccaggctctgcttagttgtctctcaatatagggattctaactcaattccaaatctatatagtggcttgatttctgaggatggcatatgtgttaaacttcacaataaaaacttcatgaacataatgtaatttttactggtgattaaaacgaaacttcagggccaggcacggtggctcatgtctgtaatcccagcactttgggaggccgaggcgggcgaatcacctgaggtcgggagttggagactagcctgaccaacaagaagaaaccccgtctccattaaaaatacaaaaaagttagccgggcgtggtggcgcatgcctgtaatcccagctactagggaggctgaggcaggagaatcgcttgaacccgagaggaggaggttgcggtgagccaagatcgcgccaatgtactccagcctgggcaattaaagtgaaactccgcctcaaaaaaaaaaaaaaagaaagttcaggatcttgtaatacttaaaggtcatcatccattatgagtatcatatgttgctgatggcctaaaaagagcttttatgttatttggattttcttcattgtgatgtactagatgtacatgtgtgcattagataattgaacatcctgctgcgagctggcttttcctgtatcagaactctttcatgctgtagagtagactatgaatgtaatactttggaaagtgtttgattagtcatcatggactatataagacgctggcctttggaaaattggaagcctatctccttgtttatatcttttttttttttttttggcctcctactctttcgtacagctatatgtctttggctttcaagatcttctttccacaaaccctccgtgcactcagccgaaaagaactgtgcctattccgaaaacatcactggcgtgatgtaagacaattcagccagtggtcagaaacagatctgcttcatggacatcccctcttcctgagaagaaagcctgttctatcattccagggaagccatctaagatcacgtgccacctaccttgttttcttgccagggttgcatgtgggactctgcagtggcccctgtgagatggctgagcaacggttctgtgtggactatgccaagcgtggcacagctggctgcaaaaaatgcaaggaaaagattgtgaagggcgtatgccgaattggcaaagtggtgcccaatcccttctcagagtctgggggtgatatgaaagagtggtaccacattaaatgcatgtttgagaaactagagcgggcccgggccaccacaaaaaaaatcgaggacctcacagagctggaaggctgggaagagctggaagataatgagaaggaacagataacccagcacattgcaggtaaggtagagaacactgctttctcatcttactggtgctgagagaaaaagggataaggagttcaactgctttctttctcttttttttaactttgctcttttagagatggggtctcactctgttgcctaggccagtgtttaatgttgcattcgtagctcactgcagctttgcactgctggactcaggtcatcctgactcagcctcccaagtagttgggattacaggcgcatgccaccatgcccagcctttaacgttttatttggaaataattttaaactcactgaagtgttggaagattaaaaatagtacaaagaacattcatattccttttacccatatttacctattaacattttactctatttgctttatcatatttgttcatgtgctgtctctctctacatacatacacacgtgtgcgtgcactcactttaaaccatttgagaataagttgcatacatcatggccctttaaaattcttcagtgtatataccttaagaataggatatatgacccttatgcgactataatatagctatcatcttcagaaaatttgtccttgatgtaatacttaaatctaccatctgtatactattttgtcaatggattgagtcataccttcagtagccttttcctgcagtataggatcccagtctaggatcatatcaggtgttgcatttagttgtcatgtttctttggcctcctttaatctgaaatatttccatagtctctcttttatgacattgatattttggaagaatagagtactgattactatcctcttttactttttttcttgtagcatataattcattactgtacttaactaatttgatacttaattgtcccatatttggccaattaggaacccctttacactgtcctctgtgtcctgtataccttcattaactttttttaatgtacttctttactcttgagcatagcaagatgcttttagtcttatcccgtatgtatccttccccagccctgaaattggtaatttctctggggattcctgttagtgggaaatgcccctgttaaagagtaaaacctggatactatgtgtccacattgtcatggggtatctgtttcttcttttttttttttttgagagtctcactctgacccaggctggagtgtagtggcactatcctgttagtgggaaatggtattaaagagtaaaacccggatactatgtgaacacattgtcatggggtatctgtttcttcttttttttttttttgagacagagtctcactctgtgacccaggctggagtgcagtggcactgtcttagctcactgcaacctctgccttccaggttcaagcaattgtcctgtctcagcctcccaagtagctgggactacaggcacttgacaccacacccagctaatttttgtgtttttagtagagacagggtttcaccatgttggtccagctggtgttgaacccctgacttcaagtgatccacccaccttggcctcccaaagtgctgggattacaggcctgagcgcccagccatggcatgtctgtttctaagccctttcagcagacagagctagaaaatatgtgcgtgtatatgcatgtaaaattcatacctatatatggctatatataacatgtttgcatgtacatgcatatttacatatgcatattttagaaattttatgccaatacccccaaatccagttagtcctctttgaccttcagtgtctgtaaaataatgttcatatcttcaacttagttctggtcaccataggaagacagttaacaatggctctaaaaatgggtatctgtccttgttctttgaaaggaaaaaagacttccgggaaagaaaactgtgcttcccatatactttattctcaggctccccatcccaccttgcactgccttagctattggcctcggcctttgttacttcttgacccatctctcatttggaggaagagaaatacaggtagagttcatgactcagataactaagcatctggaaattttccttcctatgctaggttgacatgctctgtgatcctcatttactttttgttcatctctaaattgaagctaattctgtggggttgggggttccctaagttttatccatcaaactatgatttctgatttcccccaaattgttatttctggagacttacatatgggataagaagtggagaatgttgatgaaaatttaaggtactaatagagataaatggtaactggatcttttgtctccagcatatccttcccttctgtccccacaataccctattacctactacccccactcaaaaaataccagccaccagccagccttgggctagtgctagggtagtgacttaacaagcaaggccctaggagcagttgatagattctttggatgtttttttcagagatcgttcactgaaggatattttatactcttttgggatcctacagatctgtcttctaaggcagcaggtacaccaaagaagaaagctgttgtccaggctaagttgacaaccactggccaggtgacttctccagtgaaaggcgcctcatttgtcaccagtaccaatccccggaaattttctggcttttcaggtaagataggttagggctactttagctgttatagtgctgcttttattttgtattctacctaggattctggctaaagagtgaaaattctgtgctatctcatctcattaataatttgcttctgtctgagcagagactggtaatggctaattctaagccttccgcttggtttttgtttgtttgtttgttttttggttttgggggtttttttgagatgaaatcttgctctgtcatccaagctggagtgcagtggtgcattctcagctcactgcaacctccgcctcctgggttcaagcgattctcccacctcagcctcccaagtagctgggattacaggcacctgccaccatgcctgactaatttttgtatttttagtagagatggggtttcgccacgttggccaggctggtctcaaactcctgacctcaggtgatccacctgccccagcttcccaaagtgctgggattgcaggcgtgagccactgcgctcggccagcattccacttgtatagcatttctttgtatactttaacctctatcgcagcggaaagatttgttttgtcaagactttttccccttgaaatagttacctgggccagacagagattattagaacctgtcttttacttccttgtgttttgataatgaaagaattttgagaaattgtttccctgaatatgcctagaaatgaaagtatgaaagaagggagatgtcatgcatggatctcccttcttgattcttaaaactgtttattcaaaacactggaacttcatggaacacaaaggaaggaaaaaaagatctgaaggatattgctatttgttgggaggcagtacagcctagggatgaagcttgcagactttggaatcagtgagctctgggttcaaatcccatctcctaaaggggaggactgtggctattatttgtaggacagatgaacaataaagtgttaagtttcctgttctcttcactaaaatacacacatgcacacacgtgtatacacacatatatagtttcttttatataaaatatagaattactatttcatagacagggattcaggaagactttgctggggcatgtggtatagataggagttgagaagatcaggatcatttattggccttacgtaaacagacagcattggactaggggcttttatatatgtagtttcatttcttcttcagttaaccctagacagtacttttatttaggaagtactttttattaggccctttttatgactgagaaagttgacgttcagggttatcatggagttagtatttgtactgaagtctgacttcagtacttgtgctcttttatactacactgtgttgctgcttttattgtttggagacattcttgtgattgactcagctgaagaaaataaataaagccaaaccacttggccttattttagaagtcatttggagattgaaagacattttatgtgattgaaagaagcctagacctgaggtcagaagacttgggttctggtccttgacagctcagatccctgagcacgtccttacctctctttagcctctgtctatgaagcagcagtggcctctcctaccatagtgctatgcacagggtgctataggagcacaggcagcaatatatagattactttcccctctgcttcagtgagtttgtgtatttatttgtttaagcttcatcatatctccatgcctcatctaccccatagtgttctcatgaggactgtaagagataacattgcaaaaacggtgcctggctctataggatttttattatttaaaaattctgggccgggcgcggtggctcacacttgtaatcccagcactttgggaggccgaggcgggcggatcacgaggtcaggagatcgagaccatcctggctaacacagtgaaaccctgtctctactaaaaataaaaaaattagccgggcgtggtggcaggcacctgtagtcccagctactcaggaggctgaggcaggagaatggcatgaaccctgggggcagagcctgcagtgagccaagatcgcgccactgcactccagcctgggcgacagcgagactctgtctcaaaaaaaaaaaaaaaaaaaaaaaaaattctgaggttggttggtttgttgtttgctggtaggccaaagatagagaagagtccaggtgatgataaggacagcatgtttctggaagggctccggtgttggggatggaatttgggaggagttgagagaaagagagtgttttagttcttgcaacctggttgaacattgacactttggagattttgtcccctaaaatcatatttagattccggatcagagatgaggatggatttataatttacaaagcccagacaagaaacagtgtacaacagcagttagcttagtaatggctctgccacaagtttgccgaataaaatttgctttttaaatggtcacaaggaggtgaaagggaatcaccgatgagttgcacataattatttttaagtgtctggaggaaatccctgccccttgaccaccttttgtaaaaatgtattattttttttttataactgctccttggggagcagggttttattttgacaataagaaaagaaaagttgaagcagcgaggggtagggatgttgagtgtactaatggaatctgactttcttagtagtgtctttgtcctggctctttcaacaaggaagtgggccaggaagtcatttgctcttctcagacctcagtccccttatcagtaagagaacattgaactagataatctttaaggcttcttccagctctgacaacctgtgatagcagtaatttcacattgtctaacacgtacttgatttcttacccctttctcatgccagcttttctgggatcagctttacaattgctctgagatccttctgaccactttttttttttgaggcaggatcttactatgttgcccaggctggtctcgaactcctgggctcaagcagtcctcccgcgttggcctcgcatagtgttagggttacaggcgtgagccactgtgcccagccagtcctgatcattcttggcatgactttggtctttattcttcagtaaagtgctcacataaagagatgcacatcagtctggtcttttgcttgggtctaaggaggccattgttcctttaacattatttattagctgtaagatttgggaaaattacttggcctccatttctttatctgtaagatggatataatgacatctaccccaaaagtctattcggggagattaaataaagctaaataccagcagaatatctgttagtttccttccttccctttctttcttctcagaaaggcagaatgaattcatctctgttgtttctccaacagccaagcccaacaactctggggaagccccctcgagccccacccctaagagaagtctgtcttcaagcaaatgtgaccccaggcataaggactgtctgctacgggagtttcgaaagttatgcgccatggtggccgataatcctagctacaacacgaagacccagatcatccaggacttccttcggaaaggctcagcaggaggtgtggcatgagcatcctgaataggcctttcctccggagagctcaaggccatggctgccttcctgggcatgtgagctgtatagttgcccgggatcccatgcttggtttaatgctgtactgtagtgctatctggaaattcttaataattttgaacaaggggcctcgcatttgcattttgcactgtactccacaaattatgtagccagtttttctcagagcactttggcatctgtcttcctctccccttattctgctcctaggaggccagaagaacccatcctatttgactagttagaaaatttactgtcctacatatttaattaggtttttgtgaaccatatacacagtttggaatagaatcttccaactctgtttctttcatttatctaacaaattgtcgatgagcatctctgatgtccttgtcactgggcacgtgaagtgaaactaaccactctgtccaacaagagttcatctgtaggctaaaggtgaggcagacacaatccaccagcctctgaactccatgctgtctcctactatagcgatatgcacagggtactataggagcatgggcagcgatatatagatatcttttggtctctgcttctttgagtttgtttgtttgtttatttattgagacaaaaaatgtggctgtgttgcccaggctggagcgcatgggtgcaatctcagctcactgcaacctccgcctcctgggctcaagcagtccttctgcctcagcctcccaagtagctgggactataggcatgtgccgctatgcctggctaatttttgtattttttgtagagacggggttttgctgttttgcccaggttggtctcaaactcctggattcaattaatctgcctacctcaacctgctaaagtgctgggatcacaggcgtgagccaccatgcgcggtctgagtttatttttttatttatttttgtgtgtgtgtgtgagacagtgtcttgctctgtcgcccaggctggagtacagtggtgtgatcacagctcactatagcctcgacctcctgagctaaagcaaccctcctgtcttctcctgcaagtagctggaaccataggcatatgccaccatgtccagctaattttttaattttttgtagagatggggtctttctttgttgccagggtggtctcaaacttgtgagcttaagcaattctcctgcttcggcctcccaaagtgctgagattacaggtgtgagccaccttgcccagccttctttgagtttatatatttatttgtttaagctctatttctcaagaagggttccttctgtctccagatggtttccacggtgatgtgtacctaacagtgaagctgctgctgccaggagtcattaagactgtttacaacttgaacgataagcagattgtgaagcttttcagtcgcatttttaactgcaacccagatgatatggcacgggacctagagcaggtcagaggaacgggagggagggtaggctacattccaggtggggttttgccaagccaggcacctgcagcctctttttttttttctggttgggacacatactgttttaggaaactgaaacccatttgagcaagcttccgttatagggggagctgaatgtgaggctatagctcttaatttcttaagtttctgagggtggaaaccatacaactgctgaaccacaaaggcctggttctcaaaaggcagaatttgagacttgccccctctgtctctcctggggcttttattctggactctttttttcttgcttgttttctcctataacttggctttaccaagctttggtttgtccgtgactctatccctggtaccatggcaagtttccatccccttctaggaattgtggatgggctagtgtctctaagaagtgggctagatatgttgagttgggataggagctatgattgaaatttcttgattcatcttcagtcctgggtcttgggggatacacttggccaccctagggttgcagcagtggcattttggtttttggagacagggtgacgtgtcagagacaatcagagtcttctttgagcagagcaagtctttccccccagctgccaagagcctccttaccatccaggaagtggatgagttccttctgcggctgtccaagctcaccaaggaggatgagcagcaacaggccctacaggacattgcctccaggtgggggagctgcctccgtcaaaccatgcccatagagagatgaactctcttgggaagggaaggttcccttggggttccagagctcttcaagaccaagttaaatgtgcttcatccccctaggtgtacagccaatgaccttaaatgcatcatcaggttgatcaaacatgatctgaagatgaactcaggtgcaaaacatgtgtaagtagcagctccgctgacagcctgagctgtcatttgttagctttgtttgttcccaactggtgtcaggacttttgagtcccagtcaggatttgaatcccccttccaccttcttactttctgtgagaccctgatctgtcacttgacctgtctctgcctccattttttcccatataaaatggagataacagtacctttctcacagagttcttacagttgaagtgtggcatacgttcagtgagtatagtatgagtctcttgcctactccagccccctcctcgctaaggcggcatccacataggcacagtatctcaaaagagctgaattttccaagagctttctctcctcttgtgaaagtctttagacaatagaacacaaccccttccctacagatgaggatttcttctgtgaggacagattgctgtccaaagccatggagtcaaacaaaggcagtggttttgtttccttgttcctgtaccccttggcaggttagacgcccttgaccccaatgcctatgaagccttcaaagcctcgcgcaacctgcaggatgtggtggagcgggtccttcacaacgcgcaggaggtggagaaggagccgggccagagacgagctctgagcgtccaggcctcgctgatgacacctgtgcagcccatgttggtgaggagtgctcccctgcctctgctttccagcctctccaagctccacatcctttgggctgagatcagatagggtatgagtgttgagagcacttgcaaattgactggagaagtttagggaaggaagagggaggtgcaagggggtatttctctgtaggaggcgaaggcaaaggagaagacagaggatctagtggaaagacctgagttgtaggcccagctacgccaccaagatgctgtagaatcttagatgagtgacttgcctctcttgtccttcagtctcctgtgtggatgacgtctgagactgcctgaggcatccccctagaatgatttatctgttatcttacctgaagacggatgtattaagtaacccctgagattctgtgacctactgcaaagtagatctgagagttggtagcagagccaggcttcctgtgacagggtgacttgggaagagggaggacacataaggaatgaaggctgactctgacagacatcatcttaggcctctgctcatttcgtaagaaatggggtttcctttccagtgttggttttcctgtgtgacagggcccaccacatatggtgccatgcctactgtgagattctttggatttttgagtgatgtacagtgctttttttgaaactgtcttgtttgtcatactaaaaccttggtttagggttttatgtttgagataggcaagtgttctctccctgctaggaatgtgggatagccagcatcaaaacagtgagatctccatcccagagatgggactgcggccacctgcagtagtggcctttctgacttttataaaaatgcctcctggagtctgttctatagtttgtcatttaaagactggcatgggttatatagcttagtggttaaccacacaggttttataggtgggcctagattcaaatctcattcttgccattttttagtgtaacttaagcaagcacctattctctctaaccttcagttttatcatccaaaaatgaaaacaatatttgtcacataggatgtcacatcggggatgaaatgagattatgtatgtgaagcgctcccaaaatggtagctattgttgtttgagttaggctagcacaggtaggcatgtaagtaggtgctccaatatctggaaaccctgtttgttgtagggacccacgatcactcaccctgccagcctcactgtcacctgcactctttaaccttagcttcacatacctcttttactgggagaactgatgtgttttataataagccagaggtcttgcaaggcctgaattattgagaaaagaattaaatcttgtttcactgggcttttacttgttgtacaatgaatagcattcatattcctcaaaaggcaagctcctatgtcagctcaggtgattatttcataggcagaatacaacattgcccagccctttccgttcccatcacctcttcaccagccttccctgagcgttaattgtgggcagtcagtcccaagacccaggtaactaccctcactaacccagttgcaaggtctctggctgtcgctgcttagcagcccctcattgaaagtctccaggctttgctttccccaccccaaggcggaggcctgcaagtccgttgagtatgcaatgaagaaatgtcccaatggcatgttctctgagatcaagtacgatggagagcgagtccaggtgcataagaatggagaccacttcagctacttcagccgcagtctcaagcccgtccttcctcacaaggtatgagtgccttcctttctgccaggaccgtctttcccctttctgcctctaacaacctcagggccagagtcccatagccattccagctgtggtacacaataagggtttgttttttatttgttgaatgaattaattcatttattcatttttggagtcttcccataatgaagggctgctcagcagggagagccaaagagccctgacttgggttcgtgaggatagagctccctggaacagtgatacttcttttgcccacagtgatattgggacagtgagctcagttggtgagttgctgtgtgtcttttgtgtttccatgtcccagatgcttcctgtgagctagactaaggcttatataccaggggctattgggctgtcattcattaatttgttcaacaattatttatcagatgcttacccattgttacagctggtggggatatagcagtggaaaaaatggacaaaagttctggccaccatgaagtttacattctgatgtaaacacagtcttatggggacatctaggagcctagattcctgttctaatcaggggtggcatttggaaccttattccttagcccttctccactcccaaggatactgtgagcctttgggagtgtcttcagggaaaagcagctggaacatctggctccggtagcttgtgagcagatggaattcctatctttgctatccttttctttcctaactcagactcagtttttcagagcctcagggggttcaggggaacatgttgtgtggcctgtgcttacctcagccttgccttcctgctggagcattgggaacaaagcagtcaggccatttgtttcatatgttcaagaggaaggctaagcagtggcctcattgtggagctttaatgcaggttcacgtgttctgtgaagcactgcaaatcactcaggagctgtttctggtgaggttggtgttaaatagacaccatctgtgacccaggaagaagtctgagcacacttttccagatttagtcctttccttaattttcccttacccagtattcactcatcctttgcctctcctgtgatttgggttcttaaagggctaggttagggattgaaggggaatggcatggatgtgctggcctttcctgttcctgctctaagcatcctgggtagtgatggctgtgggttcagggctcccactcagagaagacactgctcaagtttccttgctgcacctgagggagttcatttctacctttctggtttcaagtagtctgttctcccctaatccagtccccagcctgatagtcacacatcttctgcagtaggcactaatctctgcccacctaccctcctcctcctcccccgacaggtttaatctgtttcttccattttcctcaaaaattgtaccttctctacagcccatagaaagtgacccagcatgggttgacctcttcctgggcccggacagaagtactgaaacagatggcctctccctcttgtccaggtggctcgcaaggcctagctatatgttttgcacattagctgggccttccacatgttgttctatatcctgtctgggcccgggctttgccctccatggcatggtttgaggtccctgctgccatgtcatccctcaccaaagctccccttctgctttcaggtggcccactttaaggactacattccccaggcttttcctgggggccacagcatgatcttggattctgaagtgcttctgattgacaacaagacaggcaaaccactgccctttgggactctgggagtacacaaggtactagctcagggccatatgtgcaagaatgaatgagtgtgagtgagtatgtacatgtgggtgcacgctgcggtctgaaaagggaggaaatatcccttagtgtggcccttattcttcgcttctgacctgtttctggtttggatttttgtcttttgtttttctcctaaaaaggggctggtattgggaaccagtttataactgggttggtttccatttagcactatctgctcagtgcccttatggcccaggggcttcagagcagaaatagtactttttcatccggtgcctcagggggcctccagaagtggactggtactccttattttttcacactgacttttgtcctatgtgtacctactacctcattttcccttacagaaagcagccttccaggatgctaatgtctgcctgtttgtttttgattgtatctactttaatgatgtcagcttgatggacaggtgagttggctagcatctttaaacccagaaactgccaggaatctgttttcatttcctgggtgaggaagatgggggcttcaggttggaaaggagggtacagggaaccagctggcacatacgtttgtgctcaggagcttgccaaaggcaatggcaagagggagctgagaggaagcacaattgctacatgatcagttccccattcagtgtaagaaagagcccatgtgttgactccatctcttctctgagagcttaagtcacagaagaaacccaaacccccaaagaagtttctctactaaagcaaaatggactattgcagagaaatagactgtgagcatatggggtttcagtttatttctccaatggcacccctaggggctccagtggcacccctgggggcataaggcagatggttttcagctcagaggttttgatttcagaagagactgacaacaggaagctccggattataggggaggccatgggtgggaccatcttggagagaattagcagtcttgacttagctgcatccatatgcttgtgcctgagaaaccagtatcagccctttcctcacttagaaatgtatctctacccctgttcctcctgcaacagccacatccttgattggggaaggagaaggaagtagagagggaaggaattggtgggggtaggatttggggtttgggtcccaaggcctgtctcagcctgcctaccccggggttggccttgggatcggggcaaagcagggtgcaggggataaaaaatgagagttggagtcgtatttcaagtgggaccagaatttatacaatctgggctacaggccagttctcccttggctcgcttgatgaagtagaactaggaactacaactatgaactggctctatgccacagctcacaattttccatcttcggtcacgatggagcccttgtagcccttgacagcagaactgttacacatgaggtctttgatccatggcaaaccctttcttgaagtagcagttttatcattgtggcccttccttcctcagaattcctaataagggagggaggatcccggcctaacctcagctctcctgttctcctcagacctctgtgtgagcggcggaagtttcttcatgacaacatggttgaaattccaaaccggatcatgttctcagaaatgaagcgagtcacagtaagtgaagaccctatgctaggcagtgtcctagaagtttgaaagcagggcagagaactccttgggtcaactgcgactggaagaataaatcttaatgtcttatggagcctcctgataatgttggcctttgactattgcatatgttgcctgctagtcttcacccagaagggtagggcatggaaatccttcctaggtaagcctcctgtgtttcaaagccacagcagccctctgtttgggatgagaagcaacctgctttctaaccctttgtcccttatatttcaagtaagggtgtttccagtggacacttaactagtgtgtgaaaaggaacaacccccactcactcaccaccttctccactctcacaccaacttcagcatctctcttgtccctcagaaagctttggacttggctgacatgataacccgggtgatccaggagggattggaggggctggtgctgaaggatgtgaaggtaaagtggcctcgcttggcttctcctgtcgactcactcgcagccctctcccctgagcctttccagccctgaccaggagatggcggtggcagcctgcagtggttggggtggctgctggggaagtgtgggcagatgtgtcctggatctggaggactgctttgtgtgtctcctatagtgcctggagcctgagggctcttaccctgagggaggggcactgggctagatctggtgtgtagcagtgaaggggtgaacccatcctcatggagttgcctttctattctgtggtctctcttttgcttcccttcagggtacatatgagcctgggaagcggcactggctgaaagtgaagaaagactatttgaacgagggggccatggccgacacagctgacctggtggtccttggagccttctatgggcaagggagcaaaggtcagggtggcctctgccccctggggtggtactgttttagaaggtaccgcttgaggtacaggctggccttgttactggcttgatctgccagcatggccagttatgacttccgaagtcctaggatctagggccccaagctggcctgagtcacctcaggcagagctgcttactcggttagggagaagtcagaatagagtaccctatgctagcctagcagaaggacgcttaccaccaattatttcgtcagggcctgacagctttctcctcaggcaaaatctctttcctgactggaaaggaagctggagtctgaggaactaatacttttaagcaatctatcatgtgtccaacacagttcaatgccccagagcccaacaggttgggtgtgattatccctcatttacagaagaggaaattggggcttataaaggttaaaattacacagttagtaagaggtagctccaagaggtaaactctggcactctgacggccaggacccaaggtcctctccctggccctgggctcttgggactggcagagatggctcctccaacccacactcatctcacactcccctcccaggcggcatgatgtcaatcttcctcatgggctgctacgaccctggcagccagaagtggtgcacagtcaccaagtgtgcaggaggccatgatgatgccacgcttgcccgcctgcagaatgaactagacatggtgaagatcagcaaggtgaggaagggacctggttggccatggcctctggactggccgccatcactgagacagaggctgtgctttggggactacaggtatttctgtctccccagaaagaagggttgcagcttgctcaggggagcaggattaggccttataatctctgaatgccttcttgtggaaaatggcttgcatgcctctaggtcatacccactctgggctgggaggatcacatggctcaaacatcagctgtttaagtggcttcttataatctcattaccaagagaagggatttaagccttgttccaggttgggaacagcccaaagtagcatcttttctcctctaggaccccagcaaaatacccagctggttgaaggtcaacaagatctactatcctgacttcatcgtcccagacccaaaggtatcaacccagtggcttgggggcctccagctcatagaattagcttgcaggttctctagtgccatagagaatccatctcacctcgctgaaagtccacccagggataggggtctggatttccagctgagtgataggcacagggacaaccagacaactctgaggaattttgaatagaattctttctgcaatacaattgctttaaaaaaagagagagaagaagagagtacctatcccctcagcacaaagggtgtgttctagaagtaatctggcccaatcccttcttgtaccgaccaagaaagagatctagagaacaaacaggacttccctaaggttattcagcaacagcagcagcagaactaggacccaagtttcccagctgttagccaaagcttttttggtttttgttttgttttgtttttgagacggagtttcactcttgttgcccaggctggagtgcaatagcgggatctcagctcaccacaacctccgcctcccgggttcaagtgattctcctgcttcagcctcccaggtagctgggattacaggcatgtgccaccgtggccagctaattttgtatttttagtagagatgtggtttctccatgttggtcaggctggtcttgaactcttgacctcaggtgacctgcccgcctcagtctcccagggtgctgggattacaggcgtgagccactgcacccagccgcctttttggttttaattgttctgtattgcttctagctggttgggagatactttttttttttttttttttttttttgagacagggtctcactctgttgtccaggctggagtgcagtggcatgatctcatctcactgcagcctccgcctcctgggttcaagcagttctctcacctcagtctcccaagtagctgggattacaggggtgccaccacccccagctaatttttgcatttttagtagagatagggttttaccatgttggccaggctggtctcaaactcctgacctcaggtgatccacctgccttggcctcccaaagtgctgggattacagatgcaagccaccgcgcctggccaatacttgcttctccctttttttgagacagtctcgttctggagagcagtggcatgatctcagctcactgcaacctctgcctcctgggttcaagcgattctcatacctcagccttctgagtagctgggactacaggcgtgcaccaccgtgcctggctaatttttgttattttttgtagagacggggttgcgtcatgttggccaggctggtctcaaactcctgacctcaagtaatctgcccacctcagccttcctaagtgctgggattacaggcttgagccaccacgcccggccactgatactatcttcttaaccagtgatgacctgctggcttactcctgacagaaagctgccgtgtgggagatcacaggggctgaattctccaaatcggaggctcatacagctgacgggatctccatccgattccctcgctgcacccgaatccgagatgataaggactggaaatctgccactaaccttccccaactcaaggtagcagctcttaggctgtatatgtattctccaccccactgtccaggccttggagccttgggcatctagaccattcacatgtcctctgtcttctcctttcccccattctcctgaggcagagcaaggagggcaattagagagggagacaaactgctgctgggccaggggcacagcactagacctccttctccctccatctctgagtagagaaccttgcatttgcaaggccccactgagcagcctttagtctggggaataagagtttgctcctgttgccccagcaaagcctgctttgctgtacagagaacaatgatttgtaccctgattactcaggctatagggccatactttggaatggtgccaagggagccaactccttttccttgctctttatctttctcacatctttgttcccatatgcgcctaaaatacaccacacacaccacctctgaggccagactgggaaggcaatgaaaccctctgacattgtccctccccgcctcaggaactgtaccagttgtccaaggagaaggcagacttcactgtagtggctggagatgaggggagctccactacagggggtagcagtgaagagaataagggtccctcagggtctgctgtgtcccgcaaggcccccagcaagccctcagccagtaccaagaaagcagaagggaagctgagtaactccaacagcaaagatggtaaggatagggagggggctggtatggtgaagagggcggtgtgaggggcagagatccaagggcagggacccagtctcacattccagccctgagatctcatgattatctgtgtccactgcagtggacacagactacattcctggtgtgtgtccagccatgggccagagacccttctgctgggcaccctgtatctgctcagcaaacctgaatggagcagtaccctggggacagccagtctgaccagggaataagctacctttgagtaaagggcttagctgataactcttcactcccctctcacctatgctcatagcagagaaagcccctggtccttcccattactgcccctgacttcagggagcattatcagcaatccctaccctcttagttcttttgtatcatatgttttttagagacagggtctcactctgtcatccaggctggagtgcagtggcacgaccatagctcactgcagcctcgaactcctgagttgaattgatcctcccgagtagctgggactataggtgtgcaccaccacacccagcttcctctctgtcctgcaggcaacatgcagactgcaaagccttccgctatgaaggtgggggagaagctggccacaaagtcttctccagtgaaagtaggggagaagcggaaagctgctgatgagacgctgtgccaaacaaaggtgagggtaaaaacagcaacacaccacgtgggccagtttagcccaggttgtgttcccaaccttctgtacaagaagtttgaaagaggatgagcaaaggtgtttggggaacatcggctaaacctcttccctgcctgcagccactcctctgtcgtgggcagggtcagcaatgctgctgctcaccctatgtcctcttgttgccttgcagaggcggccagccagtgagcagagaggaagaactgtgccagcaggcaggagatagaacagcccggcctagccaggagagactgcagggactcactcagctgctggccccaagtcaaaatttacattaaagggaaaagaccagtctgggtgtgggaatgcagcattgagtttgtggtcagggtggaagcaggtccagcaagcagcgagtcggggagagggcactggcttggtgactctcctcccacctgaggagccttttccctgttacattttcttgtcagtcttgggtttggcaacatctcctgagcaattctttttttttttgagataagtctcgctctgttgcctaggctggagtgaagtggtgcaatcacagcgcactgcaacctccgctcactgcaacctccgcctcccaggttcaagcgattctccggcttcagcctcccgagtagctgggagtataggcatgtgccaccatgcccggctaatttttgtatttttagtagagacgggatttcaccatgttggtcaggctggtcccaaagtcctgacctcaagtgatccgcctgccttggtctcccaaagtgctgggattacaggcctgagccaccatacccggcctcttttgagcactttctgatgccaagaactaggtttagtactggctcaactctgggggagctgatgcctcaaaggacagatagagaagtaaacatatgattgacacccatgtcattgcgcccccacgctccccaccgccatccaggagtaagcatagaagtctcacagcacaaggcctgaactcggtccccaacagacctgtagaaacctttcccctctctcttcccagcctgaagtccttgaacccattgagagtagtaagcaggactcctgacccctcagtctagcaggttgtacagagtagactgcttggtctcaggggacatcactgagtctgggggcactgagtcagagccagctccgcctgcccaccatgactgggtggctcttatacacatgtactcttcccatctccaggtcccagatgtcgaggcctgtccactctccttttcccctaggcagggatggaggggcgtgtcagtcctgtataatttggagtgactggaggggtgggggtattgatgcatggtattccagtaaacttctctgcttgtgtcctaactctaggctccctcattctgtcccgtgctcatttgggtgaagacccatctgtacccagtgtaggtctgaccccaccctgacccctctgcatttgcaggtattgctggacatcttcactggggtgcggctttacttgccaccctccacaccagacttcagccgtctcagacgctactttgtggcattcgacggggacctggtacaggaatttgatatgacttcagccacgcacgtgctgggtagcagggacaagaaccctgcggcccagcaggtctccccagagtggatttgggcatgtatccggaaacggagactggtagctccctgctaggtttgctgtcttccctctccctcaggccatactctcctttaccatactactggactggactcaggctggaggcagatagacacagtatagggggaatgggcttgcttctcccaaacccaccagttctccactgtctcttctggaccaggaattagttgctgtgggtgccacagctgaagtcagtttgtcttgctggtttaaatagatctttcagagctgggtgctgggtttgccatctttttgttttctttgaaaagcagcttagttaccctttttataaataaaatatcttgcagtt

SEQ ID NO: 36545 - DNA, 8495 bp, Homo sapiens
ggagggttcagctgccacgtgagttctgcggccgctgctacacgcctggtgggcagcatgtcggcaacagcggctgctcgtaagcggggaaagccggcctctggggccggggctggcgcgggggccggcaagcggcggcgaaaggtgagcatggcgcttctgagggccgcggtcagccctgctactgggacaaccgtcatcccatccaggggacctgggtcccggcccttccccagcccttcgccctggacccctgctggagtcagcttcgtccctctctccgcgggccaaatcctagaaagccgttcgcttaacccgggaaccaccgccttccccattcctggggttctgagggaaccgaggggggggggcccttggtcaatgccagggtggtctggacccctgaccaaagaaaagaccgtataattcccaggccgactctgcgggggacaggggcaaatccaagggtggcggcaagatgaatgaggagatctccagcgactctgagagcgagaggtgagctattcttttccacatagtgggagggaaaactgagtcccatggtgcacggaagactgagtgagtccgaacagaactgagcctagaatccaagactctgtcccttggctctgagatcgtggctgtttcctttagtttctggtcctgcaaagtcttgtttctgcgaggtctctgggtgggaaggaccctgggccccaatccgaggccattgagacctccttaggttttggcagggactggactgattgagaaattgcaggaaaacagaacaaagctgtcaagtatttcttgcatccttcttcccttgccagttttcctgcaatttcacaattactgggctccccgtctcttaacatgccaggcactgcctttgctgttggaagtgcagagataggcaggcgggtgaagagagtgtgttgtagtgaggtgtgtattttatagttgtgtgttctgggaacagaggagggacatttaaatagggtcttgagagatgaagaggagtctctcacggagaggtagggaaggcattcagtgatcagaggaaagtctgaggtgtaagtgtgccagaatgggcagtagaaaagatgaaagggggctgggcctggtaactcatgcctctaatcccagcactttgggaggccaaggcgggaggattgcttgatgtcaggagtttgagaccagcctgggcaacatagcgagatcttgtctgtacaaaaaaaaaaagttagctgggtatggtggtgtgcacctgtagtcccaactactcaggaggctaaggtttggggatcccttcccagggagttgaagctgcagtgaactatgatcatgcactgctctccagtctgggtgacagcaagatcctgtctctaaaaaaaaaccacacacaaaaacaggaggactggtcataagtgcatgtagattgtagagggctttggatgcctccctcatttctgcaggtgatgggtgtggttgcttgcaggttttcaaagggtcaggcatggtgtcaggcctgaccctgtgggttggaggctcttggaccagagaatcctagtgccttccctatgagttgactttagaactcgcttctaaaattgagtatgtgttgccttaatttgctcatggaaagaatgtactttttttttttgtttttgagacagagtctcactctgttgcccaggctggagtgcagtggtgcgatctcggctcactgcaacctctgcttcccaggttcaagtgattctcctgcctcagccacctgagtagctgggattataggcctgcaccaccatgcctggctaattatgtatgtttagtagagatggagtttcaccatgttggccaggctggtctcgaactcctgacctcaagtgatccgcccatcttagcctcccagagtgctgggattataggcgtgagccaccacacccagccattaatgtacttttcttaatccgaaggttattgtgggtgagtgtgtgccaggctagtgtgggctaagtgcttttaaatatttttagaatgttgtgttgtgaagtgtgttagatacagaaaagtgaatgagatatatttgcactacagagagtaatggtaaaatggtaaacctctgtacacttacttaccacttaggttaagaactagaacatttgcagaaacttagaagccgcaactgtcattcctaacttgagttaatcatttctttggtttctttgttcttcttttaaaaaattaacattttccatttaggtataatttacatatagtaacatgccctttttaaagttatagttcagtgagttttgacaaacacacacagttgtgtgaccacctctaccctgaaggtaaagagtttcatcaccctccagaactcctcctgctccttcgtagtcagcccctctccttccccccaagtctctgctaaccactgcccctagagttgtgcattttctagcatgccctgtaaatggaatcatagtgtgtacttcccttgcatttctttagcgttctgtctcatgcgtatgaatccttcaacaatagattaattagtttggctaaattgagtagaagtccgaagttaacacaggtcccttggctgtgtaagggaagggcagcactagccctgttggctgaaggcttgccaggcacagggcactaaattatttctggggcatggtccagctttggctttcctgagagttttcaaggtcccttctggggaagtcaggggcaggtttacgagtgagtcttgggaaacacggttaggggagtggacagagactagatgtcttcaggcacatgatcagagggagtgggctgccttggattctctgtgtctgagtgcccatgacctacccccagctcccaggagcaggtcaaagcagcacctgtctttgggtgaagtgagtactctcagctggtccgggggctggggcatggaggggaaagccgtaacttcaccagtaaaggccaatccccaaacagtgaaggttcgcttggaaccttgttcccagggtaaaggatggtgctgtggtgatgacagtcctggtgtgtctgcctggtgggtccttggatctgatccagactgcccccgtcatgtctggggatagtgtcaccctttctgctctcttgtgtcgcatctctggtttccggtatcccttgcctttctctttcccagtttaccctcttgtttgggagcacagcttctatccttcctaaagaaaaagagggagaaaattccatggcaccttgcacacctggcagtgtcgtcgttgattgtttgactgggcatggcattttaggggtcagtgtattcctccagagctttgtgtgtgaggcttctttgtcttcttgttctcagtattgctgttgagatgcctgcacattttgattcctgactctttgtatgtgacctgatttcttttggaagcctggtttctcttggaagcctcctctttcccccagagttgagaggctttagtgatctctttgggatttgggtctgtttccacccctacgtggggcactgagtggggccttttagtttggggagtcacatccttcagttttctgcagtgtagtcaccgaccatgtgggctagcagggaataggggaggttggatggcaaggtgagcatccagaaggcacgatcctagcggtcagaggaacaaggtgagcccctcagacccagccccttcctgcccacagcctagctccaaggaagcctgaggaggaggaggaggaggagctggaggaaactgcacaggaaaagaagctgcgcttggccaagctctacctagagcagctccgtcagcaaggtgagccagtgggcaggccagccatgggcagggcttctgcctgtgctggtctgctgcccgccgctgcagccccagccacttgatgggtgactgacatggattcccagtgggtgcccaggctgtcagtgctggctgccctgtgggggtggccagaagctctcatgggcctcctggggagcccgcagggggctgatctgataagtaaaggcaggaggaaaccctccagcttgccctcccctctgctgaggcagctggagcttcctgcattatccagccctggggcagtgggatggggacaggatggaagggaaagaggggtctcagcctcagtttacttggtctggtctgtcctgcacagaggaggagaaggctgaggcccgtgcatttgaggaggaccaggtggcggggcgcctgaaggaggatgtggtaagtgtggagggagagttgggggaggacgggggtggagctgatctgctcccagggtctcatccatctcttctccatgcagcttgagcagaggggcaggctgcagaagttggtggcaaaagaggtgagtgggcatggtattttggtataaggttggagggaattgggggccccacttggaacatggtggacacttgggcctatctggtcaggtaaggatctggttgttgtagccttgggtcttgttttccttctggcctgggtgggaaaggccaacactacgcagtggggttggtgaaggtagtgcctttatgccactagccacagtgacctggcccctgtctgcccagatccaggccccagcctcagctgacattcgcgttttacgggggcaccagctctctatcacatgtttggtcgtcacccccgatgactcagccatcttctctgctgccaaagactgcagcatcattaagtgtgagtgagtgcctgggtggggctggagcccccatggcggatccgggagggctggtcaggggagtgggagtggtcatggcaggctgagccctgaagtggggaagtctctggaggcaggtttgctgccctaggagtgctctctgggtgacagtgaaagctgctgcccggcagtggggcttatgagctccctgtccctagagacctttgggcaaagtcaggatgatgatttaatgggaattaatgctgcaggtaggtggttggactagaagacatttgaggctgtgcagtcctgggattgagtgcccggtcctcctgggttcccatccgttgctggctgaccagcggttccttctacacccgctgtagtaacagaagaactcacaccatcaatcccaaagcccttttacatcccttctcttttttgggctttgtggctgctgtttggcactaatgtccctcttcatagatgaggaaactgaggcagcttgtccggaggctcacggtggctgagccaggtcttctggccgagtccgggacatttgccatggctcttttttccatgctgccccttgaggggggttgccagccagccctatccccccatcccagtagcttctcccccacccccaactgcagggagcgtggagagtggacggaagctgcatgtgattcctcgagccaagaagggtgccgagggaaagccccctggccacagcagccacgtcctctgcatggccatctcctccgacggcaagtaccttgtaaggccaggttggccctgggggcaggcgggaggtctggtgcatggtgggtgcctgtgatcattgtcttcatccctgcaggcctctggtgaccgcagcaagctcattctcatttgggaggcccagagctgccagcacttgtacaccttcacaggacaccgggatgcagtgtcggtgaggagctgggtctatgtcagtggatctttagtgggcacatgctagtgttctaggctcagtgctggcctctggagtctctgtcctcagggaacctgcatcctggggtagcgagtgggtagcgagtggtgctgtaaaatacataaatgggctaaagggatggggaggagctgggggagaccgggccgagcttgctcaggaatcaacgagggccttgagaagccgcctctgggcgggatgtagcggctcttgcctataatcctagcactttgggaggccgagatggaggatcatctgagcccaggagatggaggctgcagtgagctatgatcgcaccactgcactccagcctgagcaacagaatgagaccctgtcgctaaaaaaaataaataaataaaaaagacgtctgcatctgctcaggggcagatgggcatgtgggcagtacaaaattgcctcacagcacgtgccacatggcttgctttttgggaagtcctccctgggcctgacctgtctctcgcctgctgtagtccaggtcccctttgccctctccccatgcacccttagggtctggcattccgcagaggcacccaccagctctacagcacatcccacgatcgctccgtgaaggtgtggaatgtggcagagaactcctacgtggagacgctgtgagtgtggatgggagagggtgtgtggatggtgtgagagagggtgtgggagtgtgtgcccgtgagttcatgcagtacccctatccccactatcctgctctgcccggccctctagcttcggacaccaggacgctgtggctgcactggatgccttgagccgggagtgctgtgtgacggctgggggccgggatgggactgtacgtgtgtggaagatccccgaggagtcccagcttgtcttctatggccaccagtaaggtggcctgccatgccagtgggggctacatgggctgggggtgggcttgggccacgctcctcacagcccctttctccaggggctccatcgactgcatccacctaatcaatgaggagcacatggtgtccggcgcggacgatgggtaagaggtcctttggatgtctctggccacggcttctgctcctgagtgctggctgtccacggggccctgagcttgcctcagggcacccccagtgggggagctgttgtaacctcttttcatggatgaggatgatgaggcagagagctcagatggccttgtccgggctgtgtgcccttgatcccttcctgtcatgtggccttttttctttttttttagaattaaaaaaaatttgttgtgggtgcttagtaggtgtacgtatttgtggggtacttgagatgttttgatacaggcatgcaatatgtaataatcacatcatgggaaatggggtatccatcccctcaagcattaatcctttgtgttacacagggggccttttctgcctctggccccctcactgctgtattccctccctgtttatagctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggtgggtgccctgagaggcagggaggaggggtcgccgggtgggccggtgcaggggttgctcactgttccagtctccccaggctcccacagctcctgtgtgcggctttggcagtgtggggaaggcttccggcagcttgaccttctctgtgacatccccctggtgagtgagtgtgcttgaatgctcagcctgtctctgccacactgcctaggcccctggagttagctctttaaggtctttcttcctgccagaagggaaccttctcagggcagggccagctcctagcacagggcctggcaggaaccctccccactttccctcctctgctccccttcctatcctaggccctgtccagggtgctggggtacaagtcagggagcagcatggggagaggcatggaggcctggccctgtgatgaattctgtactgctggtgccagattgggtgccaggctagagggtgtggacctcactgtccacactagggtgacctgggggagggtggcaggatctgtcagtgatgtgtgctgagaatgcagggtctaggtcagtggggacagtcatggggtctccagggccccaccaccaggagccagcctcaggccatactgggtgtacactgcctccttcatcctcacaaactcactgctagccccgtgctctgcttacccccatctcgcagatgtggaggctgaggccctgacaagtgaagggctggcctgtgtcaccaggtggcaggaggcagagcagggatttaacccaggcctgataaggcccagcccttgactgtgatgctgaggacggtggtggcggggggcgttctaatgtctttccgtgttgtctttctgctcaggtgggttttatcaacagcctcaagttctccagctctggggacttcctggtggctggggtagggcaggagcacaggtatgtgtggccctcgagggttcaggtaaggtggtgcaggctggacagctcggtggaaatggggtggagactgggccgagtctcagctgcgtcttgcactccctgcaggcttggccgatggtggagaatcaaagaggctcggaattctgtctgcatcatcccactccgcagggtccctgtacccccagctgctggttcctgacactcttatcctccttatttaagtccttcccaggctatgccccaccctctttgtattaaaagcctcctcttttggg

SEQ ID NO: 36546 - DNA, 146195 bp, Homo sapiens
caggaagtgtgtgtgttggccacggctgcaggaggtgggggagacacaaagcaggaagcctccgggagaccagagctgggtgcagacatacacacacacatacacacagacacacagagtcacacacactcacacacactctctctctctctccctctgtctttctctctctctctctctctctgtcctttcctcctggacagatccacagttatacacagaaacaaacacacacgcacgtagagaagtgattcacaaacacttaaagacataaatcacaggtgcaaagccatacctgggctcaaaaacctccaagagaacgcagcctcagacccacccaggggccaggggccaggctgtttgcgagaccagcccaggcgggacccaggcttgcacgggcaggtacacgacattcttgggcatacgcagcccgcctggccggagctgtgggagtcctcagccccaagacccagcaggcgtctgagggtaagcgaggtgccgccgttgctgttgttgctgttgggcacgtaggagggaggccctgggagggctgaagtccctgtctgtcacctctggcctggttttctgtgctgctctcctcccccttctctttttttctcttagagttttgtcttatttcactttccccacttcttctctttttcccctgccttttccttttctccccttgtctcatccctccctcttccctgggctttctaggtctccacctccccatacgcctctcctgggtccaccaggagcccacggtgcctgttttctgggcctttctcagactctgccccacagaatactcctctttggggttcttgccccttgggggcctggtgctgatcaccttacttctctgctcccacctccctacacccctctggggattcgttggggaggcttagtttggcttatttcactgtcaagttcaagggtgctgtgattctgaacctctcacccccagaccagggtgatggggagatggtgtgctgcttacccctcctccccaggactggtgctgtggtgggtgcttatggagtgtgggggctggtctcccctttcctgagttaccgtggatccctaatgaattcaacaatcctgtgcttggcttattggggacatagacctctaaccaagtcctgtccacccacccggcactcttcagccctgccctgtgcccttggctcatcttttccatagggcccagcggataactgcacctgctctttctgccaggccaggccaggcctgggctggacccaggaagagctcagtacttctgtgagctccctgaggatgaacttcctcctgctgctgccctcaggagccagcacagggccaggcctgggaagcgcttagagctgccatgggaaaggggcctctgccacctcctgcccagacagcagggctggcctgtgggaaagctgagtgtaggtctggtggtggaaggtcaaacaggttgtgtgggcttagaggagggagggagcggtttgatggacttcctggaggaggaggcatgccctgagcacaatggagttaataatcccaggtcattatatgaaaaaaagcccctagcagaatgtttggcacatagtgagcgcttagcaagtggtagctgttgtcccagggagaagtgctgagagctgggtgaaggcgcggttgtgaggatgggctccaggttaactgggcactgctgtatggagagtttggggagctgcagaccttctccagtgatgaggatgcgagtagggtggtggtcattcagtacccacttactaaagccccttctgtgctgggaactgctggcggcatggagaggactggccctaggggctcccggcttgtgcagaagttgagagaagcagaccgtggacatcccattctagcaagtgagaccctaggaagggctgtctatgctgggggctaggcagaagtgaacagagcagaaccaggagagtgctggaggggatgacctttgggtctcatgatggaggaggaaggaagaagccacagaggaagcaggaggcataggactgaggcccgggcccctgagagtccagagcatgattgaggaagcgggcagctgggacagtttacccctgtggaatggagacatcagggtgggacacagatgtccacagatcactgggccggcagccctgatggtgagagtccaggggctgggattgggccaggtccctccaagacctgtgtgacatcttgtggggaggtggtgactctaggatggggttaggtctgggtcctcagtcctctgaggcagttcagtgaagcacacattgatatgaccatattgagtgatcagaattgtggggagccccagggaggccccagatcagcctgagatgtgaggggaggcctgcgatagtggggaggatggatgtatgatttgggctttttataggaggactaggagttggccaggcaggggagggtgttccaggtggaaggaacagagtattaaaggcctgtaagtatgcactgatagactgcagctcagtcagggagggctggagtgtgagtagtggggtgagtccagggtcagcctgagatatgcagactgctccactctgtggccttccttctctcacagtgacacctggttctttcggccagagattggtatagacagaaagataggaacgggtaggggtgaaggagaaggaggtggcattagaggccgctaaggctatgaagctggttcctggctcagcctgtagggcctgggtctccttcaaggtgaagaggttctgttgatgccatgtgcaagtggccctcctttactgaattatcagtaagcctggagactgaggctcggagaggaagggacctgctcaaggtcccaaaccaatgagttgagctgagttcaagcccaggtctgcctggctccaagccctgtctctagttaattgagtaaccacacatctcatttgacgtgggacaggccctgtttatgcctgctgccctgacatagttattaatagtgcctcttttaactcttagaagtgtttgtggtttatacaatgaattatgtggtcatgggtaagaggagggtgaccttgggcagggcagtgatgtgttccctctcagatgagtcctgagacctggtggcccatgggaggagactggcctcagagaagccctgggaccctggcatggccttgtttgctcggctgtggtgctgggctgccagggttcaaataccagctgtggcatcaagaacaaataatccaacatccctgtgcctcggtttcctcctctgtaaagtggaatcatcacgagccttaccttacagagcactgtgagtagatgaatgaagaatccatgtcaagtgctcagaaaatgcctgggaacacatacacgtagacacgcacacacagagttaatgaatccaggtgtttgtaagtccctgctgagtgctggagataccccaatgaggatgggatgtccatggtctgcctctcaacttctgcacaagctgcaccctcctcttacccattctgcattttgcctacccaccatgtcacctaacccccaggcatgaggtctgctgcatgtattttctctgattctataaaatagatttaggctgagggcccaggctggggtgaaccaaccccttagctgcccggggtgcctagtctctcgggaatagtgggtaagcaggtgggttcacatgccccttgggtagaggggagagggagctgcagtgcggggtgagtggggagcagctctgtgggagaatcttggaggttgcctagaggaggaggccggctgagctgcattttgaggtggaggtgggcttctgtgggctacgggagggagagggcagaggaggatgaaactgtgtgaaggcttggaggtggcgccattgaggacgtggtccagtgggtgacaagtcagtgggtgacatccaagccgggcctcagctggacctcgggattggagcggggcctactcttaggggtgcaagcagtgagaggctgggacttgggctatggcgggggcattctgtgggccctgttctcggtagggggtcactgccttttccctggggttttcccacatgttgtgccttcctgaaagcacttctcctttcctgggctccgtcctgactcagcagtgccctgataccctgtggtaagcaggcaggcagggagcagccaggagacttcctggagaaggtggctagaatttcccagatgcttccgagaggcccctgtgttccaccttcgtgagacacggtcccttccctgtggaagctctgctgggagaggagccctttgcatctgtttccctctcccttcttgccgtgggcagggcagtgatgtgttccctctcagatgggtcctgagacctggctgcccatgggaggaggctggcctcagaggagccctgggaccctggcatggcctcatttgctcagctgtggtactgggctgccagggttcacatcccagctgtggcaccaagaacaaataacctagcatccctgtgcctcggttttctcctctgtaaagtggaatcatgacaagccttacagagcgctgtgagtagatgaatgaagaatccatgtcaagtgctcagaaaatggctgggaacacacacatgtagacacgcatacacacaattaatgaatccaggtgtttgtaagtccctgctgagtgctggagttaccccaatgaggaaggagggtgtggagcttgcttcagggaacgtgcctgctgcccaagatgcacagacccgtcgcagttgatcaggacagtgatgggagatgcactgtggtgccagaggaggggggctgatgctgccggaccccagggatgcggacgagcaggtgggcagtttttatttatggttaccaccttcccctcagctctggccctcagacctgggggagctttgggagccaggctccctcaatcctgcttggcattggagagatggcacctgtccccacctccctggactgaggtctgactggccctggcctgacagcttggaattctgctctctgctgatcccaggccgggtttccaaggcgccttcctcttgggctctgggaggcagcagtgatggattgatttgcccatcaagaagtctctaagggaatcgcaggtgaccagctggggccagcaccccagctcatgctcttgggccttcaggcactccctcagttgcttggtcatcgttcaccccttccgttgccttcccttccacctgcccacctgtccacccaccttgtccacatgctattgctactgactgggctgcgggggtaccaagtcagatgctgcccctgccccaaagggactcaggtcatgtaggggagacggcctggtgcagtgcccaccagggggtcttcataggtccagctgtgagagtacgttccgactcaagactcccacaggcccaccccttggccccagattcccagagaggcccgttgggtagggagcagcttgccgccagggcagtggcaggccttcgtctgccatggggtctttgaagcgatccgagccacagcccatgcagctgtccaggagccattctctgtggccctccaagtgacagctcaggagtgaaggactgggtctcacagtggatagtgactcatagggagccatcctggctttgaaagctcttacctaaggggccagtagttttctaacatccccacaggtgtggcttcaactccctgtgtgcgatgtgcccagtttgcaagtcaccacactgagcgaagctcaaagctccggtttctctaccagatatagaatctgcttatagtttctctccgtccagatgctgttcctccacaggccatgctgccaaaggcagtggttgcctggtaacagggctgacacgccaccgtttgcaggtttctaggggaacagagctggaaacctagccgaaggccagctcttcacacagaagaggaaagggtttggttaacttttatctacacctggagaagagacaagtatagtagaaggtgatgtggaagtagccaagtgtcctaagaagctcataaactttggagtcagggttcagatcttggcacaaaggagatactttgaaaaatgtcatttagaataatttgtatgaagatctttttttttttttttttttttttgagacggagtcttgctctgtcccccaggctggagtgcagtggcgcgatctcggctcactgcaagctccacctcccgggttcatgctgttctcctgcctcagtctcctgagtagctgggactacaggcgcctgccaccacgtccggctaatttttttgtatttttagtagagatggtgtttcactgtgttagccaggatggtctcgatctcctgacctcgtgatccgcgcgccttggcctcccaaagtgctgggattacaggtgtgaaccactgcacccagccatttgtatgaaggtcttaatggagagcagcataaaggagggtcaaggaagactttcagagaagggaaatgtggttttagagttaaaggattgctttgggaagccgaggtgggaggattgcttgatgccaggagttcaaaaccagcctgggcaacataacaagacccagtctctacaccttgagacccacctactcgggaggctgaagtcagaggatcacttgaactcgggagtttgaggctgcagtgagctgtgattgtgccattgcactccagtctgccacagagtgagacccagtctcttaaaaaaaaaaaaaaaaaagaagttaaaaaactagtggatattcccaggcagagaacagggagaagggtgttactggtggaggcaacagcaggaggaaaggcctggcatcatgaccacaccccaggcagaccctgtcactgcctcccagcccttccttgctttcacggtagccccacaccatcagccaggaacaccagggcaacagacaaggccaaaaataagccatccaccctgattctcctccttggcccctgcagggcactggcagagacagctggtggggccaggcctccagggctcaggcaccttgttccagcctgtagtccccgtgcatcctgtgcactggcacatgacacatcctgtcttggttaatccttctagcaccctgccaggtcagtgatatagcccccgtttcacagaagaggaaactgaggctcagaggggctaggtgctcaccccaggacacacaagaactaagaaactaaggcaggattcaaattcatgtccttgatgccacagcccttcagaagacagcctgccagaagcaatgtgatctgtactgagacagatgggaacactgtggggccgtgagagcccaggaggccctgaacttggccttggagaatcaggggagggttccctggggagtggtagcagaggtgagtgagtggggtgaggtagcagaggtgtgggagatgggtctggtgggatcaggtgagtttgaggagtctgagggcaccaggaggtagtgaatatccaaatctgggcaagagcaaggtgatcttgagacagagacccacaattcagggccttaggaattggtttctgaggctctggtctgtgcctcgggccttgcagctcatttcaatcctgtcccttctctttgccgtcaatgccttcttatccttaaaagctcaggtcaagcatcaccttctccacgaatccttccctgactccccattctggtctttatccctccttcagtgtggagacccagtagatatatgtgactaaaagctagagcactggggataggtgaacacctcattcaggccaaagagggtgcctgcttcctttaggcttcggggaaccaggaggggttttggtctgggagatgagttgaggaggactgtgtgcaggagggctcctgtctgtgtgagtttgtgtagtgcctgagttttgctgcagttcaggtgagctgggggctcagtatgtttcagtcttggctctgttgcttagtgatgcccaacttttgttgtgttcccagcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcggtgagtgctgcagccaggagatggggctctgggtggatggcctgggatccctggaatcaggcctctggaaggtatgcaaggatcacactcctttctgtgcaagcctgccaccagcccactgtgtggccccgggcaggtcacagcctccctgagcgctattctcttcatcctcacaatggagacagcacccacctctctggcctcctgaccgttaagtgtggggccatggccggctttgccagttacccatggtctgattttccatggtgttgggtggtttgcttttcttttttttttttttttttgagatggagtctcgctctgtcgcccaggctggagtgcagtggtgcaatctccgcccactgcaagctctgcctcctgggttcacgcccttctcctgcctcagcctcccgagtagctgggactacaggcgcccgccaccatacctggctaattttttgtatttttagtagagacggggtttcaccgtgttagccaggatggtctcgatctcctgagttcgtgatctgcccacctcagcctcccaaagtgctgggattacaggcatgagccaccgcgcctggccagaggtggtttgcttttcctggggttggccacatttgttgattcttgttgcctttgacagtccttaccccaacccccaagctcaccactggctcggacctccttgtggtgtcccagcttctcctctgccaccctttagtactgtcctatgaggcctgggggtataaatcgcacttcctgtcccctgtgcctttttttgaaagccagggggaggtggggatgggggtcttggcatgggggaggctttgtgaagcccagtgtggtgccccaggagaggaggccaggccccttgccctgaggccccccaacccctctctcaccagatgactctgactacgatgaggtcccagaggaggggccgggggccccagccagagtgatgaccaagaaggtggggccaggcatgggactgtctgcctgtcagggtgttgtgggggtgcccagctgcctgtcagaccctgaggactaccagacagagagtgggcagccatttcccgggaggcttccccttcccccacctcactctcttgccatacgggggtcaggagtcacgtgtagccacagcgctctgggccaggggtcggggctctggtgtggctcccccaggccctggctgtatgtgggtgggcatgtggcctccccccaccctgtgtgttaggaactcgtgtcctgtcccggagtgtctgtctctgtttcacttcttgtgttcccgtgtctgtctgtcttgcatccctagcccgcagtctttttctctgtccctttatctttctgtttttgtctgtgtcctaggtcggtttctgccactggctctcctgtccctgtgatctgggtctctgtgtggtctccgctggcagggggaggggagtgtgaggaaacagaactaaaagtgctgggctgtgtgggtcggggctgtgtggacagagggggcgtggcagccccgggtgggtgtgatctgtggcttgaagggaaggatgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaagtgagtgtccggccaccctccttcccactgagcccaacctcagcccgccccctccttgcctcctcagcccggccccccatcccctcatctctcgctagtggcggatggcataccagcagcctgagcttgtccttgcccagcacaatagctgcgccacaccccatggacgggccgcctgggggctccacccccgtcacaccagtcatcaaggctggctggctggacaagaacccaccgcaggggtgagtgaggcctcttgggtcctgctgtgctctgcatgggggggtggggggcagtgtccaggaccccaggacactggtatcactcactgatctgaaaaccagaagggcctgcgatgatttgcacaggtctccctccaggcacactgtgaccactgatgattccctccagacccattttattgccctgaaaattgggagatcgctgggcatagtggctcactcctgtaatctctgcacttgagatactgagatgggaggtttgcttgaggccaggagtttgagaccactctgggcaacatggcgagacctcgtctctacaaataaatttaaaaactagccaggtgcagtggctcatgcctgtagttttggctacttgggagactgaggtgggagaagcacttgagcccaggcatctgaggctgtagtgagctaggcctgtactactgccttccagcctgtgtggcagagtgagaccctgtctcaaaaaaaaaaaaaaaaaaagagatgtgctactttgagtctgacttcagtcactcttgctgtaaagtccatcttcttgccagtggccatttgggattcttcctccctagaacctggctgatcctcactctgagtgtggcttctgagggctggggtggtcctggaacctgtcctcctacccccggtcatttgcttgttgtccctctccctctccagatcttacatctatcagaaacgatgggtgagactggatactgatcacctgcgatactttgacagtaacaaggtgaggcctgcatcagtcctgacgcgacccctgctccagcctaggctggccccaacactggagcgaggtggcgtccctccccagaggagtcctcgccagagttctaagtctgaccccttaacccatgtcctcctggccctctgcctgctgagggctgcagtcagggtcagcacagggtcttgtctctaaccagctgcaggagacagggctgcagacttcattttggctgaggctgggggagtcagcgaggtgctgggtcccaaaatatagttcctgtctctcccccaggacgcttactctaagcgctttatctctgtggcctgcatctcccacgtggctgccatcggggaccagaagtttgaagtgatcacaaacaaccgaacctttgccttccgggcagagagtgatggtggggagtgtggggtgttgtgtgtgtgtgtagaagagggtagagaagactggaagtttgggcagaggagggggaagagagtcatggtgcatctgccctctcacatcacatccggggaggcatgctgcctttgtgaggtgggcagaggaagggggcaccctctgtgaccggctctgtgcttggcacggtcactgactcctcagaaccacacaatcagcgggagcaggcttggaggggtgaggtcacttgcccagcatcagtggcatagctgggattggagcctgagctcgttcaagtcagagaagtcaagcaaaatgatgggggcatctgagtgggctttctggaggaggtgttgcatgaggagcctagggccaggagacccctgaggggctccctgcaaccttgggcttactcctctacccttctcctgcagtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggtgctaaggggtcatggaacctctcccctgcccatgtccacctaccctgccccaggctgacctagggccttagccctgccttttctgttccctcttttcctgcactgggcccagccctttgcctggatatgtcctcgctcccccaagttctgaccacttcccccaggctctgagcactgccctccagtccctgccctggcccttgctcccccgcacctctgttcattgctgtgtgggccctgaacctgcagccccttaccctgcccagcctcccatgtcccctgctgtctccctcctgggcaccccccccagtccctgagttgcaccaccttcccttcctctccctgtcccaagcctcacgccctgcccccaaagccttgccctcatcccgtcccatctgccctccaggagtaccacctgggcattggcatcaccttcatcgacatgagcgtgggcaacgtgaaggaagtggaccggcgcagcttcgacctcaccacgccctaccgcatcttcaggtgaccctccatcttcttggctcaccggcatcctcactccttcctaatgttttccttttgcgcgacgtgggaagctgccccttcctatgggatgggttccctcaccctgccccgccctgccccacctgtggagcccctctcccgtcacttgctaaccctctctgatctccttccctcctgagaggtcttactctcccctgtgctgcttggcaactgctgtcctcccctgcccgccatgctgctcaggggttgcccatctggcctcctgctcccactgcccctgccccactatccctgcgcctacgccacccctggagagtgctcttgtctctcatgaggctgctcctcagtccttgtctctgggccaccaagcctctgccatcttggtttcctctgacctcagctgttcattggtgtctttctctgtcctctgccctctccctgggcagccttgcccactcccaggccttcagccgctacctctgaggtactgaactatgcctgggttcgaatcctgggtccaccactgactagctgtgtgacctgggaaatcacttggcctctgtgtgcctcagtttcctggggaagtgtttgtaatactgggtagtaactgctcaataaacactagcatcactcccaacccttccacttctctgctcttagtccaggtgtctgtctccagcgggatctttctgctgagctctggcctgcatatctgacagctgtgggcatctccccttttcagctccctgttcttcccagaggcctgtctctccaaccaagaaggaaggactcgtgcctttcctttttttttttttttttttgctttttgagacagagtcttaggctctgtctcccaggctggtgtgcagtggcacgatctcggctcactgcaacctctgcctccaggttcaagtgattctcctgcttcagcctccccaagtagctgggattacaggtgcacgctaccacgcccggctaatttttgtatatttagtagagacagggttttgccgtgttggtcaggctggtctcgaactcctgacctcaggtgatccacccacctcggcctcccaaagtgccgggattacaggggtgagccaccacacctggcctgtgccattcctttttaccccatctggccccatccctctgctgtcacccttctagcccaggcctggtgggcctttggccccagcgcctgcctcctcactcttgggccgcccgtgcctgtccagcctctttactccaactgctttgacttctgcgggagccttatatttgagagctaagtttttatttgctcatttcttgcatttgaagttctctttgatgacatccttgccctgagattctttgccatagtccttaactaccacacagctgcagccccgcctgacgggcgttctctgattgtcagtctgagaggcctgtccgttcctgggtttcttgttgtcatcaaccctaaagaggtagacttagtgttctacacaaagggcctcccccagctggcatgagtggctcgttgcatttgggtgcaagcacaggaaggtgagcttggtgcttggctccacctttggcagttttgcgaattccacgtgctaggttgtggaggaggaggtctccagcacctccataaagtggcattaatggccatcacacctccagcagcgatgccttccttggttgtggcaatgggtcatgggtggagtagactcatggtcacatgtgtgactcggtggtggcagggaaagagccagaggggtctttttaaaactaaattttttcagggacagtcatcatttattgttcaaccagggcctcccaccctgaagagcagggcatgctatagcggccacaggtgtctcggtatgttgggccagtggagttctttgtggagtggggttatggagcatgtcacatttggggctgggacaggaatgaggatagggatggcggaggagtcttttaaagacatctctgtaccctcccctccttcctacttaaaccctctgtgggttctccattgtcctcagggtacactttgacttcctcttcctgatgcaggcctgtccctgtccatctcccacccttttctctgccagtctgcccttctgtctcctggaatgccccctgtgcaatcctgcccctttgcacatgctgttccctctgtctagactgtcctttcacctcttcacctggctcagcccttctgatctgtcgaatcttagctcaggcatcattttcttcccagcagccttcattctgcgggctgggcagagccccccactgggctcccctgcccccatacgctcttgtgttcctgttgtccttgcctttgtccacacctaccttccctaccagagtgggatgcctcactcttttgcctaagcgctcccaacaccttgtcccccacttcattctgtgcatcctcatgctgcccccaaatccctctgagtccatccccactaatctccccacccctatgtccccagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggtgtgtgcatgggggtcggggcaccaggcagaggcatggcggggttggccagttgggatggcaggtatcctatctggaggagggcctggagcggagacagcactcagagagctgctgttgatgaggcttctcctgcacacctgtgattagctttgagtccttacattgccaggcaggggttcaacttctcccatcacgggtggggacacggaggcacagggagaggaaatggcttgttcagggtcacctggcaagtaagtgagcccagatttgagcccaggcttgttggggtctggtgttcctctcatgtcagaagaatagggaaggccaggcaagaggagttggcaggggccaggcagggctttgcatgcagagggaggagctggtttttgtctggagggcgatgggaggcggggacatggtcagatttgtgggtcagactctggctggtgggtgaaagctgagttagaggggcaagactggagaccagtgaggaggctgccataggatccaggagagggaggaggaggaagcctggcctggggaagccgtgagcatttgagggctgttcaggatctatggtggaaaactctctgactgactggatgaggaagatgaaatgcgagagggttgagcccaaggttcattcatctgctcaatcgaggccactcattctggccactgtgtgccagatgctggggattctgtcctcttgggagctgacgtagcccaggtggtggctgtgggctgctggaggtggggatccaggtggaggagcaagtctagggaagtgtgctggggaggccctctctgaggaggtgacatgccagctgagatctgaatggcaggaaggagtggccatgaggacatgggtgatgacagtctgggtagaaagatgaaggaggggaagcaggtaaggagttgtgatctaattctgggagccactggagggtgaaagcagggattagaagtcagggatttacattttaaagagatcacctctggcagggctttgttaagagtggcctgcaagaggccaagcatggttccagggggccagttgcagagggctggtgcaggagcccaggcaaggattacggggctcagtcctgccctgtggggagcaagagtacacggctggattccagagctgccagcaggcctaccccctggggcctgcctgtggcctctcatccctgcctgtcccagtagacactgggggtgggtaagtgctcccgtgaagggggggcccaggtgattctgggtctggccctgtgtctacaggggagcaccgtggcctgggcgctggcgtctccaaggtgcggagcctgaagatggacaggaaggtgtggacagaaacacttatcgaggtggggatgcccctgcttgccaccgatacttggggtctgccccattcaacagctgtctgggtctcccagccccctccctatctcagtgaccacagcaccttggagctggaagagaccctttgtgataatctagtgggtggggatttcggaaaagcaatttttggcaaagtcagcaaactggccagtgagctaagaatgtttttatagttgtaaagtgttatttttttttaaagaaaaaaaaaggaagaaaatgcagcagagactgtatgtgttctgtaaagccgaaaataattactatttcgccctttagagaaagaatttgctaacttctgatctaatttcactgtcatccattgaatagatgtgtaaactgaggtcctgggcagggctgtaatctgcctgagattaccctgtaaatgcatattgaccaccatccctgcctctttccatcccacttctggctgacccagggccttctcccctaccttgcacagcccctcagaggccctcagcctccatttcatgtgaactcacatgtaccagtgggtatatatatgtgtgctgtgtgtgcacacacgtgtacatttatgcccctgtactggaaactcccaggtacccatatgtggtagatataggggagaacctgcaatgggagggtagacccaggctgcagactccagacacttggagtgtcacatccgtttctcacctccccacggtgtgtttggcacataagtgctaaggactttgcatatgttaattaactgactttcagaacaagccaggagttaggattagaataaccagtttacagccttgaagcccagggagagaaaataacttgctggaagacacagagtgaatcagtagtggcaaggacttttctgctttgttctgtgctgtgactccagcaccccatacaggacctgacaaggaggcaaggtggggggcctaggaaatggctgtggaatgaggagccgaatgaaggaactgattaccaaatgctggatccctgcactcacccagaatccacccccatccctcttgcccagagaggaatgtcagggataggagaggtttccaaaatccctgcccaccccattggctgacaggttaggcacccatccccagctgtcacagcctcaggaatgcagagctccagatgtggaactgggtggggcagcagcaaggcccctgggaccaggtgcaaggcctgaggcatccacctgtcagtctgctgactccctgtcctgtcactgagcctgagacctaggctcagagcccagtgctggtggcaggagcatccccagccaccagcaggccaggctgtcctcaccttccccattgggaaagtgggcagatggcctggctctcccagcccctttcctaacaacctcagaaaccaagtttctgcccggcacggcccctggctgtcagctggcccgtctgacctcctgcacacccccacagctcttcttacagctggggaatggcgctgggaaccgcttctgggcagccaacgtgccccccagtgaggccctgcagcccagcagcagccccagcacccggcggtgccacctggaggccaagtaccgtgagggcaagtaccgccgctaccacccgctctttggcaaccaggaggagctggacaaggtcagggcactgcagctctggggccccttgggaccacccccgtctttctgctgccctgttcctcatgctgtcttaacccatctcatctaccagctcagggagatgtcttggcatatggggaaactgatgtttggagggcagaagggccctgcctaagccatgtgaaaagttctggccatgcagggaggagccaggcctgacccttgggccaagggcacatccccagcatctgtctgtctctctcccaattcctcagtctcctgcaccccgtccggttgcttctgaatcctgccaaaaagagtgaacttgatggggatgctatttcctgtcaggctcatgaaaaacagctgggctgctctgacccatccccatccacaccccactcaagatgaggccccgcatgggccccaggccctgacaggctgggagccaagtcttaggccctgatctggctctgcctgagtgggaggcagccagctccgaggcaggggtatgccatttgtgacctctggttggccttcagcccctcccccaaaccgcccctcccaggcagactcagtccagctagaagcccggtgggagtcaggcctccacctcccagggacccaggcgtcctgctcccagcccaacccagtctagcctgcaagccaggagggcggcaactcccattggttgggagggctgggcaggcggtgaggaattcaaatgtgggaggaattagctacaaagcacaccccccccccggctcctccacaaggcagaaggagcttgagatcctctggaggctctggctgactgggcagctgtgtccaggcagccagcaggggtgaggccccgggcagctgggatcccctggcctctgctaggcagcccctgctcacccctcctccccttggcctctctcttccctctccttctctctttcttccttcctattctctctttcagtctgaggatggactgctccaggcctgggtgactccttccttttctttcctctcctcccccgtagcccctttccttgtgggccccctactccttcttgggctgaccctcccctgcctcttcctaggccctgtgtgctgcagtcaccaccacagacctggctgagacccaggcgctcctgggctgtggggctgggatcaactgcttctcgggggaccctgaggcccccacgcccctggctcttgcagagcaggcggggcagacgctgcagatggaattccttcggaacaaccggaccacaggtgagcgtggcagagggtgggggtccaccaggctgtgcagtgcctggtggggtttgatttacctgctgctctcaggccgtgatcgcagctcctcaagggcctgtgataaatcatgtgtgagctggggtgtgcttgggtttgcatgtcagtgtgtatttgtactacgtatgcatgttcctctgtgtctgtgtctctgtgactgttgatgacttccctgacttgcagtgtgggcccctcaggatggctggcagctgtgctggtgtttgtgcgcctctgagccccccggatttgtgtttctggggatgctgagagctttggagtacatgcgtgtgcagagtgtgtctgtgttgctgcgtgaggggtgctgagttacatttctccatgggtgggtcacccacctaggcagccctgtctactgccctgcttgggtggagctcaatcctgaacttggtttgggtaccattggctccctcttggggtgggtgaggaggggtcagtgggctgagcagcacagctcgtggcccaggcctggactctggggccacatcccaggactgagggtggagctcaatggctggggctctgggctcagggccatgggtgggcggggcacactgggctggagagagcccaggtgtccagggagacacaggagaccacccaactggcttgggcttggggacagatcaccgcccccccacggcgctgaccgtggggaacagggctgtagtcaggctgccaccttgagcttcccgctgtctgggacaatcctctttccagggattattattgagtttgcccaatgcccccctcatgccagtgtgcctggcctatgcctccaacctggagagtggggtggggcaggaatcagggaggcttcctggaaggggaggtgctggaactgggccttgggagtggagtgaatttccacaagtggggagaggtggagaaacagcctggacaagaccctgcaggtaggagggggagcttgaggctgccagttagggagctggggctgatgattcgaaagtgagcctgaatgcccaggccaggtgggagtgaggtggggacaccctcttgggtggccagcatgacctgccatcctttccccgcctacaaagaggtgcctcggctggactcgatgaagcccctggaaaagcactactcagttgtcctgccgaccgtgagccacagtggcttcctctacaagactgcctctgccggcaagctgctacaggaccgccgggcccgggaaggtgggtgccaccccagactctgctttagcccatggcatctggtcacggctgcagggctagggaagccagggctggccagactggtggactctggcagagtcaccctagagggcttcctggatatagtctgtggtacacagtaggtacttcctaaatgatcctggtgggagtgggggtagtgcatgacactgcagagcaggtcagtgccagagtttctttggactaaatgagcctttattgagcccctactggatatgggctctgctgagcatctggtagtaagagcctgtggctggtagggagtttgaggactgaacgaaagccctatccatctgatctcagccttccattcactccccaactcagaagaaaatccacaagagcccgcacagttggccaccacccccattacctctctgaaccacccccctaatcactctgccggtctcctcactgtttctcagacacgtcgtcacctaccaggatctttgcctgtgctgttccctctgcctgaaatgcattcccccaggtatctgcatggccagtccctcacttccgtcaggtctctgtttcagtatcactcctgcagagatgtcatctctgactaccttatgcaaaatagcaccccccatctctccctttacccttttgagatggagtttcgctcttgttgcccaggctggagtgcaatggcgcgatcttggctcaccgcaacctctgcctcccgggttcaagcaattctcctgcctcagcctcccgagtagctgggattacaggcatgcgccatcatgcctggctaatttagttagtagagatggggtttcaccatgttggtcaggttggtctcaaactcccgacctcaggtgatctgcccgccttggcctcccaaagtactgggattacaggcgtgagtcaccacgcctggctaccctgcattttcttcacaccacttacctggtactcatttgtccattaatgtacttatctatagattctctgtaccccactgggacataaactccttttggccaccactgcctgtagcccccagatcctagaacagtggctagcacacagtgggcacttggcaaatacctgcagaatgaaggatgactcaggcagagctggtgctcctggagggagcccacctgcggggacaggcctgaggacacattgctctcaaagagcacatgtcaggccctcacagacaggatgagagacagagtctgctgtgggaacattgtgaggtcattgctgacaacatccctcagcacctcctgcatgctttcctacggggacaaagccctccaactcccaaagagatttctttggaactccatgctgttcacaacctcattgccccaggtctgcctccctctgcctgacaatgtcatttatgtaacaactgcctgagtcatcctttttgccctggatgccaggaagctctgagccactgtaaagctcagtgctgtgaacggtacaagcctgcatggccatgacagcctatcctttccattacctttcctggtccagattcccatttctgtttcttttatgggaccttgccagtccttcagagccattgtagcaggaggcagagtacagagtgatagatgcttctggaaaaggaggttggggcatagaaggcttcctgtgacattcaggtggtgggtagaggggacaaggtttgcaaaagctgggagtgctgggtagggatgtgtgtgtccaggagtgacagagaggcagctggagagacgggcaggggtagacctggcagggccttgaatggcaggctgaggggcacagagtctgtcctgaggaccatggaatggttttggttagaggaaggatggggtctgattttagctagatcactctgggattttggaaggggctgctgcagaggcctgggggagcggatgacttgtgggctggctagcgtggtggggatgcagagaggtggatggatttagggaaaacttgagagaatgaagagctcatgggtcagatgggagcaggagccccgggaggatgcagaggtggttttcaggtggtggggggctccctgatggctcccctgcccaaattctccccagagttcagccggcgctggtgtgtccttggtgacggggtcctgagctactttgagaatgagcgggcagtgacccccaatggagagattcgggccagcgagattgtgtgcctggcagtgccccctcctgacacccatgggtgagtactcctgggcaaatcagactgtggttgctataaggtacaatcccccactggggagacagggaaatagacccagagaaggggaggacctccgcagagtcacacagcaaacggaggctgcacaagggccgactccagtctcttgaggccccagcccaagacttttccaccacctcttaggggaccagaataaggacaagcgccaaggcagtgcggagggggcagaggatggcggttgatggtgcgggttgggggtgggcccgtgctggatgaggtgggcctgagtcctggcctgtgtatttgcagctttgagcacacctttgaggtgtacacggagggagaacggctgtacctgtttgggctggagagtgcggagcaggctcatgagtgggtcaagtgtattgctaaggtgagcctggggtagcagggtgggtgtaagggtgtctgactggggaaggtggggcctcctggccaatcccatgtatcccagctcccccgtctagagagcagaagctagatgcagggcagcagacatggagcgggcctgtcccaccaagagcctactgtaatctgcagccctctgcggagttggtcagacctatcctagctctgcagaagaagggctgtgggccttgcactccataggtgctcaataagtgtttaacagtgaatgacagtcagagccatcttaggatggacagtgcggcctccagagggggtgtgctcctcgttcctggaggcgagcaagcagaggctggagggaagaggcagggaggccaccgggagagctctgcctcggggactagagccaggtgcctgtggggtcccctgtgctgtgagagcctgtgactttttatcattcacttctccgttgatcagttgtcttgtgcgcctcctgagagtcagccctcggagacctgggacccagatgaaccaggcttagtcctagctcttcagtagcacccatgtgggtgggggagacagctcccctgcgggtgtagttcaggcggcagcagcagtgtaaccagtgccacaacagagggcaagaatgctttggtgctgtgggggcccagagaagggccctccagaaggtgtctgggaaggctttccagaggcgggcacatctgagtgggtatgaagtggggcatggtacccaagttccatcactgggcttggttctgccttggggaagagaagagaaggcagctgggtgggaagagggcatgtgcctgtaagccaaggagctggggcattggggcaggcagtgccgttggctgatgctgtctcccccggcgcctctctgccaggcattcgtgcctcccctagccgaggatctgctggcccgggattttgagcggctgggacgcctaccctacaaagctggcctgagcctacagcgggcccaggagggctggttctctctcagtggctcggagctccgtgctgtcttcccggaggggccctgcgaagagccgctgcaactacggaaactgcaggagctttgtgcgtggaccagacctgggcccccagcctccagggcaccctatcctgggctcccaggcccccagcccttgcctggaaatctgaactctgcctggcctggccagagccgccatcctgccctctcatgtccttggggtgcatctcagccaccccatacattggtgggcgggtctcaagggtgtgtgtgtgctcacagagggagggagcaggttggggatcaggagcaagacctgggcctcaccttgactaacccctccacagccatccagggggacagtgagaaccaggtgctggtgctggtggagcgaaggaggtgagccacggcctccctgaggggctctgagaaggctggagcagtctgatgggcctggggacagggtgggataggtgtaggcccctcagtgactgactgtccctggcccaggacactgtacatacagggcgagcggcggctggacttcatgggttggctgggggccatccagaaagcagccgccagcatgggggacacgctgtcggagcagcagcttggggactcggatatcccggtgatcgtgtaccgctgtgtggactacatcacgcagtgcggtgagccctgcccctagggtgccagccccgcccctcccggagagccgcctcccgccccagagctgcgcggccccgccccatgactctatgcctcaggccccgaacgcttggccccgcccctccctaggcctgacctccgagggcatctaccgcaagtgtgggcagacatcgaagacacagcggctgctggagagcctgcggcaggatgcgcgctctgtgcacctcaaggagggcgagcagcacgtggatgatgtttcctcggcgctcaagcgcttcctgcgcgacctgcctgatgggctcttcactcgcgcccagcgcctaacctggctggaggcctcaggtgggccctgcagcccgtgcccagcctcctcctcctccacccatccctccggactcctgcgcccttcccttgtggcacttgcactaggcttaccctaacccacaggctccagttgcctgcctctgcttctcattcccatcgccgctccatacagagccaggggccctggaagaccgagagttccttaccctggttgaatgcctggcctgcattgacttggagggcacagggactgctgtcacccaccatgagaggcacagcagcccaggcggggtggggggaagatagttacagggggtttctgacttgatttatctttcccacccagagattgaggacgaggaggagaaggtctccaggtaccgagagctgctggtgcggctgccccctgtcaaccgggccacagtgaaggcccttatcagccacctgtactggtgagggacgataccattgtgagattctggggggatgggatgaaggttcttctacccccaccctggctgactaccctcctctgggagccagctgggcttttgcaccaagtgctgactgtgatctgccctaacattggatatttgtagagcagggttccccagtccccaggccacagaccagtacaggttcgtggcctgttaggaaccaggctgcacagcaggaggtgagtggtgggtgaacaagtgttactgcctgagctctgcctcctgtcagatcagccgcggcattagattctcaaaggatcggaactctattgtgaaccgtgcatgggaggtggcgcgctccttatgagaatctaatgcctctgaaaccatcccctgccccccgaccctgtccttggaaaaattgtcttccatgaaaccaatcccttctgccagaactgttggggaccactgttgtagaggatttttccaactggggccagggtaccttgtctggatctcccagcttcccagtcctgctcctaccaggacccaagatatggccagaaaaactgttcctaccctgttaaacagtggtcccctctgaccagaccagtcttggacctgtcagaaattaatagggtgagatgggaagctctggcctgactcctcactcaaagccctcctcctcccctctccagtgttcagtgcttctcagacacgaaccagatgaacgtgcacaacctggcaattgtgtttgggcccacgctcttccagacagatgggcaggactacaaggctggccgtgtggtggaagacctcattaaccactatgtggtggtgtttagtgtgcgtccctggccagtgggcagtggagggcaggggtgatccttgcagatgacggtgaccacctgtccctgcctctcgccccttcccaggtggatgaggaagagctcaggaagcagcgggaggagatcactgccattgtgaagatgcgcgtggctggcactgccagtgggacccaggtgaaggctggagcctgggtggggggcttggacctgccacctgcacccatttcctaggcccccagctgagccctgtctccctgcagcatgccggtgacttcatctgcacagtgtatctggaagagaagaaggcagagactgagcagcatatcaaggtaggtgctgggacctagaagccaaggggctagagaatcaggctgggccaggtacaggctcagatggccaggggagcagtgcttctaccccgaggagaggaccagtttgggacctgtatctggctggtgctggggtctgctcctaaggaccactcagaaatacccctctctatcccaggactccagaagggcctgagaaggatgggctcaggctctgagtcacatagcaaggttgtggcagagcaggggctaggcacaggcaggctaatctcctccttggtccttgcaggtcccagcatccatgactgctgaggagctcaccctggagatcctggatcgccggaacgtgggcatcagggagaaggactattggacctgctttgaggtcaacgagagggaggaggcaggtgggtgacgctgggcttgtgcagggtgtggtatggcttgtcttgtctcagctgtagccccagtctgtcctcccctaccctgcacatgaggatgggtggtgaaaagggctttgatgacatgttgctgtcacactgatctctgtgatggtggtgatagggtgctggcagggattgaggttatggctgtcatgtggctgatagaagatgtcagtgacagtggtgatggttgaggtgagaaatgtattttatggtaaaggtggtcttgatggcagtggaggatgaggctgtatctgttcatttgttttactatatttgttgagtgccaggcactgggctagggagccacacacacagtccctatcctcgtgggggttagtctggtgtgggacggaggcattagtctaatgatcataccaataaatgttcaactacagatgcattaactgctgtggaggaaagacccttggcattgccaggtcttccctgagccaggatgggaaggaagagtaggggttacttggtgaagaaggcaaaagccctgtggtgggcagaggcacagccctttcaaggagacgagggcagtgagggggtggtgacatgggtggggctggagatcgaggcagaggcagccatgcagggcctagcagcaatgcaagaccatcggagggctagtgaatggcagtttaagaagattgctactcgctgatgggtggggagagggaaattagagcacactttgaaggccatggtttcgtccaaggagaaggcggtaatgtgggctggggtggcagcagtggagatagacagagcagagagattcgacgtgtggattgggagagggaggaggggtttgtttctgagttgagcagcctggcgggtggtggtggtgtttccctgatgggggccacagggagggtgggatgggaggcagggggtggagatcatgggcatggttttgcacatgttgaatttgagcagctttggtcacagccaggtgtgtcaagcctgaagcttggtcatgggaagggtggtcatgatggtggtgttttgtgtcgtggcacttgcatatggttggagtggacaggggatgtgtaggtgatatgtgcccatctgccagcctttggtggtatcgggccatgtggtcccagtgacggtaggtgtgacctctccccagagcgccccctgcactttgcggagaaggtgctgcccatcctgcacgggctgggcacggacagccacctggtggtgaagaagcaccaggccatggaggccatgctgctgtacctgggtaggtggtgcctgcagggtggccaggctccgggtggtcctctcttccagagccagggtgggacctggtggtgccaggtaggaacagctcagacagagggcgccaagtgggtgggcctctatggagaggctggggcaggatggggcagcttccttcatcctgggacccagccccgggtaggggttggtgcagcctgtgcccactccagtcccaccccccagccagccgtgtcggtgacaccaagcatggcatgatgaagttccgtgaggaccgcagcctcctgggcctgggcctgccctcaggtggcttccacgatcgctacttcatcctcaacagcagctgcttgcggctctacaaggaggtccgggtaagtggccccgctgggttctgccccagggtgggcacctgtacacctgaatgtgctcagagattccccttggtctgcaagtggaaatattcccgttacaggctctcaggatggcacagcagtgggggagaactgtagactctcaagacccctcctgctgtggccctggacggccactctagtgtgccctgtagccccactaagccctggcacccggatgccatcacaccactccatgcccatgctctgtctcactgtgcctgtgccttatcactgcatccacaggaacctgttacttgatgacagccccaagttgtgcatgcatgccttgtcatatcgtatgtcatatgcctcccgggccacccttctccctcattctgtccacatgcaggtgttctcccaacccagactccatttgacaccctccaccttctgcacatacatgccatacacacaccccaaccccacacatcactgcacatgctgtcctggctctagacctgggacttcttccataaccctgatcctctatcaaacagagccagaggccgtggagcggggcccctgagaccgtgagtagctgtgggctgactgccagctgccttacaccacctgggggccaaatgagctgggtgggagcatggggagacagccagggctcctggccatctccaggcatggatccctgcccccttgcccgttggcactggcccctatcctggggcctaagctcctcccctttatccctaatcctgtcccagggtcctttccccaatatagggttccttatcagtgcaatgctctagaattttccaaaggacttagtgtagaagttaaagagccagtaatgatggcacctaggtttgaattagagccctgatcttcatctcctgtcatccctggagccaccttatttccaaccctggacagtgttccaggactgtcagaatgttcttgctactgccctgatcctaacatgccggggtgggacgagagaggcttgtgggatacccccacctggggtagcagtctctctgaggcttcctggctggctatttccactctgcacactcctaggagagagagctcatccctccgcccttggggctgccctgttcctagggggatacttctgtctggaaaaggtccttgctcaggttctgctgagaatctgcatctcatgatgcccccatgggtcccagctatgccttgggggctacagagcatagatgccctgcagcaggggtccccaactgttgggaacagggccgtgcaacaggaggtgaacatcgggcgagtgagcattactgcctgagctctgcctcctgttaggtcagcagcggcgttagattctcgtaagagtgcgaaccctactgtgaactgtgcaagcgagggatctaggttgtgcgcttcttatgagaatctgatgtctgaacatctgaggttttacagttttatcccgaaaccatccccccacccatggaaaaattgttgtccacagaactggtccctggtaccaaaaagactggggactgctgccctgcaggatgggcaacagagacatggttccaagcctggtggtctagcctgagctcccacagctacccaccaccccatccccagtgtcttcagcctcttcctgccccttgcatttcctgaggtcatctgaacaggcttggctgccatggcaggagcagagcagatagagcaggacctcatctccttctctttgcattttgtgcctcctctaatgcatcctgggctcctgctaaccctgtgggaaacaccgtctcttctctcctttgccctcttctgtgatcacatcctcacttctgagcctatctgcccatccagtcaatcccccttggttctgggatgctatttccctggccgcctccctctaggagtgtttagaaccctcactgtgggcagaagggagggaagatggctgaggtacctggaaagggacgtgtggatccctgggcatggaaggaaggaggcaggagagctagaaaaagggatgagatctaatgttccctaaggaacctggcttagtgctggcccttcacatactgagacatggaatccttactactgttctctgaggaagagggctgtccccacttccaggtgagaaaacaggctttgtgtgacttgcccaaggccatctataagtgtagactgggacttgcacccaggtttcttagtgtggaaacgcaagcttgtattcctggaagtctcagacttgaggactcagcagggaggggtgctcagcacagggtaggtggtgctcttcacaccccagagacagccaacacctctggcctggcagaggccctgagcagatgtgagctggttaccacggggttatcaactctggcatttgttggtttatgcggcagtaggacagaatatttgaaattgggacaatctcaggtgattcagtaggatatatgtccacttgtgccttatcctgggggtctcctcttgttaaagaccctgaggcacctggaaaaggcacatgctagaaagatcttggttccagcagagatccttaagcatcaagagtaaacgtcattgtctgcccatggccccatgccttggagatgctggaaacatgagccgtctgattagaaatgtccttgggccaggtgcagtggctcatgcctgtaatcccagcactttgagaggtcaaggtgggaggatggcttgagtccaggagtttgagaccagcctgggcaacatggtgaaaccctgtctctataaaaattagccggatgtgatggtgcatgcttgtagtcccagctactcaggaggctgaagtgggaggatggcttgatcccatgagttggggttgcagtgagctgagattgcaccactacactccagcttgggggattcattctcaaaaggagattgcattgactgacatccttccctcccaagacccacttctgcagactttctgactcagccacccttacatcacacacatgtcatgcacatcagaccccaaggaatcggaggcctgagggttgtgttttcattcttggagccacagcctggtttgaatgtcttgattcctgcagttgcctctgcgcctgactgggcctgtcccgtccaccctcaactcacttgactgcttgcttctagttctgttcccctcccacccacagcctgacttcttccaaacccacagcctgttttccatcccctcagccgattcctcctgtacctggagtccagtttcccccacatccttcctcatacccagaaccttgtgttttccatgcctgcagccgaatctcttttatagcctctgtctcagtctttccatttctgccatcagctgtcttccagtttgcaggccgattgctctagtgctcccagccttgcttcttctgtgtgtgcctacaggtttcttccttatattcccccacatcttgtttcttccatgtccgaagcctgatttcctcccgcctgcctaatttcctccctgtctgcagccctgattgttccatgcctgcagcccagttggttccaggccctcctgggcacatggccatcatcaggttaggtgctgtctgtagaagacatgaggctttccaatcagcaggtatcggggtaaaagcagagtgaaaagtccttactaaggccctcctaagccacaccccctgtgagagcacagaggtcttctccagtccctaagcagcccatccttttgtgatatcacaggaagtccaccagttcccaaaacttccccttcccctggctgtcctttctctggcccctgctgaggagccatgcctggtggtggctgggagcaatggtggggaacaggggggaggtggctcagtctttgacccccagtttcggttgtaagtgaatccccctcccctgccattcactctggtgcccctgtggactccaggggtgcctggtaggggtagggcttcaagcaagtggctcctagagcaggaggaagcctcattagcttgacctccaaccagcctcttccttgggggtcattgcccccatccctctgcctccgagccagcctgctccttccaagcccagacccatatgcagaggcgggggccagaggtgaacattttggcaatctggtgtccctccccagtacattggtctctcgcttcctgacctagaccattgggaagttcttcctgtggtctgttgaacagctgttctgcttcagcttgagtcattagcctccttgtggaaccaaagagctagtaactgctggtccctcaagccttctgttcacacggtcaaccctggagcctccatggggcagagagggctgagaaatgaataatctgagatgaacatagacacaggcagccaaccgaggctctctgatcacacccgctcgttccagtttggtgctgggggaggatgtacagttctccctccacatacaatctgattcagggtgatacttcaagtcctccagtttgcagggcatcagggtggtgctgggattcgctgttacagatgtcccagttgggacggctgcctcggagactgagggttgactgtctgatactgctgcagggagacaggccttgggggcctagggctgggaggttggttgggctagattgtgaacagggagggctttatcaggaaggcttcttggaggaggcgccctgtgctgggatgcaaagagggctggggagttggaagagggagctgcccagtcgggagagcggccccagtgccctttctgcagactaaagtgccctcttctccttgccctacctcagagtcaccggcctgagaaggagtggcctattaagagtctcaaagtctacctgggagtgaagaagaaactcaggccacccacctggtaagctgggactgggcagataggcctgctactggggcttatgggggctcagaactgatgggggaggcacagctggggtttttaatttgacagagataggtgcaggggctctgatggtgtggtctccagaccagcagcatcacctggacacaccttcaacacaaattctctgccaagtgcagtggctcatatctgtaatctcagtacttggggaagccaagtcaggtggattgcttgagcccaggagttcgaaaccagcctgggcaacatggcgagaccttgtctctacaaaaaaatacaaaaattaactgggtttggtggcgcgctactcaggaggctgaggcgggaggatcgcttgagtcccgaagtttgggctgcagtgatccgtagtcacgacactgcattccagcctgggcgacagagtgagagcctatctcaaaaaaaaaacaacaacaaaaaaacacaaattctcaggtgtcaccccattcctactgaatcacagattctgagggtagggctggggcttaggggtgtcaagggcctgggaggctggttggggctgagacaggaagaggccaggatgtgccactcttgtgagaaggctctgaactctggctctggctctggctgtggcttctgggctctgtcctgggaactggggtgttgagcctctatggcctgtcaaacacccaactctctcccttcttcctctgtagctggggcttcacagtggtgcatgagacagagaaacatgagaagcagcagtggtgagtgagcgcctcatcctgagatcccaggctgaggaaagatggtggcacgtcccccttcattgtgtccctcatcactgcccagatctgtgaccactagcagaccctgggctgggaaggcagacacggtgttccctgctcagtcaggcctttggcatcatgtgggtccgcgtccaaccctgcaggtacctctgctgtgacacacagatggagctccgggagtggttcgctacctttctgtttgtgcaggtaccaggtgcagagtgtggggtgtggggtgggtccctggaggcttccattatggagaatggggacattggcttctgtgctattcaacccaccccttgcttcaaggagattttgagttgcttttaattcatttgctagtttattcaataaacccttcctagcacctactgttagtccagccccaagccagggatgctagggacagacaggacacagaccctgcccttggggcacccctcatgtggacaggaaaacagactcagaagtggccagttatagcccagtgtgatcagtgctgtggtggcagtgaagagcccaggggatctgagtcttaggaaatgtgggagaattcaccaagcatagaggagggggatgacttctaggcagagggaacggtttaggcaaaggtccagagatatgcaagagaagcacagattgttacagtggaatgtgaggggagaagccaggagtgctggaagtcagcacaggaaagggagtgagaagcagaatctcagaagaggcttgtaggtcacgccagggaaactgacctcgacacagaggtcagtggggaaccactggcgggggtgggggtggcatttaggcagagtgtggtgcaggcttgagtcttcgagggctcactctgggtgcagcgtcgggcagtgggaccgagggtagaacccagaggtgagcaggccagtgaggcagtggctgtggtagcccaggcagggacatggtggggatgactcctgagccagagcagggccagaggctgggttagacttaaaacagatgaattaagacacagagtttttaaagtgagagctcatatgtgtttagggaaagggagacaaaacaaccagggtgctaggctgagttctttcttggagctgtgttcttttagccctgagcttcctggtaagcaaagcctaaagggaaacggtggattttgtagttcccgattcctaagatggggtgcagacgtgttcctctaagagaaatgttttcttggttcttggaggggtttgtggatctggagattggagttgttgagtaacagaactggccgtgttttgccagagatgcagtcatgttctccccacagctgcttctcatatcggcggggatcaaagctgagggtgtcatctcagaccacagctggaggcatttctgggaagggtgggcagatctgaggctgagtgtctgggtgaactgaagctgagcccagccccttcctctctgctccccagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctgtgagtggctctccatgcctttgggcagggggctgggggcctggctgggtgcctgccttctactccacagtagatgattgccctgattgccctccccgattgccctccggccccctccctccagccttggtgggggccctcataggcctctttggttcacaccattcaaaggagccccttctgcctggccctggaagctgggagtcccctctgcctggccctgggagctgggagcctggctgattggagtgctccccggctggcagtggagagtggctgcagcagctgcagcagcttcagcggggcgccagcccctctgggccttcacaaaatacctgtgggtctcttgccttcctgcagcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttaccctatggtgctgaggcctgtgattggctaaggggattgggcgtcctggggtaggaggggacaggaggtcgggaagcccaggggtgagtgcctagtgcctgaagctgagaacctaggccttgctttctccaggccctgagctattcagacgacccccttccccaagcagagccctggcttgactccatgccttccccattgtactatcctgcagccaggctgggaatgccggtcctttcctggccagcactgaccctggctggacacaagcccctgtcctgctgcagtccgagtctgagtcccagctggggcctgggtgtggtgtgtcagtgactcaggcctggcagccctgcagcagccccctgctggagacacaaggtcagagccacaggagcctgaggaaattgagaagaagcacctttgggtcacctgtggccccagtgcctacccctccagaggtggggcctgccatgcaccagggggctgccctcactgggcactgcctggccatctccactaagaagatgaggccctggcctgcagaggaaataatgagttgctcagagatgggtttgggactccctggggaggtgccagacaccacattcccgcctctgcctagagcctcattaccacccgctcttcgggggctcagtgggcggacaggctgacctccatccttagcctcagccagtggggctgggcagagtgggtggggatgggccatgtgacctccgactcaggcatccagctcagtggggagcctgggtccagcggaagacttggggagctggactccaggttccctctcgctgtctcaggaaggggaggtatatggcaggagactggaaccggttccctgagtcctactgacctatttcacaggctggggctaagccccttgagtctcccacctcctgtgggtcgctctggccagatccacaggtcgaatgtctgacccttctgcctccagccaggacaggttggacccccttatccaagtgctgaggggctggaatccgctcctggatctgaccttgcactgcccagccagccctgaggcccacctgagtgggtgagactggaggcgccccctgctctgctaaggccactgccccagctcagcgtgctggctgcagtcctgcactaggccacaaggcggcagccatggaccactcatcattgctggaatcaaagcagggtctggaggatgcctgagtggtggtcctggcccagacctttctctgctggggtgtgaagcgggacccagttctgcctttggcctgcaggctggtgacattctggaaggcagcaccatacaggaatgtgcattggagtcctgggctctgggaaccaggaagaggagggaacagccttctaccaagtacctgctgtgaatcggcccctgtgccccctgcactgtctgctcttggcaagggggagctaggcccagagaagggaggcaactttcccaaggtcacaccatgctcgtgaagcaggcctgaggtccatttcccctgccctactttggtggggtctccctctttgactcccctcctgattccaacccttttctcctcttagaaatggcctgaggcagggggtctgaactgtcaggagttagtgatggcttaaagtgatttccctctggtaaggggtaggggtgacatccaaacaggagcctcagggcctcagccggaatgaaatatgcctgtgacaacagtgttggatgggttaggggcaggaggctctgctggtccttgtcgcaaggattcctaaaaatggggcctgttgggaccctggatggtttgctcattcacatattatttgaagttgggttgccatggatgagttgaagaccccagacctggacctgcagaggggccaggagcagctcttggaaagggaggggcttcctggacaaggaagtgctcctgagccagctttgaagaccggaggccttgccaggtgtggttggggtagaggttgaaatactgaaatattgggggaggaggacagggcttcaaggaccaacccaaatccaggcctagcccctggggaatacggggagccctgggaaagaaggccgaggcacgtcagagcctggatggtgagggcactgcaggtgaaggggaggctggggggcagaggggagaggggcagggaggtggggtaggatgtctgcctctctcctgcctccttccagcacaaccttcctaccctgcagagttctgaggagtcctggggcttctggagaaggaaatcagtgggacagggaagggcaagagctggggcttctttcctggcctcatgctctggtggcctccaagccacctgcccacagcccgctgtcttggaaagcacgcgtgtgggtgccagtgctcctgtttacaagctgtgtgactttgcctgagttacttaggtctctgatcctcaatgttgtcatctgtactttgcgggtattaatagtagctacctcctagtggtttgggcaattaaatgagctagtaagtgtgaagtgcctagcattgccccttgctaatccccttcccactgcactgtctgcagtttctgagaaggtatcatggcatattctagtcccaatatatttgcactcaacaagcacttattgaacaccaactgtatgcagagcgttactgaacactgagggggagcagatgagtgagtggtgtggaggaaggtagagacctcctggtaggggatattatcaggaaagactggaggaggtgagtctgaaaggagaggcagttctccacaggtggaggagaggaagtggtctgagcacaagacaaggggatgtgaccctgctgtggtcactacctgctgtggctgggacacagtgccctacagcaccctagggcctatcccccttgcgcctgcctctgagatatgaccacatcccagtccagtgggctccttgggatcatcccccatcagaataaggaacagttcctattctcttagccagctctgtgacctaagtgaccctgaccctgctctggggactgtctctcacataagtgcagtggcctgaacctcccagcccttcctccactacgacacctccttcaggaagctcttctgggttgctctcccatcccactgtgcctacttagggtatgcgtatgtgcccaggtcaccacacctagtcagggactcacctagggaagagcagtcggggacagtttccctggtcagccagggttggcccagccctagcatgtcccttctcctacaccacttccagcctgtggaaatttccatactttctctgccctggttacagctcctactgctgtatttatcaccctggagacacagtggcacaggcgcacacatgccacacacactcaggcctgcacacacgtgcctgcacacctcagcctgcttctccagatctgcgagtgcatgctgcgcgcacacacacacactcggcacgtggatgagcacacacacacggcacgtggatgaacacccacccacacacagctctctaggaaaattgctccccttccctcctgctcctcctccaccctgtcctcccaccaccacccacttccaaatgctgagaccaaagagatgggctggacggtgcctctcaccacttgtcagcctgggacgccctcctccctttgtgactagcatgccctcctccccctgcccgtctgcctccccagctctctctgcctccctgtcgccctgccacctccctgcgttcctgtgtatctgccctccacacaagtcactctgaggcctctctttgttactcttgactctgaagtggaaactgctcctcccagctctcctgagaggctcaggatggggacctgacctcatagggctgatggaggcatagggacaagtgaaagggaccccaggtcccgaatctcctcagctcctgtcaccttcagtccctcctattgggttaggggagggctgtgtgcctggcaccatggagaccagtgtcatggcaacacagttcgggtgggcacagcttcctcctcctggggtgtggggtccataagaggaggtgccgaggaggtgggccttgtgctggtgcccaccatggctgcctccagctcaccattcccaggacagcccacccccatccccccagccaactttgcttgccactgcagcttccagtgccacaagtcactgatcccatttgggaaatcctctctcaaacaccagctccagagctgggcgccagagagggcaggggcttgcccagggtcacacagcaagtctggccaagctcctgactctcagacctgttttctcctccggtctcccaccttccacccagaaaggggactgggggcagaggggtcagtccaacctcagttcccaccacgatcttcagccagcccttagagttggcagtgggagtgaagatgcaagtgatagtgccgagaaaccatcatggggcgcccaccacctgctgtgccaaggctttgcatgtgtcatcccattttattccaagacccaggaggaagatgactggtaagtggagtagctgggacaggaacacaggtccctctcagatggggcaggtgagtcaaggctcgtgtgtattgctgtctccatcaggcgctcttttaaaagaatggcaaagcttttaatcccatctttattaccggtaagagtgtagggggaggatctggggcatagcctgggtctggccttagggtttctagaaaccaggggatatttttctaagaagatagagaatagagctttcctagtgtggttagacctagggaagacctttcttgcagtgcagcaatgcagaccgacttccaatccctaggtcaagctggagtctagggacagaggggaggagacccctgcctcctgtgcccagcctcaacttgtctcctgaccttcatggagtcacgttgcagctgcctccctcctggcttatgtaataattcaaatatagcagctgcctttatcccactgagtcacaccccctgcatcccccctcaggtgcggggagttatgggggaagaggtggttcagggctgagtgggaggttcggggcctcctggcaaggaagatccctagtgtgctggattggagggtggtggtggtgagggggctggtgctgaggccccaagaagagcagagccttcgccagaatatgaagccacaggggccacttctgccctgacccatccctgctggaattccacattcctgggggccctccccagagtcacaagctatatgtacagccttctcttgtgggctgctgtctcagttggaggaggaaggagaggtggaagagtatgaagagggggaagtagtccggtggggcaatggccaccgtctttggtcctaggctcagcctcgcccttcactcactgggttacctgggcacccctctgacctcagttttcccatctgcacagtgaaggattagattaactggctctagcgtctcattctctctgatttataaccctggagatgatctcaacctgaggctgaaggcacttccgagtgtctggcccagccgcgttccaggctgacttccctccctcttttctctgccatccctcctagaccaatgcagccacccccacccacaagacaaaagaggcaggagagggccctggactcagctggggctgggcggcttctcccttccctgaactcgccatctgttccagccccccagccccctgcctagcagccatgggtaggtcactgccctcacctggggtcaccccttcctccccggagagctctgacagatatcctggaacctgaagtggatccttcatgccccatcctgaatcccaaagccaccttcctgaggtgttgaagaagctgctccaccttggaactactataggggctgtggtggcctttcattcctttatcagcaaaagcttttgtcacttgtgtggtgggggacatgcttagtgtgagaatgcagagacccatgccaggccctacccaaggacatggtgctccttcagccattgtcatcagagccacagaggggagcttcctggcagaggaggagtggggagaagctgtggaatggctccttgagctccccactccaccccttccccatgcctgggctcccattgcaaagacccagatgtgggcttatcctgtcccccagccagagggagtcacccaggggtgttcaggccaaccctttgtgaaatccatgttccaccagttaccagcctttctccggagagctgagggctgtctcacactgggtagtctcagcctgccctggggttgggggggtgctcacagagcagtaagcgtcactgcctgcatccccacacacctgcattatcttgtctgcaagacacgtgtgcccctgagctgagctctgttgtgcaccacccgatttccgtcggcctcctttctgacttttctccatcaacatttcctgcttgggcctgttgcgggctacccaaaggctgtggactggggccgaggtacataggactttggcttgtcttttgagctaacaggatcctgtagaagaaatgagatgagcctgagagggggtcggggggtgagacattagggaagggagaggccaccaagggtctctagcccagaatccaatgccccttcctgcctacctgtccttgtgggtgggaggcagggtgtgtgctgactggcccagcaatggtgggctaggatttgggataggcagagaaaaggaagaggagggggaagtcggcctgggaggagaaacactgtacaaagtcgaggaggagagaaccagagtgtgcttagggaccagacctggccccacctggagcagaggatggtgaggtcagtcagggctggatcgacaagggacctcaaatgccaggctgaggagcttggcctttatcctgagggcactggggagccctgcaaaggttttgagagggaattccattaccagatagatgtctttggaagccgcctctaggtgcaaggaggaggtggagtagagaggttgacctggggtaagggttggagcatgaccaggggagggggaaggaagcagggggtggggatggagggagtggatggatctaagagaatctactgtcctttggaacaaacgatacaggaagtgtaggagagggatggggcaaggcgactttgaagtgtccagctcagagattggaagtttgctgatgcctttgggaggccaaggcaggcagatcacgaggtcaggagttgaagaccagcctggccaatatggtgaaaccccgtctctactaaaaatacaaaaattagccgggcgtggtgcgggtgcctgtagtcccagctacttaggaggctgaggcaggagaattgcttgaacccgggaggcagaggttgcagtgagcccagatcgcaccactgcactccccactccaccccttccccatgcctgggtgacagagcgagactccgtctcaaaaacaaaacaaaaacccaaaaaacaaaaaactaagaagtttgctgatgcctttaatagtaacaaaaggtgtattggatgttcaatatttgagggacctacgggttgttcccagaggagatgtccaagagacagcctggacacctggagctccagggagagggatgggcagcaggggacacccggagttgttggtatgctgggagaaggctgcatgctccgtgggagtagggtggagaatgaggagagacagggccgccgtcctgcaaggagcatccatattgagggggcgaagatagggtgcaccagtgagggagacagaggaggggccgtctggaaggtgggagggaaacagccgcgcaggacggggcgggggcgggcgctgagaagaagccgccttcttcggcaaagaggtagctgaagcctgtggagcctgcagtcctctcaaggctatgggggcagcgcggaggccggattccagaactgaatcttcccatcgctttgggcagccaccctacctcccaggagcatccttcctgccatcccacctccagttccccagctaacaaaaaacggtgtttcttgactcccggcagggcggcggggcgggcaggtcttgtgaacacggctcgcagggttcagcaccctggagagaggcctgtggccggggcggggcctgcggcgggggtaggggcgcgcagtcagagcagtcgggcctttggctccgtctgggagcggtcttgcaggcaggcaattgatggaggagggaaaaacaatcttggattttctccagctctctcccctttatgcacctcccccatcccggcactggcctacaggagcccctatcccagcatttggggctattactctcctgacgacttcaggaaatgagatgggaggagaggggcaactatttactgggaacttttcagacattcccaaaacctcacaaccttttgagcttggaattcgtgaccccatatttcagatgaggaaactaaattgaagttcaggaaggtgaaataccttgcctaggcacttggcagagctgggatttgaattccacctgccgggctctaagtcctgagtgcccattagcccttctgagtcctgaatcttgcagtttgttcctgcagactctccacttctgggtggctgtggagtctggtgtggcagtgggatggggaggagaccttcccttccacctgcttgcttgagtgtattcccaggagatttctgaagatgaggccaccaccattgtttctgaagtgggagggcagaaaggaggctgagggccaggtgagacctcgtcacacctgcacccatgcatgcccaggaggaaccctcctttgaactcttctgactcagcttcttgctgccaggttcctccgaccagtgagcaggttcccaggacatgaaggggagctgtgagggagcaggacgccatggtccagggctgcagcttcctgagcccagagaatgccttcctagctgtcaggaatggagcagcgaggccccagtgataggtgaggtggagaagcaagacatgagttctgggctggctcagctgctttacaaccagcctgggcctcgttccctttgagaaaatggtttgcccagagttcagagatctaaaattctatgatgccttctggggccacagtgggaagcaaagactcctcatattttctttcctgacacttcccaggccacaagacaactgctttctgcagcacccagcctgggcaggccatctacacaagctcagtcatttctgaccttgccccctccaccgtgcacccccatgttcttcaacatgggtcaggtttctattcagcctcagggacttctctgcttgaagcctgttgtgtggcggggaggtattctccccacagctcagagagatggggttgctgtggagggtttgctgtagctcctctaccctggaatataccctcttctgccttaaaagacccagcttggaccctctcttccagaaatgcttgctaaccgcccccccaccacccaaactaggtcaggggtccctctgggcttcacagaccctgtgcttctttctgtcacagcctgcaagtctcccctccccactccccagcccgagtgcttctctgagacaagggatagtgtgagccatgagctcagccactggtaggccaatgaataagtaagttaatggtgaagccaggatccaaatccccatttcctgcctcaaggtgtggagctgtttctcctgcatacaatagtagctctgctgtgacaactctctatctgtcctagggcctaaaatgcctctatttcactaggttatagctttatcctagggagtcctctttggaagcagggtgggggtgcaacaggccttcccccatgcctgtagtctgtgagcagcgaaggccatgtggggcaggctgtggcctaggtctccacagatcctggtagaagtccatgctcacgcatcagctccaagtcccagctaaaccaagccaccaagaggtgggccctgtgacaaggctctgagtccaaaggccatcagtaaagccccctaagtcttccgtggacccagctccaggctgggatgcacgctaggagatgatacacaccgggtgagggagcccagaggagagggcagctagctgtgcatggaggcctgatctctcagacttgagggcacaagcgtgtcccctcatcctgaaggcttctgcgatggggcagcagagggtctgggtctgctgcccctcaagtccccagccccatcctagcccatgaggattgtaaatccctcgtcctctcccctctctcctctgtcagccactcccctttccccctaccccactctctttctatttctgcctctgattttttttccttttctgcctttgttcctctgtgtgtgtgtttctctatgcctctctggtctctttgtacttccatcttgatctcgctaaggctctgatccctctctcctctccctcttcatgtgttactgtcccccttcctgtctctgtttatctctcagtctctctgtctgtgagtcttttttcctctctcccagtcagactctctctctacccctccctctctccctctctccctctctgtctgggcctctctctgttcctcctccctcctccctcccccttctgcattatcagacctgctccaacctcctcccagagccagccgagcagcagaggcagtggcagcgggagaggcgggagcagcggggcagcagagctggattggggtgttgagtccaggctgagtagggggcagcccactgctcttggtccctgtgcctgctgggggtgccctgccctgaactccaggcagcggggacagggcgaggtgccaccttagtctggctggggaggcggacgatgaggagtgatggggcaggcatgcggccactccatcctctgcaggagccagcagtacccggcagcgcgaccggctgagccgtgagtatagtgaggggctggggtggtgagcggctgtgagaggtgccacagacagggtcctgggagtccctccaaggagctggggttggcatggagctgagccacgtggaaggatcgatcctgttcctgggcacccctcctccccgcgttgccagactgcagcctggggtgggggcaggttacctctgagcagaatgagggtgtctaacgtcaacctagtaggtgatgaggctggggtcccatggaaggggctgctggttggaggaggggctgataatgaacctgaaccggttcttcaagggctgagggtgtatgtggggagggggaggtctgccaagtagttgggaggagctctcggggctgcaataggctggttcaggacccggagagggagagtgtcttggcccaccaaggctatgtgtgtgtgaaggaggtggggagggggaaagatggagaaaatatgaataagagtggccctggagcaagagagggttagaggtaaccaccttccatggaattgggaattggggttcagggacaccactttatgaaactttaccccaaagcgtctgtcccaggatagggttctacggagccagatggaatatggtgccagcctcgtgtgtgtccacgtgcaggggggtgcatgtgcaagtgagtggggggcgccgtggcgacacccctctactaagggctgccgaggtggtaggcagggtatgtgtgtgtgtgtgtgtgtgtatacatgtggaatgtaagggacatgttgggtgtagaggggcctgtagagctctagggtccttggtggttggatgtaaagcagcctgtcagagtttgtgatcatccctgtgtgagtgagagtttattcgcatgtgtctgagtgtgagtgcaggttggtctgcatatgtatgtaggtgtgtctattaggttgagtttgtatattatgtgtgttgtgtctgcaaaatagagtgaatcagtgtgcattttttatctgttccatgtgcatttatgtgtgtgtatttgttagtgtgtgaataatagcattgctgtgtgtggaggtggatgtggctgtgtgcgtataagtattctggtgtgggtgtgtgatcatggtgctagtgtgtatatcggtgcttctgtggctggtgtgtgtgtgtatctatatgtgtgtattcatctgagtgtgtgtgggtggctgtttccttcccctggcaattgaggatacagctgggacaccatggcccactgatgcagggcagggaggggctgaatgtatgaccgcctctttgaactcaggacaattcattctacaccctgtgggaaagatgcagaaaagaaataggcaataatgactctgccctctggggcttcctaagcttcttagacataaaatagcttgagaataattaagcagtagagatcaacgtcatgctaacaggtgggggtggggtgggaactgcataagcaaaggccctgggctgggcatgtcctggagcagtgaagacactgtatagagtggggggcaggcaggacccacattcaatagaactttaagatccaggactcttaggctttatccagagagccctggggagcccagaaaggttttatataggggagagacatgatcagatttgggttctagaaacctgccctgggccaggcatggtggctcatgcctgtaatcccatcactttgggaggcagaagcaggtggatcacttgaggccaggagtttgagacgagactggccaacatggtgaaacccagtgtctattagaaatacaataaaattagctgggtgtggtggcacacgcctgtagtcccagctacttagaaggctgaggcatgagaatatgagaatcgcttgaacttgggaggtggaggttgcagtgagctgagattgccttactgcactttagcctgggggtgacaaagtgagactctgtctcaaaagaagaaaaaaaaaaagaagaagaaaaataaagaaacctgcctcggtggcattgtctgggttgaactggaagagagaggtggggccaggaggctagagtggaggccaagccaatacaggggtcagtgagttctggagctttttgagaacttgggaaaggctggatagatgagaacagggaagggaatgtctaggtggctcaggcttggactggggtcaggggtgtagtgcagacatctcagtaagtcaggatctcatgagggaaaaggctcatggaaggctcaggaaagctgggcgtgggtgggctgaggtagtgggagagatctttgtagtgtttctagctaggatgcagagggtcagagatcatggagccatctcttgccagacagggaaactgagactatggcttcatcactaccctttggctgcaaggctggggctcaacctcttcatcagacctgaccctcaatatcattctccttcaggccctgcccggaacctcttggttgctgagcttggtcagctcagtgagggttaattgtctttatgctccctgcacccccaccccccgcagtcattccccctgcccaccaagcagctcctgccactcttcctgcttcccactccagcctcctgtccccagggactgctgatggcttggctgggatctagccaaatggtggggggtgggggcgggggtggggggaagagctcccagcagtcctttaccccttggtcttaatggactgggagtctcaccctcagccatgctgctgtcaggccaggcctgcgctccccgggcttctgctgcttgggcctatgaaatctcccgactcagcatgattccattgctgcattcattcattcaaccactcaacaggaacttctcagtagctgcttggtgcccacttggcttgtcaccggggacacagagcagacactgactgagtccctgttctcagggagtgcccagtctgatgaaggagaaagaaatggaaagctgcaaccctacagggtgagcagtgctgtgtaggaggtggggggcccacagcaagcctgggcttcagaggaagagacatttgagccggaccttgaaggatgggtaggaatcacccaggcagggaagagcagagggaacagtttgtgaaggtgggtaggaaaggcacagggctaggcacctgactcagtgcagcctctgggtgggagaagacagtaagggcgtttgggtcattttctagcagttgttttagtactctctacaacttgccctgcagatctatccagcctgctgtttgtatacccccggacataggatgttcatctcttccctcctgggcagcccttcccttgtggtggttatatctgtcctgggtcttctccgcagggcccagcaactccaggctacccagcctggccttatgtcctttctccgtcctgtgtcactgtcccctgaagtagggccaggctggggcacaatgatccaggagtggcaagaacacatctaggcagagagtgggagaaatgcgcagcctttattaacaaaaatctgagatgggtgcaggccctgactcctctccaaaaataatgataaagaagcaggcatggtcaaataagggagtgaggacagacagcaggaagaacttcctaccaatgcagaagggctgtgagtctcttggttttatgagagtgggctgtacgtgtgaaagggagggtctcagaggacaagagggggaattggaggcagaggcactgtcagcctctgactctcccataggtgagtgagtgaagtcatccagggagagggaacagaggagggagatcaggactcatcattcattcattcagcagccgttcactggccctaccaaacatgacacccctgggggcagatggacagagccagtgaccacgtggatggaagctccgagtctttcctacctgtgttaatgtcgcaggaaggtatttaggaggaggggccattggggctggccttataaggaagagccacttcaggctgagttgagggacagcactaggaagatggaagagcatttgcaaaggcctcaaggtaagggcaagcaggattttgttcacttagcactataggagttcagagtggcctaggcatgaagtgccaggctggggggaagccctgggccgtggtggagcaggagaggagtggggaattgagcctagactgtaggaagcactttcttccgtgaaggtgtctccaacaggcttgatgtgtaggcattattgtaagtttgcaacttcttggtctctcctggtgctcgtgaccagagcttgctgagggacccagccttgcttgagaaaggggtgttcagtgaacaaaagagaccctggaaatgagagagaagcagtggctgaagaatgtgggccccttccagaaagtggcgtgcaaacaaatacaaagcaatatgcaaatcagctggctagggcttggcagctttggttggaagaaatgagccatcaccccttattatgccggcctcctaccccctctgccccagcctccaggacagccggaacagccttgtctgctccttggagcgccccagcttttctgagacacaggattgtggcctccagggtggtggccgtgggctccctgtcagcaccctcgtcctcctgggaagtcgatatatttagtaacagaaatgttttcacacatttatctcctattgttcagctgcttgctccctgggaaaggccaggtccccagtgatgtgacccacttcttgaagtccctgaagtcacccttctcactgcccccccaccccgaaaaacaggaggcaactggggcttggtgcagcagaacagatttgagtcaaatatctgggaggacttcccaacagtgtggttgctgagatgtgtggaccctggatttctgggctttcattctttggatggttgccttgggcgcagaggaggctttgaagatagagcagagaaggtggcagacaggcttatgctcaaatttcagcatactgaaagatgtactgttactctgtagctgtgtggtcctgggcaagttacttaacttctctgaaccttgtgtgaatagtggggtggagataattatcctttcttggcaggatgattctgaagaatctggaagtgcagagcttagcccctggcatgcggcaggtgctcacaaaggttagctactgtcattatgaaccacccacgatcagccacactttcagaaagatttagcggggcctggagagggagagaccagagctaggagctcagggctgtcatcgtgtgggagggaccaggaggcctgaaacagagctgtggttgtggctacggtgagaagcacaaagctctgtgggagggaccgaggtttctcagagaagtgtggccacctcattaagttgttctgactggtctgagaccaatccccagataatacaatggaagaaagggcttggtgaagaaggggttaagtctgtggccacacccatgcagtctgtgagccattctgggagctgtagtctgttgtgaatttgcagtaagcatagtttgtactgcctcttttgatccaaatccacaccctgctgccaaggctggccgagggccggccctggtgggtgctgggctgtgtggagcccaaaggtgaagcagcatcgacctcttccctcagggaccccctggcttgctatgtgttggggggtgcaggtaggagcagggatagaagtattaagccataattacgacttctcacatgttcacacagaagtttacagcttcctgagcactgtttccacacctgtgatctcatttaatcctcaccacaaacccaagagactgctgttttctggatgaagaaacagaggatccaggaggggaaatcgcttgcccacaggtattcagccagtggagccagacctggggcacaaatctgtctgcttccagagctcctgctctttccatacattactgttccagatggcagacaggcaagatgtggacaactaaagttggatgtgagacatctcggcagaggaacagctgagcagagagctgctgattccaggctgagagtttggactttgtgttgtggcccaccaggatccacccaagggttttctgattagagctgagctttgagagaattggtcttgcagcttaggctgaatggattgaactggagaaaccaaagtcagactgaggcttctaaatcccatccttggtgcacccagcactttgctgctgtccctcctccatgcttcttctcagtttcttccttctcctctccttcatcttcttccctcaccctttttttttttttttaatagagacagtgtcttgctggctggagtacagtggtgccataatagctcactgcagcctcaaattcctgggctgaagctatcctcctgcctgggcctcccaaagtgctgggattacaggtgtgagccactgcacccagctcatcttcctctttctctcctactcctctctgcctcaggctgaggagtgatgacttttataccatagagctgtgctgtaatatcacatgtctccagaagggggtgctgtcacatacagtccattccagcctgaatcttcgttgtgtttgaagggccagtagaagtgttggacaagtggcagagatgaaggatggagagaaggatagcccattgttctccacctccattgagcccaggacatgagggccctgctgaaatggcactgggaggaatgaaggctgaggagaggttggaccccaaccagaagggacagacatactgagttaagccagaggaaattttctcctcatggttctgggacaggctaagatttggaaatgcatctagaatgacattgcagttggggtctgggtttcttttgggtcatgacttgcttgatactgaggtgctggggatattgcttgtgtctcagtgtgtgtatgtgtacctgaatgtgagcttccagttgtgcatatgtgtatgctgatctgagagggtgagaatgtgtgggtcagtgttcgtataaaagtgtgaacatactcacatgtgtgagcatgtgagtgtccttttttttagtttagttttgagacagggtctcacactctcacccagactggagtgcagtggcgtgatctcggctcaccgcaacctccgcatcccaggctcaagctattctcctgcctcagcctcctgagtagctgggactacaggcatgcaccaccacacctgcataatttttgtatttttagtagagatggggtttcaccatgttggccaggctggtcttgaactcctgacctcaaatgatccacccaccttggcctcccaaagtactgggattacaggcatgagccactgcacccggctgtgactgtccatctttatgtctgattttggtaaacagttatatgcatgtgactgtggcttgtgtgtgtgtacatgtatgtagagtgccatatacatatgttctagtgaaaccgtatgtgtgttccctgtgtatacagatgcctgtgtctcaatgtgagcacagggatgaggggatatgtgtgtgtgaaggcccagacacctgctgtgctaacctttaaggccgcgcctaatgtctggctattcaatactttttctcctgggtcgcgctttcctgtaggtagagacccttgaagggctgggcttccttcaggggactctgggccagagtcaggctttgtgttcagtctcaggttgggccagccagggtcctagtctatcggattgggcagctagacatggctgggaagtgtctaggttccattctccccaggaactcttaatggtcacacttaaagagtttcagggactcccagcacggtcctcttgtactgatgcaactactgaagttcagagaggtgcagtgattaacccaaggtcacccagcaggacccaggatgagatgatagggcttgcagcagagaggggagtgtctgacctggaaggctgccctccctccagcccctagagcaggtggggagctcagaggagagccaagtctgtggtgtgaagccacctcctgcacctggctatttccatgcctcctgggcctcagaggctgcctttgaagtttttaccagagcttctgcatgctgtgagattcctcctggggacgtgtgaagtcgactgttccatggagcatggagactcgatggagaggagcccagtggtgaagtgaggccagaggaggggcttcctctggaagcctcaatttcttctttgcagtagttgctttttttttcgtgttttttttttgttgttgttttttaggttttcaccgttctaacattcaaggctttctctgttatctctctttgagctcttagtactgagacagtgctggggtttggggcagtcctggaggcctatctgggctcaaagtgagggtggcagggcagtcccttagggaaagggctgcgtgggagacagggatgagcttcctgcccatagtggggaggcatgagcaggggctggacagcctggttagcaaggctgtatacaaggtacctaccctagtgaggaagttggttgcagattatcttgagtcccttcaagctgtagctgccatggggggccagagaagaacgtgcctcagctctcttgggcctggggaggattgagtccacagagtgctcctggtgtcctgggcagtggaaggtgcaaggttagactgtgcacctggaagcagagagatcccattccctggagaactgaagggaaatttgtcttcctggaggtttggggctggaggcaggggctggatgggaggacactctggggtggagtgggggtgggatggggaggactgggcaagtccgaggcggctctgctgttcagcacccgcaggaaggagcagggaggcatatcctgaatcatgcagggctctagggtgggaggcccatggttgtggggctcaaacatgggctctggttggggcagaggagaggcttcctggggttggggtctgggcaggaattggggtagaaaaggagagaagcagcaattgggtaccacctccttcccaggtcaggtaattcggagttgtcttaaaactctcagtgggccaggcatagtggctcgcgcctgtaacccaagcactttgggaggctgaggtgggtggatcacctgaggttgggagttcaagaccagcctggccaacctggagaaactctgtctttactaaaaatacagaattagctgggcgtggtggtggatgcctgtaatcccagctactcggggggctgaggcaggagaattgcttgaacccaggaggcggaggttgcagtgagcctagattgtgccattgcattccagcctaggcaacaagagcaaaactctgcctcaaacaaagaaacaaacaaaacctctcagtgaggggggatctggggtccagatggagagaactaatgtttacagagtgacctttaagttttaaaaatgattatttaaggaggcgattaaacaaatcgcctccttaaataatccttccagggaggccgggcacggtggctcacacctgtaatcccagtactttgggaggctgaggtgggcggatcacgaggtcaggagatcgagaccatcctggctaacacggtgaaaccccgtctctactaaaaatacaaaaaattaaccgggcgtggtggggggcgcctgtagtcccagctactcgggaggctgaggcaggataatggcatgaactcaggaggcggagcttgcagtgagccgagattgtgccactgcactccagcctgagggacagagcaagactccgtctcaaaaaaaaaaaaaaaaaaaaaaaaaaatccttcaaggggctagccctattttgtagaggggaaacagatgacaaacttaaatggtttaactgaagacagttagtgaagcaagtattatggagatggggaaggcttaagggaaccagcaggacatgtcaagttactcaggactggcatccaaggggccaggggcgttggcagaggggggccgaggagagtgccccagctccatgagccagagccctggagatggggctgccctgcaggagctgtggctgcagccactgcttgtcaaaggaggcaggtgggtgagggggtgaatacccaccatgagcctgcatgcttctcaccctttgctctcctgccagtaccctgaccctcactggcagaatttctctggatgccagggggcaagggagccctggatgaagctgccacttagaagtcggcctctggggcacacaacccagcagcaaaagttagagattggatgtggagggacaaagagatgatgggaaaccgaagaacagagagggcatggacttgcccaaggtcacacagcctgttgatatcagaattggagtcagaagccaggctctgcctctgaacactcacttttttgtttgtttggttttcttttttttctttcttttttttttttttttgagacagtcttgctctgtcgcccaggctggagtgcagtggtgcgatcttgtctcactgcaacctccacctcctgggttcaagtgattgtcctgcctcagcctcccaagtagctgggatcacaggcacctgccagcatgcctggctaatttttgtacttttggtagagacggggtttcaccatattggccaggctggtctcgaactcctgccctcaggtgatctgcccgccttgacctcccaaagtgctgggattacaggcgtgaaccactgcacctggcctgaacactcactttgtcacattcactgaggtctcctgagtggactcatatgcgcattatctactctctggctgagagctgcttcctgccgtgatcaccgcgctctgtatctgggcagcacaggggctgctgaagaatgtcattctcagaacgcagtgtgccctggagccccccaagccacctgttcattcatcccaactggccttgagggtgccctggtgtgccctgcctgtgcttgtcaccctggccatggagatggacccaaaagcccttgctctccgcttcattagagacaggcacacccagacgcaggcaatcaattttgtcgggtgagtgctgggaccgctgatgaggacccttcctgaggaggcgatgctgggtcttagccttaaagaacaactgagagttttccaggtggaggagaaaaggaagggtattccaggcaaaaatccccgtaagagcaaaggtgtgagcagcaagaaatcaagggtggcaggttcatggctcctgggctggaggaagggcctggcggtggagaggaagggagtgaaggcccagctcacaaagggaagcagaggaaagtttaagcagggtcaggccatggttagctttggggttaggaagctccaaatgatgggtgaagtaggggggctagacccaggtgagaggcagtattgcggttggccaaggacatgtgagttgcataaatgggccagaggaggggtgacagccgctacttcccggctcacctgcctgagctaaggccctagttcctcagtgtctgcccaccaatgcaggtgtgtggcagctctagaccctcctctagggacatccctccctgcctcatgctgcctgtggctttcactctctggagcactcatccatggcacccataagccaccccctcagacaatggcccctaaagcaaaactgtgtcaccgttgcatatctcttgataacactctgacccctccactgccaaatctgataaaagaactccctttgaagaccttcctcctggagtcggatctcagtccttcttgctgtccagagcctgggccttgggcctccctgggaggcgagtcagtgagggcagcccccttatggtgctgggagttgagggaccttggcccagccaactcatccctgttgtgtcagcctctctgggcctgggcagccaactcattttcagtgctaattagcatctcccctgcagctttctgccccactctaagtgcttgacaatcattaggtgttactgtgtgcaactggatcccagctccggcacctccctgccccagcttctcctccagaccccagctgcctgagataagggacctggccacaaacatacaacacaccgaaacccggacacaatctaggcatagggacttgaacaccaacataaatatacaaagaggaaaaacccaataacacagaagaactccccataccaggaagcagaccatagcacagacagagacccacagtacacacacaacacagacaccaacagatgctgaaaagcagacacaggatcattccaaaaagtgacccagaaacgaaaacagaacaaatgggaacatcaatgcacatgacacaggtatacacatctagatatgcaacacaggtacgattcagcacatgtgtggcgcatcgcagggaagcacttgcacttgaagtatacacagatgccaagatagtcagagggagccgcctgtggttccccacctgtgcagcgtctctcgcctctgggctgccgcacatgctgttgcccggaattcccttccccaaggccctcctctttttacctggctaattcctgtcattcttcagatcttctaggaagacttctgcctccttgataggggcctttccatactccccagccttggagtgcttcctgccacatggcatcactgactgttttccaatgagtttctgtcaagttttgggatgaaggattttgcctgtgctcgttgaggtggtgactgtgggtgtgagtgggtgattagggccaaaaaacccccccaaaaaactggacagaggcaaatttggggggaaatgagttaggaatagctgtgaggagccccagctactcagggcctcagaagatatttatttctgtatttatttatttattgagacagagtcttgctctgtcacccaggctggagggcagtggcgctatcctggcccactgcaacctccacctcccaggttcaggcgattctccttcctcagcctcccgagtagctgggattacaggtgcgcaccaccatgcctggctaatttttctatttttagcagagacggggtttcaccatgttggccaggctggtcttcaacttctgagctcaggtgatcctcctgcctcggcctcccaaagtgctgagattacaggtgtgagccactgcacctgacctcagaagacattgaaacccacagagaggacacagccagatgccctctgcctcattttctcagaccctgcctgatttctcttatgtttcttctaggcttgctccctgacccagttccctccttcccagagctggccttgccccttgccacctctcggagctcacacatactcactcaccttctctgcttggctgtgccctacccctacttctacgtgcagtgaaatccttgttattcaaggcctgaggtcagtgggcacatcatccatgcctggcgtcctaacccgtgccactgagtatcgtgaagggaggtagtggagggacgtgcttgggagcacaagccttgaggactgtctcttggttcagatctctgctcctctacttcttagctgcaggattgtgcaagttctgccacctttgttccctcatctgtagaaaggagaggataatagagcccacctcattagggcagccatgaggattaaatgagacacagtgtgtaatgtacctggctccctctccaggttgcgtgagagcagggagaaagctaatgagatcaaggatgtgcaaatgcactcagaaggtgcctagtgagtccttgctaactggcacttagtgaaacaaacacctcctgtgtgagcacctaatatgtgcctctgtagtgggctctgtgacccgcccctccttagtttctgcatggctgccagttctgcacagctgttactgctgtgggggcttagaaggtgggggtatgactactttttctgaatttatttttaattttttacatctgttttatggaggcataatttacatacagtaaaatcaccaatttaaagtgtataatgagttttgataaatatatatggtcataaccaccatgacaattaagaaaagaatatttttatcctggcaaacttcccttgtgccctttgtagtcagtccctttgagggggacttcttataggagtgtgagaagtactgggttttccttgggctgcaaacctgggcacatggagtgggggtgcctccaacatgctggaagttgccagggaactgctgaccctctctgggccttggttcctggcagaggcagtgcagccaggcaggggaagggatgcttaggccttggtctcctgagggcaagccttggatgtgagggttggatcggctggaagtggtggcttcagaaacccatagagtgggtgacagggtagggacttggtgtttccacaaacccgcccctcctttgaccaggtgtgccctgtggtcctggtggaaatggctatatattgtccagactgtagcaggggctggccaagatggtccactcctctccccatcctcctccaaccagaggccataaaccccactctatagattaacaattccctgaaaagaagggggtcacttttgttccccagttctagaactaaatattaaagcaattatgtaactagcaataaattacttaaagtagtgactcactcagcttaattagagcgcaagcagggagggattaaggtatttttagagcacacacctcactctctcctgtgggggaggcctctgtgcaaggtgggggtggaaaaaaggctgggaactcatgggagcaccccaggtgtctgcaaggagatgaaagctgatcctccgccccactgaggtcctaaggaagaaaggccgagtcagagctgcagcaggagggattcggatcagactcaagaacacttcccagtggtgcttatttgagaactgggacggcaacactagattgtaaactctgtgagggcagggattaggtctgtgactgcctcctcacccagcgggagaccaagaatgagacttgggagtcagacacaactgggtgtgactcctgcctttgcgggttgccagcacgtgggcttgggcaggttcctttatcaccagaagctttgccgtctcctccactataaagtgggcacaataacatccacctgcatgcatattataaggattgagtgggttaaaatgtgcaaagcaagactttgtgctcagctgggcacagcggctcacacctgtaatcccagtactttgggaggctgagacagagtgcttcagcccagtagttttgagaccagcctgggaaacatagggagaccctgtctcttaaaagaaaaaaaaaattagaagactcggtgctgactctgctagaccaaaagcccacaaaggcagggattaggtttggtttgtgttgttcattgttgtatctcaagcttcattcataggactgcacaaagtaggtgttcagtaaatgctttgttgtgtgactgcgtgttaattttgttcccattctcctgctccaaaaaaaagttcattttcctgaggttgtgagtgaagaaaataggcagtgtgggctgggtgtggtgtctcatgcctgtaatccccagcactttgggaagctgaggcgggaggatcacttgaggccaggagttcaagaccagcctgggtaacttagcgagatcccatctctacttcaaaaaaatttaaaacagaaaaaatctagggtgtgtgggggggcaggtggggaggttgcaggggtgcctcacaggtgggagtctggcatttctcctccaggctgaggaggtggtgacttccagggaaagtcctgggagggatcagaaccacagctccagcctgcttggatgagggtggtcttctggctgccaggagggtagctaggtgggaagatctgcccttgtttcctccataacctggggtgggaggaggaggagctcccagcccaatctgatgggggagaccagaaccctcacccaccattgctggcagttcagagaaggcagcgataagtcggggtggggcatcctgaaaggcttcccagaggattggatgggaggattagctgagaagacatccggcatccgtaaaatggagtaatgattctgaccctgcaggttttctgggaggattaaatgagttacattttaaagatgcctggtacatgcctgccaggagaaggcacaacatatgaactccctccctcttccctccacccctcctcagctcctgtgacatcaggagggacatgccctgccctgctcacagaggctgggtgggaggctcccatcatggccttcactgaggctgcctctgcagttggaccaagctggacacacagtaggtgcacataacagatgggggcaggtctgtgcttgttttaccagggtgttgggaggctgagggaagggcacagctggattggggtgatggagttcaatccctgctcctcccccagatccaagatcctaagacgcctatgtccagtggctgctctgatcagctctgaccagctctcctcacacctcataggccttccagggttcaggtgatgaattagtgatgacagcatccagcatcgctatgacaaccacatggcactcttagcctccagtcagggctcagccgcagaggccagagacccctttggctctgggcctttgtactggcgtgtgtgagcggggctggggcctgagggagatggaggagtgggaggggcaggggccggggcatggggctgcatctggcatggactggagttcattcagattgttccatccagagggaccttggggacagttgtttctctccttccttccccctttcttttcattcctccatccctcctctttcccctcctcccacttcttctgagccttgttcctgtttgaggccctgggctgccaacccttttcccctcctctgggaataaagccaggctcagccctcaccccggggagctgagtgaggtgggggacagccaccttctggtctaggcctcagggaaggtgtgtggggaccactgatggcttggtgagagggcctgacccagctgggccaggggctgtgcaagtggctgctgaccctgatgagtggggaggaggttttcagtagagaggcagggtcagagatgaagcagcgtgggatgggggagcgacagatgttcagagtggcctaagtgtgagatgcggagcagagaacgtgggaggaatcgaggctcgagaaggactgggagagagtggatgcagtgaggagtttgaagtttgtccctgggggaagaggagccctgaagatttttgttgttgcttctttgatttttaaatgggagggttcattttagagatggggaaacaggcccagggtgggaaagtgacttgctcaagcttaagtcactagagacagactgagagtacaggctctgcttgggtcctgctggactctagctgggacctcttgccccagacttgctggccaggattttcccaggtaatcactacctccgagaaaggcgaggagagcccatgggtgactttgccctcagtttgaatgaaatttgcatcagcaagggctatgccgatagtcctttctgctcgtgtctggcctgtttgggggtgggagtggggtggaggtgagcatccagggaaggatctgggaagtcaggggcttgccagggccagcaaggcattagggtcagagatggattcaaacttgggtctttggagacccagcccagactctgtgctccatctccttcctccgtctctcaggagcctttggctgagttaggcacctacaggaggcaagggcccccccgagcccctcacattctcctcagggctccttctggccctggggcctgatattgggcctgctgtgctggaacttatccaggcagaataaacctttagccccattgtcctgatgaagaaactgaggtcccgaggtaacagtgactcattcagggttacaacaggtcagtggctgggctgggcctagcgtctggccctcagcttgtctacatggcccccctcgtggctctcccctcgcctctcgcaccccactgtgcagcatggttgggcctgccagccttgatggatggctctgcagctcaacctccctcccattcctctccggatgccgggccgtgagcctcctaatcaccagtcctgcctggtggccgccaagccatccatctccccacacagccttgcccagcacaggtgattttgtttggggagaaggggggcacagcaggtcttcctctgaggctgagccaagagtttggctgcagcccccactctggggggcccgagggttagggaatagcctgcactcccttgctggagtgtcagaaatccctcctgaatctccctagggcacgtgcacatgcacacacaggcacacacactcacagtaacactaataaaagctctcgtgtagcaaaagaatattgtatggcaagtattgttgcagagccatatgtatcatctcattcatcactccactgtagagatacagaaactcaggctcagagaggttaagtgacttgcataggctccatatccaggaaatggaggagctgggatttgaacccacatccttatggctcacatcttgcattcacaactcctgctctactgactcacctgtgcacacacacacacatgcacacacacacacgtgcgtgcacacacacacacaggcactcacttgcatgcatgagcacgagccaccattttggctcttgtaccatccatctacctgggccaggttcttgaggagtgaggagaatgctgggctgcagagggcatgaggggtcactgctcattgtccccaggctgcctcaccctggctgtggcactggctggctggggagctgcagggaggcagcagcctccaggcagtggaaaggggaggctgggagacagtcgatcgatcatccctgcagtgcctccttccaggaactggggcccaggggagtgtggcgccacgggtcgatgttctgggcagcagcacagtctctgagtgcgtacagggtgtgtgtggggcgaggctggtgtgcagctgcccgccttcccctggctcccttcccctgctcctgccttcctcctgccattcacctgccagccccacaccttcccctgattcccccactgtccccaacctgggcactacagaggctgagaatcaaactcccagttcccaggcacctgtgtgcctgctgctaccatcccgccctgccctagaggcaggtctcgggtgggtgctgcaagagtcaccctatggtggttggggatgggtgggtagggggaccgggggctggagctgtggggatgtgaggcaagcccacctcagagcctttggagacctcgacagacaaaacgatgagttaagaaatgtaaaggggcacatagtgggtgctgaattcatcttgtctcgttcctccagtaagagtctggagaaaccaagagcagctgggtgcctctgagggcacaggagctcccagggctggctggcaggtgcagctaacagtgttagcaatcccaaggacaggtagcttggggcggaggagagcatgctgtcacccatcctgatgaggggagagatgtctggtgctaggagcagtggtggccggaggagggctggggacccaccccaggccaccccacactctccctctgggaggggctcctgagcaggcctggtcaccttgcttcttggctgcttcttccccggcggaggagcctcccccaggctctcccacctgcactggcctcaagagagctgggattgagccccagttcaggcacctgctggctggcagaggttagggcaaatcactttcctcagccctctcatccgtgacaggctctggtgagggttaaatgagatgttgcccgtcaagtgcctgccacttccctgacgccgagcagctaggctgctctgggttctctagcacctgcctcccctggtcccagcgctgggtgggcggctgtgttctaccggtcactggtgggtcctcagggccccgacacagggcctgctattgggaaagagggaagtaaacatcccagggctggagctctgcccactatggaggtgttccatcttaggctctgtaatctcctcattcactctggtatggggacaaatgtgcctctctgcactaactgagcccccatgggcaactaggagtggtgtcacttggggtggaggtgggcaaggatctctggactgggatttccaagccctgacttcctgttatttcaggcactacctcattgttccatcttgggcaagacctgtccccttgagggtaagagacacatgtgacctctgacctccagagtctctcttctgagcttctgtgcccagatgattctgtgttctaggggacaggcgaggctggggggtgacccccatgccactgatgggcagactaaggagcaggggcccaggactggggccagctcaggactctggtggcctcggtgcccttgacctggtattgctgccgttttgccccactgctgtctgtctccgcgtccgagtcaccacctgtccctctccagtcctctcctctcttcctttattactatctctatattgcctcctgcctcaggcttatctcctcctgtcatgcctctatccacctctgtcactcccctgcgactctgcctcactccctggcacaccctctccctccctgggagtcgggagtggagcctcgctgggaatcaggacccccctgcctctggtctctgtctaagcagtctctgcgattctggccagctcttatctttttccaccttcccgaatctctcttgctgtctgatggtgtctctgcctttcactgtctctgaactccctttgtttttctctatatgcttctctctgctcttatctctgggcctctgtctctcagggcctgactggtcttgacctctttgcctccttcttcccctcgagagcccagccaggcagcaggtccagccctccagcccagagaacagatggagtccaccctccctctctcttgctggctgcctcggaagccccaaacaatggcctccgccctgcaccgtgccttgttgctaggccttgggctggcagcacctggcttccatagcgacgggtgcttagaaacagaatgccacatctcccagtcccaccacaggagcctttgccgattgagcgagtgccttttgatcaatcaggaagtgtggccaggctctaggttgcctccaacttgaggaggcaagagaggaggggactgtggtctctgccttctggagctggggggactgctgggctgggaggagttgctcaagtacagccctgaagccaaggaaggactgggggaggccctgggctcttttccccaagtcagcctgctgcaagaggcacaagcttgggagctggaaggggctgtgttgaaattgctgttccatcatttctagctgcatgactttggacgaatgacctcaggtcccagggcctcagtttcatcaactgtaaaattgggctaataatatcatgaagattaaatgagagaatagatctggcacttagtaggtggtcatcaatggccattcccctcccttcccctttaaagttgtttaaaatttaattgacagagaggagaaggagggttcttcaggcctgtggaatggtgtaagcaaaggggtggaggctggcatgcacctcacatatgctggagtatttagggaggaccaggggccatatctggaaatggttctgccagaagcagccaggccaagctgggtgccatgtcatgcacctgtaattccagctactagggaggctgaggcaggaggatcacttgagccctggagttccagatcagcctgggcaacatagtgagaccccatctcaaaaaaacaaaacacaacaggcaggctgatgggcccatggagaagggactctgtctcctgggaggtatattcttgccaggtgcaaagggatgggcttgactaatttctcctctagcatttggggctgctgggtagggagctacattggggtccccttgcttattctcatgctgctccctacttctgccctgtcacttggtcccaggagaggggctcccactggttccttttccctgccaggcctgcccaccaaggccaccatggccacacagcctgaatcctggggccagcaagtgtccatggaaggccccactctgtcatcgtagagatcaggaaacaggctcagaagtaggagggcttcctggtcctagggcccagctcttccctcttttcaggcctgtcttctgcactaaggacttcaggccaccagggaaggtggggagggaggaaaggagatgagatagacttgggcgggggcctgaggacagagtttcatgtcacttgggcagccaggaaagggttaaagatcccttatcccaagccatgggcactggcactgccagaggatgctgaggcctgctggggcataaggacaacaagcaacatccttttctgagctgttgggagtgccaagctctctgttaaatacttttgagcctcttctcatgtattcacagccacctttcaaggaaggccagttgatccccagtttagaagtgagaaaacggggtctccaggaggcacttgtctaaggtgacacagctggagagttggagatggtggttagaccgagtcacccccccagaccctggcctctccctgcgtgccccttccaggacacccatcactcccttgacaccccttgggagtgggtgttcatttccttgggctctcccaatcccagtccttggtatccccaactgcaggcagacacaggtgcttgctgctgtgccctcccctttacctggcatcacagagactcaagcccactgaccattaggctctcaggggcatagaaaccaggtgctggagtcttagagtcctgcaatcaggcatctcaggcagtcaggacattagaatgttagaatcttgggcttctacattctcaagaccccaggttctcgcattcacagaatgtaagaaaaacagactttttgaatgatggggtgttataacagaagctttgattttctaagaacatgaagctctgggagttcttggagccttgaagccatagactggggcctccctgtgtgatggtttctgagttagcagggagtgttcagagtatggggccttggtccctgttgcttagaccttcttgccttggtatctctgatgggctcagctcttagtagcctttgtgtatgtgtgtgtgtgtgtgtgtgtgtgtgtgtgtgtgtgtgtgtgtgtgtgtgtagtggggactggggtcaggggtcagggactgactctaacctgaggcacccctggagtggggccagcccaggaatagcaggtggaggaaagccgggcagcctcagggctgcagctgtctggtggtacagggcagggctctgggtggctgcctttggcagaggaccagcctgcctccttcgtcccctacccagcctgctaccaggatcaggaggaggcatctccatgggactcctagggctggagtcagagcagcccctccaggttctgcagcctggacggtaggaggtgccactaaggggaggagattggggaaggattgggacctttatctgcggtgaggtggggcacggggggatgagagatatagtgggagtctttgaagggtgtgggatcagtgaaggggctggggatttagtgatgggctggggcttaggatggagccaagggctctgtgggtgggagaccttttgagagggtggagactcagagagaaggatgggggctcagcaaggggatgtggctcagtggaggttgctgaagagtttcttggggttggctacacgcggtggctcacgcctgtaatcccagcactttgggaggccaaggcagatggatcacttgaggtcaggacttcaagaccagcctggccaacatggtgaaaccctgcctctaccaaaaaatacaaatattagccgggcgtaatggcaggcgcctgtaatctcagctactcgggaggctgaggcaggagaattgcttgaacctgagaggcggaggttgcagtgagtcgagattgtaccactgcactccagccctgggcgacagagcaagactccatctaaaaaaaaaaaaaaaaaaaagtctcagggctgtctctgcactgctccaggttcctgaggacggcggttggggctgggggagtcttctgtccctggggtaggctgagaagcaagagctccttttcccaactctgcccaaagctggaaaggttgttagagctgctaagaaagctggcatctgcctctccttttgctcatcttcctttctggtttccatgggaatctgtggctcaggatgatcaggggttgacaggatggcgctgtggaaggagtctgtgtcaggcacagccatcccacatgggaaggagccggctggtaagaaagtgagttccctgtccctgggagtgtgcaagcagggtaggggctgaatggctagagtgactccagaaaggggttcagatggggcagaggaagcagtctggaggccacttccctgagacaatcatgttttgtgtgattggctctgggggccccaccagccccaccttccagacgtccctgggcctcacaaagggggttgctgcaccctaggcactgcctctgatccagccccaactcctgtgctctgtgcctggcctatgctgaacacggacatgtgcagctgaatcagattcagtctctgcctagaggagccccagtctgatgggggaggcacacagggacacaaatatagctgggtaagtcctacaaaagggggcatacctggctgggaggcagttccatcactgattcctgtagtctgtagatgtctttttgagcaattcttctgggtcaagacttgttcttatttgctgggataaaacagcagtgagcaaaacagagctgacagcatggtgggaaggttgagctcttccagaccgtgatgagaagtattggtgagtggtggggagagtggccagaaggcagagtgtgggcgcagcatgagaggaggctttgtccagacttaaggacctggaaggccttgaaggccaggaccagggctccaattgtcctgctggcaataggaagccatatgggtgggggtgaggcagaatcagatttaggtgtggaaaagatgactccagccagtgtgggcatcgaagaggaggcacagaagcaggcgtggccacctgtgcctctgtgtaggagctgtgtgagcatgtgcttgaggatgtgtgtctgtgtagaggactggggtgtaggcgtgataggaacatggacgtgtatctatggaaagactccaattgtgcataggggtgtatgtgtgtaagattctgtggcccagggcagcctgtgaaaaggaaggatcttggggtctgtggatgatggggagcagagactaaggcctaaggtatgctggggctcgagccccctggactttatcccctgtgagctggcaggtcttagactagtcctggactagaatcctatgggttcccttcccccagagggtcatggggccagccatctgctgcagacaagacaaacatgcatgcaaatcacatgaaaatggatgaggcctgtggctgacccaccctacagcccccatcccctgggcctgagttcactcagcctgtacccttcctgacccagagctgctgccagggctctgggaacaggccttgcccactaggagctgaaattcacattgtccccagcacctgcccgtggccacatcctctctctgtgagggctacccccacatctggagccatagccagcggacacagagctggatctggactggtggccatgggcagcacctctggcaggtgctgaggtggaggaggcagtatccaggcaggcatccctgggcagaaggtacctctcctgagcagacaggccttcccaggcaccaggcccaaagataggggcaagggctagatcctggtattggaggaccctcaggagaggctgtgtgtgacttgctctctctctgacctgggctagagcataaacacgtgtcacatacttgcacacacattcacacgtgaaagcacgcacatgctattcctggacacttgtgtacacacaccactgcacacatatacctgcatgtgtgaatatacactcacttctgcacacagacacatgcctatctgcatagacacacccgtgccaacccctatagatacacagacatatctgtgtatacacatataagttcagctataccactgcagtatcacacaccctcacaaggatacaaacctgtgctcacactctcttccaccctcacacacatcatgcttacaagcctgtgtgcagccttacacacatgcacacacatacagagcagcctaagggtggctcacccctgcccaggtgaacacctgtgcccactccagggctggagtgttgaggaaagggtctggatggaggcagaacctgcagagatgtcagtttcttccaggaagcatcttggattgtcccttcacagagcccttggaagtggggccctcttttagtccatgggctctagcccaggtcacagagagagcaagtcacacacagcctctcctgagggtcctccaataccaggatccagcccttgtccatatctttgggcctggtgcctgcgtaggaccatctgctcaggagaggtaccttctgcccagggaggcctgcctggatactgcctcctccacctcagcttcctgagcactcaaagagaagcaggccaagcttcacggctgctgagaagtctgagaccagggagggccaaagccttgcctgaggtcacccagcatgtcagggaagggctagggtttgaacctgggcttccaggtgggggtgtaaccatggtccatggcaacaggatagatgcatgtcaggcagcagacaggcccttggaagcaagacatgtggtcatgggggataggaaaagacttacagtctatggagatctgccaggaccaagtgtgtgagatggagagatggtgcttcttcaccagagctcactgggcaccacagggctcccagcttggctggaccatggggactcagggaagaatcagacaggccctgctcttgagggagggctggggataggtgaagaaggaagagggcattatagactggggagatggtgggggctacttctcgttggatggcagttttcttcctgcatcttgaaagatctaactttcaaatttctttaccctcaaaactcggcatggagtacattctcagtaaatatttatggcatgaatgaattaatgaaagtatgatattggcaggcagatatgcctttggaagggtattcaaaatgggagggcaacaggttgggcaaaggcaaagaggtggaagaaaagccagaggttcagggtacagctgagtcaggcatggctggacgggaagtggtaggagaagcagcaggaaaaagtcacgtggggatgagccttgcatcttatactgagtttggatgttgccttggaggccatggggagcccagtgaagattatgagcagagggtgaacatggtcagagtgaacctgccctggctttggggggtcctgggctacatagtagctgcttatccttggtgcaaagagcactgggtttggagtctataggccagggttcacattcctatagtaaccagctgtgccatctcaggtaagcatctacatttctctgagcctcactttccttatttgtaaaatggggctaatgccgtgcctcctgaggctgttggatctggcctgggtgaggaaatgctttgccagcacaaggccctaccaatgagaggtgtcatttttattaggaacaaggcagggctggttcctagacagggcctgaggttgagtgggcccaggacccaggctgacagctgagtcaccttttccaggccaagtggcctctaaggtgggaagacaaaaagagttggctagaggggctgggctatgcattcctaagctggagctgggaggaaagctggggctgggactgggcttcctggtgtccgagatgggcagagggtgcagacaccgggatagtaggaccctcagccactgcattcttggggacaaaagaggagctgggaaatctgatttccttacctggctttgctcaagaagcaaggaatgtatttaaggcacagactggagtgagatggcctgggtttgaattttgactacttacaagctatgtgactgtgggcagtttactttgtgcctgagttttccttatctgtgaagtgtgactaataatagatcccaccctataacattgttgagaagatgaaatgtgaggcacacagtatgtgctcaataaatgcgaaagcctcccagccccagatgtatacactcggccagtaggggccagccctggccctcacctccatgggacagaggtcagccagggaggagatgcatctactccagggttctctgacctggcagcaaattagaatcaccgggggacattcacaaacatctgggatgggggttccagatatcagtatttaaaatgctcccaggcaattctaacatgagtcagggtgagaacccagaacaggatcacagattgtgcagttggagtgaggtagggatctgcgtgtgagtggaggagtccttggagtggggtcactcctagctataagagctcggcaaggcctttaaatgtgccaactcaaggagccttggttgccccctcaggaagggtgctggttggggaatttcaaggattgtgtgagagggtttttctgaaagggctctgcactctaccaagcactggaagaaagcagtgcacttgtttattgagtctagtgtaataacatttcacagatggggaaatagaggcctagagaggtgctgtggcctgctcagaatcccacagcaagtctatggcacagttaggactcaaaccctctgaggaatgcttggatctgaaaggttgacacagaaagactctttgagctgagggacacatagagcacacaccagggaccccagtcattgagctgtagtttgagagattcaagtaagactgaagaaataacttcttggctgggtgcagtggctcacacctgtaatcccaacactttgggaggctgaggtgggtggatcatgaggtcaagagatcgagaccatcctggccaacatggcgaaatcccatctgtactaaaaatataaaaattagctgggcatggtggtgcatgcctgtagtcccatctactcgggaggctgaggcaggagaattgcttgaacccgggaggcggaggttgcagtgagctgagatcgcgccactgcgctccagcctggtgacagagcgagactccgtctcaaaaaaataaaataaaataaaataaaataaaataaaataaaataaaataaataaaataacttctcaagaggtgagtgccatggaggtggtgcctggagttgggagcccaagagatggtggcggtgccaggccagggtcggctgttgaccatggtctgaggtggcctcccctgaagaacaagtaactctggccagtggctgtaacagatacctcccgggcacctgtatctcacccagccttgtccagagcccaggactgagccagtgacacatgctcagaatttaccaagagacttgtgcactgagctcagactcagacctagtccttccaacagcccttacatgggtcatccccttttacggaagagaaaactgaggccaaaaataggaagggaggccctgtgggggccagaacctttacacatcttagcccaggtaattttttctacagtgttaataagtaggatgaattgcccctgtttggaagattcagtaaaatacattgacttggcccagatcacttactctacacctctcctaagtccccagatgtgactcccaggaaagacacaaaaaagggctacccagagggataaggtagtaaccagggaagccctcccagaggaggtgggccttcaaatggcccctaaatgacaggcaggagggaaggatctgggagggtattgggggtggggtggcatgggcaaaggcctggaggtgagagtcagtcagtcattgatgtgagaagagcaagaagtagaaatgtaaggaatggtggggaggggagtcagagctggatgaccaagcaagggttcagctgtagagggtctggcccgccaggctcagggctcgggctttattgtgctggtggtagggagccactgagggtgagtgggggagagcatgccagagcatgcctcagaaagaaaggtgggagaaacgctggcatggagggctgccccctgagttggtggggtggccgggctctgccaaggctatgtgccagctgcctggactgtgtccaggaatgggcacaatgactcaacattgagaaaatcactccccagggagaaagggccctgatgaatcacccagctgaggtggggaggctgggaggctgggaggctgggaggctgggagctcactgagtcaccgtccaagagttggtgaggaggggagctgcagagagaggggccggcagtgcagttgacggggggattcaggtcagaccacattgagggctgtcgggggactctaccttcccgccattcccgggtttggtcctcctggccgtcctgtgagggagatgagaaaactgaggcccaggaagtggggggaggggatccgagcaaggtcatgcggcaagtcgctggcaaaggcctagcgagacccaagcgcaccctccagtccagacacgtcctgccgccccaaccgctttcatgccaagcagaggcctaagaaccgggtcggtccgggcagggagctgaccccggtgacccgctgaatccccggacgcggcccctccgggcagccggcaactgaggccggattgcgccgccgcgatgggacggcagggggcgcaggagcgtcgcggctgccgcaggctcctgaacccagaagccgctctgcggagaaacgcgctcccggagcgcgggtcccaccgcggaactgcggaccgtgtggccctggggcctgcaccctctccggctccggggacggcgacagagacctgcccacccaggcctgggggccccagtcagtggcggccgccgtgtgtgcgctcggtgtctgtgcgcacgtgtctccctcgcagatgggcgactgctccagggcctgtccgtctcacagcgacctccaacattctcccgacttccccctgcctcctaggctgagggagaggagcaagcccgaggctcctgcggtgtccgcggcccctgccccccttccccttccctccccaccccaccccactgcgccggtctctgcctggggctctggccgggccccggaccccagagtggtggcggggaaacagggtgcgatcagacagggtggaggctctgagagcggcccctgcgagatgcgagagaagtggcgacggggcgaggggcagcgagcgcaggctgacagcaggccagctggaagggccgagggaacccagggcgagacagaagcggggtgacagcggccgggtgtccggtggggtcggaggatccgacgggccgagaggtgcggtccgcggtggcggggacataggcggggccggggcgggccgggggcgggcggggggcgggccggggcggggccggggcggacactcgggcggaccaggcgaagctgtcgcggacgcgctgaccgagcgcagcggccgggccggcgggcgggcgggcggctgcgagcatggtcctggtgctgcaccacatcctcatcgctgttgtccaattcctcaggcggggccagcaggtcttcctcaagccggacgagccgccgccgccgccgcagccatgcgccgacagcctgcaggtaggggggcccccgcgctgggcaccaggagaacggggtgtccggcgagcgccgggccgggtctgcccgcccccgaacccttctcagggaggagacccctcctctagttctgaattctactcctgtgctgggacggcagcgcagaccaagagcccttgaagccccagctctcagtccacacgtcaccccagactctgaactcctttcggatccggggctccaccccaagcactgagcttccagtccacggtgggaccgcagtgcacactgagagctgtgcccaagcctcgaattccctttccttagattagtggggaccctgcccacgcctcggaaccttcaccatatatgtggggctcccggcacacctggagcacctgaacccccagctgtcatccaggactccacctcagagccggcctcacccaaagccccaaacctccattccaagcctcaactggacacccgctcagattcccacccaaacatctggacttcagtcctcagcctggaacctaccccagagtccaaatctctccttccatcagggcttcactggctttctctgtgggacccactccccgatcccttccctccctcctgtgttggagatctccgagtctttcctcgtggggggcccctcctcttgttcctctccaggtacagtggtcccactttattctctgggcttctcctctggtttctcttcaagtatttctgggctctctaatttggtctgttgccccatgtgcccacctctcttggtctatcttggtctctctcctgtttctctaggtctccatcttcgttttggggtctctttctgcagccaccccttcctcttgtatctacctctgctttgtggtgaggagggggcaggctcagagagcagggctagtgtccctgggacacccccgccccccatgttctcaggcatggcatggtgtgggctcaggtggaagggcctaaatgtggagtgtgctgccctcaggcgatgcccagggatctgaggtggtggggggatgatgtggtgggcactggcttttgtaacttataaagcccctcatcccagctgccctggtcttgacgggggcggctagggcttgagatagggaagagtaaactgcaatctggtgtcaacctgcggtgggatgtgtccaggctgggtgggtctatagtgtatgtgtttgtgtgagtgttcctgtctgtgtgtagcacgggctgggttgcatgtgttgggtgtgtcttgtgtgtaatcatgtgtgttgtgccgtgtatgaatgtgtcatcgagagtgggattatttgtggggagattatgggaattatgggtctatggcattgtgtgctatgtgtggctggggaggcagtgttgtggctgtggagtggtagctgggtgtgtggctgttgtgtgtgtagagaacttgtgtgtatgtggctgtatgtctgttattgtacagtggagttgttgtagggacagcttgcatacaggattctatatgtagttgtgtgtgttactggctgttgtgtgtggccaggaagggccactgcaggggcctgatggtttccactgggtgtcttgtcagagaggagttggggcagggggtgccgtgtgtgccaatgtgtttgcagcctaggtggctggcttagagtcactatggcacatcctgggattgcttgggtaatatatctattaggacctgagtgctggtgtttgaatgtcatgtgtctgtgtggtggctgctcccgcgattctggacaggaaagggttgcagccagggctgaggggtctgaggtgaggagccagttgacaagtgtgtgagtgtgtgagtgtgtgtgtgtgcgtgcatgtacacgtgcatatgggaatggggtggggtgggaggaggcagtgggccagcagcgctgtctatgctgaggggctgtgtgtgcccacaaacgtgtgacattaggtgtgcacattatctatgcaggttgtgtctgcatgtgtctctgtgtctaggtggcgtgcgtattgaatttaattggatgcatacacctgtggctggggaggtgagaggtgtgtgaggtgcgtggtgggagacggtgtgagtgtggtgtgaagtgagggtgtgtgagctgggtgactttttggtgtgacgtgtgaattatgtgatcttttctccccatgagctgtgtgtgcctgtggtgaggagtgagtggaggatggccagtgagctggcggtgtgtgtgttgggggtgttgaggactgtagaatgtgctgcggtggcagtgtgtgcatgaggtgtgtgtgaggaatgaggtctgtaacatttggggcgtgtggaatatagtgggtgtccccataaatgtctgtggagtgacgcatgtgtgcaaaagggcttggctgccatcctgttcttgctcccctcctgatcaggtccctagagatgccctggaatgttctccatgcccccccaaccccagctgcccctaccctttgcccttcatcctccttgccttgaccaagccctttgttttgggtttccggcggagcaggcgctggacaggcgggcggcaggcaatgtcgtggtctgagaacctttgttctcttagtttgactggtgtttggggccttggtttggaggagggtgtggagaggatgcacgtggcagcaaggtcactgtgtttactacaccacttcgtgctccgcagaggggaggcatacggcgcaggcagtgaggcctgggtggtgtctttggtggcgcctgttggtgtaagaacagcttaggctgggcttggagtttgccagccatgcagtcttagtccatagtggcccagcgcccttcctggctcatgtcagcggggctgagcagccgagcagccaagcactcacttctccaagttcacctgccctcgccccttctctgtgtggctgcagcccctggagacaaccaggaagacctcgatttagttctatttgtgttcactccaggtcagatggaggagaaagagtccccatcctcacagagacacttatctgaaaggagagagctggtcacacctttggggaccctctagactgacgcagtctgtagggggatcgaggtcataccttccagagagagctgtgggaaaaccctactgggctgcctcccagcaggtgcttgagagaagaaacatccaaggttccttgagattggaaggcttagagaagtctgagtcagtcagggaaggggctggggtcgatgccgcagtgtcacataccagaaggttctctgaaatgaataggcttgaactggaccttgaagggggtgttggggtgggcagagaaatgcagcctggggctgaggaaggttctggcctgactggcaaaagggatcttgctggccattccccaggcaacactgtctggctttgggtagccatccctgggcctccagccttctcaagctttcacggtaccttttttatcccattgtctctggctggaattatcttcattgtcgttgacattgtcatcttcatcatcttttaggcagttatttccaaattccagggtcctttcacaaatgtctcatttagcaggttaactcatgcaattgtccaaaagtctttatggaacactgctgtgtaccaggcaggcacagttttaagtgccggggtcatggtggtggccaaactggcctcatggagctcctaccttctgtgtccagccatgctgtcagttgcccacccttctgtgtttcccccagtctggggcgcctggttctgtggggctccgcatgtgcaccctctggtgctggggtctggctcctaccagaatgtgagctctgcagaggctgggcccgggtctctcctctacccaccgtgtgtgtcctgagctgggtctggcagagtccagatgctcacacctatcatcaagtgactggaactgccatgtagggttggcagtccagctctgtctagggaaactggggtccatcggatgaggggactctcatctcatcaggcagcatctcatcaggcccttcttttaccagtagctccagagaccaagaagggtcaggtgactggtgcaggtctcacagcagggtggcgcggctggtgtcagaagacagcacttcttgctgccaggttgggctctggtcctagcaccatgctgctctctggctggcctctgtgctgcctgcggcgggtaaacgattattaatgacccccctggcaaggagacaggaaatgtttcccagccacagctggggacctgctccctgccagccccagctatccatacccgtcctgaccatggcatcggtgctgatgttatcttcattctgcctcagtcttctttactccttctgcccatcccccgacctccctgatcttgacatcctaagggtaaatgacgagaagctacagagctttcttttccatatccctgtccctcaccactttctccaacctgactcatctctaccttcttccttgtcccatgccagccagaagtagctcttcctccaagaaggcttctctgaatgcacagccagctcctccagtgtccactaccctgagcccgaggcactgagtccccctcattgcagactctagtcctccactgatggtttgctctgacagccctagggctggcctgggcacttcccgcagactgtccctaattgctgccttaggactgacatatgaagggtcctcccagatgctacctccaggaagtctccagttccactcagcccagggattcttacctcctttgagcacagtgcccttcctgtctgagtcacacatgtgtacttccaggacttcctaggtggacattagtgaacacctgctatgtgcccagcacagagggtgggaagagatgagcaggatgcaggccttaaaatccccacaccttcctccaagcctgagcaatgttgcatcagccccttggcaggtggcacagacctaggtactagggctgggggaggggaggcggagaaacagggagtgatgttggtagagtgtgtggggagggcaacgagggagataaactcaggggccatggtgatataaagcagggacccctatttcagcccagagtgggagggaggggcatgttggggagcttccaggaggaaacaaatctgaactgagagctaaggtcaagccaggagaaagttctggacagaggggagagaatggttactgtgaaggttcgctggtggcagacagagggaggagagcctgtggcagcaccactccatggagcaggcccctgggtgccagccggctgggtccggggggatggggactggtaaagctggcccagccagatggtgcaggacttgtaagccatgttaaggactgcggacttattctggagggaaattgaccctggggaagagttgagagaacggatatgacagatcagatctgcatgttcaatagctccctggaccatggtgtggagactgaaggggaggctggtgtggtccaggtaagcgggggtgatgaggcctggacagggaaatggctgaagaatggaggggaggggacggagtggccagggctggtggagggagctggacagctgtagacgtgaagggcaagggaggagaatgctgccccacccaggtgtctggatgggttttgtgcagtctctgagatgtataggagggaagacaggggttagtggcagatgcctgggcctgtgtcagggccctttaaggaccaaaaggtcttggaaaagcctcagaggagatcatgagctttgagattaaagggagacctgaagccggcccagggctgctacagcctcacctgtaacatgggaacttgagatctgccctgggcaaagggtgttcagaattcaataatcaaaacaatctgtgaaatgtaatacttaataaaattcaaatccaaaaatgtctgagtacattccaaaatgagtaaaaatgtaaatttatgaaaatgctaaacatgcgtgattgttctaatgtaaattgtaagcctcagctgcttcccagaactttggatctggctcccttgaagctgctgcctctgatgtggctgccccctgcagctccaggaccttcctgttcagctcccttgagagtagccggcagggcccctcctctgcagagcctgtactctggctggtggcttcagggggcaggcattctgcctttcctgtctcccaccctaagggagttggccttgcatgcctcccatccacggttgcctctactgggggctgccactgggagacaggaagggcatgggagtttcgggagctcagggtaagaggggctgagatctcgtggtgtggagggggagcgggaaggtcgggtggccgaaagaatggagagggccgggagtgagagcaaagggagacaggcagagctgaagagcagtatcgccccaacatcaatactggtatttcagaatgggaaagctgttccatttcccgaattatcagaatgctgaggtccgatcttgcagtctctgagctgggcattccttggcccccactctcgggtattcttgcacaagaccatttttctgggctgcattttctcacttgtaaaaggaggaagttgggggtcaatatctccaagcgatatatgagctctagctctaggagtataggattttgagaatctggaattgttagtctgtggggttctaactgggacaattctagcattccttgactctcagctcccagccagggctgtgtggatgcgtggttgtgtgattccgacattctgagactttaagatgctgaggctctaggagctagagatacggacattctgtgaatctaggattctaggatttgatggtttgatgattcaatgattctaaatggggctgctgggaagagctgcaaccacctgccttgttaatgtcaatgttcagttattaaaaacataacaagaagcaatggagacagatagctcagaatggtgggcgctccctccactcccagtgagggaggacagaagaggctgggctggccttagagaatagagaccttttcaacctgggtcacacaggttgtttctcctgtcacaacagaactggtgtgtgtacattcgagagagcttccactcccaaagcttgcagggtaaggggctcatttccttcagcactggcctctattccttaaccatttcagactgggcagagagaggggtaactaccctttcctcccagccctcgaagtctctgggcagaaatggcagcagtggaggaaggagaggtctgctcacccccgccccttccctgacagcctgagggggaaaacaggacatgaatacttcctggacacagacatggaaatgcatgaacccctgccttcgagggccccgcgtccaaaggctcagacaagggcagaggccaggacagccagtggggtcccatcagcaccctctcagtataggctgaggagggaagaccctgttcttgccccaagggtgacagtgagaaggggtcaaggaaaggagtcccaggtcagggactggaagtgctgacaggtcctcccctgtgtgcaaggccacagtccagcctggcagaaggccagcccaattgtccagtgtttcactgcctcctgagtccttcttatgccttggcacccaggccagagttggggaggggtccaggctgcaggggagggtttccttccagagtgcccatccctgatggatccttagaagcccagtacagctgcacagttccaagggcttccgctgcctggtaggttcacagaccaaagctggccctggtcacacagcacaacggggcctgaaatcaggcttcctgattcccagtcctgggtgttcctttttgcccacagcctcccccacttcccctgggacacctgaggggcaggagtggaggtggggctcaggttagggagcagagcctctgtccatcatccctccgtcttcctcttcccacaggccagaagcaggtgtggtggtgacagctgcccccagtcctccacaaggctccattgtccccggcagggagcccctccccagctgcaggccagaagtgtgcctccccgggccctcctgtcgtgactctgccacccgcttcctcctgctgccccttccctcttctcatctccgcttgccctcaggccctccccatccccgtgaggtctcgtctctggcgctctctgggtttaagcctctctccagtgaaagttagatttggaagggccctgggagatcaccaagtccaacccttttattcttcggataaggaggccaggtcagagaggggaaggtcctgtccaaagctgcacagtaggctgaggcagagcccagtgctgtgctcccttcagcgctgggtcatgggtgcacactgcccttggcatcaggcgtccagggtttgagaactgactgtgatgatcagcgctaagcacacaggcacctacagaaatgcggtagggggcttctctcctcagcccttcttcacagccctgagctgccctcccttcctcttctttgcccagctcctctctccttcactatccctgctgtctgctgactcctgcctctggcagacactgtccttgggacacagactagagctcaggcctccaggactgggatgcacacccatgcacccagacacagacacataaacatgtgcaagcgtgtcacggggtccataaatcccagctgaaaactggtcagaccatcaggaggccaccctggaacccagtgtcctcctcttcctgtcaggcctcacacacctcctccaggaagccccttaggacccctgaagaccatcttcatccaactagcccctttgtgacaactgaactctgtgagcctaggttcctcctgtgactcgaagggcaaggctgagtccccccttcagtcctggggccactccttcagtgtcttcaggaggggctcagcttcctgttgctgggtggggagagccctgaggtccccacaggacgtgggacaatggggaggcggtgacagatgagaggctgagtcttccctaaagcagactccaccctcccctgacctccctggctggtggcttggacacagccctggcctggactagggtcctggtctgaccccacaatgcagaggtctgggaatcagaagccctggttctccagcagcagttctctaactggcggctatggagtccaggcctccagggcactggtaggttattggcgggttggtgcagattccagtgtccaggaggggtgagctggcctggggggcctatgtacaggagataggagggtgataaacacaggctaggtgggattacagggagctgggaatacctagctaagaatcccctcatcctaggcactttccccacacttgaaattggctggagggggaaccagaagttaggtggggttggggagggacaggagccagcaccctgcctccacctccgggcagtgcctctgctggggggagggaacctgtcctgggggtggtgggaggtgtgaggggggagctggattctccagtgaaactggccctccctcctctcaggggaggggagggggctgtccctggctgctcagcaggtagcccatctggctgtgggtggaaaagaagactcaggctttgtggataaaagggacagccctgggtcaggcacttatctcaaccctcgtcatttcctctgccggacatgactgggtgagtggggtcattgcacagagggaaggaacaggccagggccagtgcataccaggccctacaggagagtcaggcacatgggtgaccctgccacaccctgggctgcagtcagcccctcatagaggcccagacacacaccacagtcactgccggagatggccacacctagaccatcacaccacacacagacccagtctctccaggtgacactcaggcccagctgcaggcgcagctaagagggaagaccctgcagggcacagggacacgtgggacaaccagacgccctgcttcggccacaccacaagcctccacacaccaggtgcagctcctgtcacccctacggtcaacccaaggagagccagagattccagtagtcgtgggcaggtatccagtgcccaggcgagaagagggggacaccagcagggaacccagaacctcctccatgccagactgtgccctccccccagctcacagaaggagtgcctcaggctgtttatttcctagcagggactagcagggatgggtgtctcatccccctccccctcccagtccccaccacacgattctgaagctgccaaatcaaatcagcccctgcacccgcgccaggctggcatggcggccagcagctgacgggaacgaagccaggctcagaatatcccaccgcctgtccgatgcctgagtaggcttgttgggtgggggtggggaggggcaggagcctggcagccaggccctgggcagtgcccctcagagaggctgggggtttggaatgctgcagggtggtgggcttctggagaatgagtgagcaggtctctgttgtgtctccaggctgctgtggcagtgtctccaccgctagcattccgggaactgtggaagtggtgctggtaggatacaggtcgggggtctgatcccagtccagatgactgggcgccaggctggggtaggggggctcccacatggtctcacattcatttgagactcacagcacccaggttggaagccccttggttgtctgtcagtaaaggcccaactcactgtggaggcccagtgactgtgtgaggtggacattacggatcccattttacagacagagaaactgaggcttagagagggctagtagagctccctggagagaagcagaagtggaggaggcctcagaaagagtaaagaggtggtcatttccactccttaggagccctaggtggaaagaaggaatatggctctgttctcagagtcaaggaacagagaatatggcagagccagaggtgcccatgggaagcagagaacaaggagggagtcttgggagagagcagggtgcaagcaggcaaggctccctggaggagggggccatccgtgggcttgctgggggctaatgggaggacagtctggggagaaggggagaaggcctggccggcctcagcccctgaccttcttgtctctgcagccagcctggacccccttgcaaaggagccaggacccccagggagtagagacgaccgactggaggtgagagctcagtggagggagaagtgggtgggcttgagggggtggggcgcagactgaagatcagtctgagtggtgccctcccccttgggaggacggggaggctggagtcacatcccagccccagccctccagactaggaccacccctatatcaagaccatctcccctcaccctatatatccccagcctggaagtcctcccatgaggattcctcctcccaactcacctggggagtcactacagactcctcccttgtcctccccaccctcacccaacaattcccgttgattctctgccctgagtatttcccgagttcctctcctctccattctgccgcctgcttgggtccaggctccctcaactctcccctgggccactcactggctgcttgctttcagtttcccccatcatccacgtggccaccaggaggatctttctaatgcacagacctgaacttgtcactctcttgccccagaatcctccatgctccccacccccatgccccctccacaaccccagcctggcaatcgttccccttcatccattcctgcctcccccaaactgctcctgctggcctcttccccactcagcttcctaaatccttcggggatcagctctagcctcctttcctctgggaagtcctctctaccccttgaccatgggaccaagctcactcctgctccctcctctgagctctcctgccctggcagtcagatgccagggcgctctgctgtctgtcgcccaccgtgctgtgccacgagcaccctgttttctccatcacgtgactctgtatgtgtgtctgccttgtcttctctgcactgtgagctctttgagcctcgggactgtgctttcttcattcctgaaccttctaccacccttggatgggtaccggtgcagggctcagccagcgcatttcctgccctgcgaggggtgccatccccaccccccgaccatgccttccttccctgtgaggggtgcctcataggactcttcagtgctcaaaggggccttgacgagcaaacaaggtgggctgctgatgttgaagatcggcacagaggagggtgtgtgtgtgtgtgagagagagagagagaactggacccacagccagaacagagtctgcccaggcctggctgagagggagaggaagatgatgcttgtatcagccctcctgtgtgccaggagcctttgacacccaccttgtttaattattacagcacccccatgaggtaggggctgctattattcctatttcacatttggggaagctgaggcccagagggatcattcagcaagtgagttgggacagagctaagattggagcctagatgtgtctcaggctcgaggctcactctttcccggcccctgagtaagatgggaaagaaggtgcccacacagggcctggtgcacaggaggggctcagcacaggttccctgctgggacacagggccaagacctgagaatgtgcctccaagtggggctgggccctgctgctgggagctggcaaagggagctgggaggggagggcctggaaagccacattattaatttatttactgccatggcattccccatggggcggggctccccccagagctgggacagatggtgttcctgggagcctgcagtgtctcagcagcctcggccacccgccaggaaagactggatttgtcatccacccagggagccacaagaagagggggctttggcaaagctgagaccctcctgggcaacggggactgtgccctgagggaaggagtatggctccaggcaccctgctatgcctctggggcagcccccgctgcctaggccatctgcctgccctctgcaggttcaagttctgctctttgtccagctccaccggcctcgtccttcccatgaggcttccctgggtcggccccacctgctcctatccctgtattttctctgcctttccttgagctgggtcctgctgcctcttccctctgaccgaggatctggagccatgagctcctcagccctcagctctgtcctgaccccatccccacactcatccccaaaacagttagtgtctgcctggactcttggcagggcctgctggatttctgggtcctgccagcaccccacccgagtgcccaggcctatactcagcactgctgggaagagatgggctgcctgaggggacgctgccaacatggagagggcaagactggagagagtggggacccgagggcattgctcagaccacaggggcagctggagggaaaagggactgggagcctgaggggccctcctgtcagggtggatctgggaagccaagatggcctcatatagtggacaagccacagggtcagatgagcacgggttcaagtcccaactcccttgcttcctaggtgtgtggccttgtgcctgtcacttaaccagcctgagcatcagtctcctcacctgccaggcgggataagaacgtctatcactgccgggagcggtggctcacgcttgtaatctcagcactttgggaggccaaggcaggtggatcacaaggtcaggagatcgagaccattctggttaacagggtgaaacctgtctctactaaaaatacaaaaaattagccggttgtggtggtgggcgcctgtagtcccagctacttgggaggctgaggcaggagaatggtgtgaacccgggaggcagagcttgcagtgagccgagatcgcgccactgcacttcagcctgggtgacagagtgagactccatctcaaaaaaaaaaaaaaagaacctctatcattcttggatgtaatcactgttattcaacattaccacaatagagctgttgggagaagttacaaagactgtatgtgtggggtgcccggcgcaggcctggcacatggcagatccttggggagagttagcctcctctctgtttccctcaaggatgacatccttagagccaggactaggctgtacccctgtgagacaggatgctctgcagagctgggctgaggcttatggaagttctatgggcatggcacactctcctggcactggctgggcagcagccaagaaagcagagctgccagcacccatccccacccagcaggcgtgtgttcagcacaccctcctgggatggttacctagcccctgtgccagcagctgacttggaggaggggctcttccagctcagcctggcatcctccttcagggccaggcctctgcatcattactgtctctctgaaagtcaggtctggggcagttcaagttggtgaattgagcatgctgagtcaatgccctctttgtgatggctctcagggcccagatggcggcttgggagccttagctgggatgggggcatggggagaggcggacgtggatgagggcactgacatccacaataagtactgaaatgcactgcccaacaccggctcctctattgctgcccttgggacaaagaccacaccccttggcagggcattgctggccttgcctgctgggtcccctcatgtccccttgtgtccccttatgccctgagacagccagcgctacagccacattgttgtgttcactcccagcacacagcagctccccctgcctccctgcctttgctcacactgaccacctgtctggaatacctttcctttctttctccacctactctcttttcaaggcccagatgaaatgtcacctcctttgtgacgttcctcagactggtccctctacctcaggccgagccagtctcctcccttccctgggcactcacagtccccatttccctgagcccacagttgggaaacctgttaccccacggggtgctgtgggtagtgtatccttccccatggggttgtaaacacccaggaggcagaggctgagactgagtctcctttgtctctcttgggcccatgtggtgcttggtataggcctggtatatggtaggtgctcaataaatacttcttgaatgaacaagagtggctgtgagtagggctggagtagttccaagaaggggcacagttgggttgggcggtcttggagacttggaggaggcaaccttagaactttgaaggatggagagggtcaagggcaccaaccgaagaagccagggaccagctaggcagtcagagaggtccatgaggtcagcttctgacagcagcagctaaggacaaccaggaccagaacaggactgggaaaaagcagatagaggaggctggagcaaggactcagccccagaggaggctgcaggaggttggctcatgctcagaacccggctccaaaacactctgcccatgagtgctgggctgaggaaggcttggtgccagagtcagggtgaggctgaggccaccagtgaatatgtgggcccagctgcgggggtagcactaggcaggggcgggagccaggttggagggggtattgccattgccgctgcaggtggagtagggcttcgctggggaaggagcagcttgtgcgagagtgtgggcaggagtgggaggggagaaggctccgagtatacgagcatagcttaccagcaagtcctggggtgaggctggaggggccgcgctgtaggcagcacttttcgggcccttatctaacattctcaagtgagtgctcctagctgccagatgtgctacttcctcctggattctgcacatcaggagccagtggcctctacaatgccccatggccccaagggagtggctgccaacaagttggccttagcatctggcatccatgggggtcctgaggccctgccatctgtctgtgcccctgttgggctgcacaggcccggggcgtgcagggacctgggaccagggaggcggtctcagctgccactctagcctgtctctctgcctgcccatccactgtccacacccctggctgactgagtaaagagagagatgggcatcgcaggtcctgccatcaaagaagcctagtctaaaggaggaggcataaagcaccggggacttatacccagagaagacacatgctgagaccacgccaggctcgcgggcaaggcctaggcccagggagggccagcctcgtcaagggcctggagttgagactcagggaaaggcaggagctggcatagaggcgcaggcaggtccaaggcagtgcccaggccagatgctgcggccccgggctgaggttgctccagccggccccaccccccaccgtcctgcctggcctttggctgtaaacactgagagaacaagttccgtttcccgggaaatatttatctcaggctgtgtgaagagcgtgtgcactggcctccgtgtgtccttcctgcagaccggctggggcaggaggagagggagcttggcagcgcccttgctggggggagtctgtggggctaggagggaagggtgtgccagaggcccctgcctagagcctgaatttgagtgctggctgagggagaggtgggagcagatgggagagaagcctgttttctccaaaccccacaaatgccctccacctctctcatgttcctttcttcttcctggtccatcctgtctcctccaggttccggcctccagcctggtgtcccctcctcaggctgccttttcctcctcctcctccctgtttcctggctcttagccgctccatctgggaagtcttcctcaactttaaaccctcgaacccttgtcctctgccctccatctcccactcctcaggctttcagcagcttcacgtggagcattgggctggtcctgtccacagttgttcagttgctgtaacagcttgtgcaggctgccctggagccctgttctgggaagcacaggtctgggcaccctggggctggggcgaggcccggagctgatctcctctgtccatcccagtagagccagcaccagtgcagacacatgggggatccaggttggtggaccaggggaggatggaaagtcccatggatccagccggaatgttggagtggggaggcagagggcccagggttcctgctggccagcctctgggcttaggggtgtgtatcccagacaggccaggcctgccaggggccctgacaacaggaaatccttgaaggaacaagcagaggctgaggactctgagcacaacaacaggaaacagccgtgacatggggcaacagccctggcgactgtgcccagttggggtggggacgaggggccaagcttgtgggacccagggtgatgccaagagggacactgagacactgtgggacagggggcgttctgcacatgtgacacggagcttatgacgtgtaatatcaagtacgtgaccatgatcatagggtactgtgtggagtgtgggtgagtcactgagtatgtgacactggctgtgaggcactccatgatagcagatgtgtacagtggctgtgccaccaagtgtgtaacactgtgtgatattgattgtgtgatgctgacaccgagtgtgtgacattgcacattgcatgctaccacgtgtgtgacactgaaagtgacagtgagcacatggagggtgtgtctccatgagaatcaaatacagaaacgtgagcaaatgacgctgcagtagcaggtatggtcctgagtctgtggctcgagtgtctgacactgaattgtgacattgagtgtgtcccaagcatatgatctagtgaggctgagtgtgtaaacaaaggcatgacatggagtgatagcaagtgtgtggaagtgggcgtgtgatgctgtgtgatcttgggcctgacattacatgtgtgatgctctgtaatggttgtaacagtatgcaatgtgcacatacagtgctgtgtaggacactgtcatgggaaggcaccgatgggttcaggcgggaaagtaacaccgtccaaaggatggttttaaaagattgctctggccagatgcagtggctcacacctataatcccagcactttgggaggctgagctgggtggatcacctgaggtcaggagttcaagaccagtctggtgaaaccccatctctactaaaaatacaaaaattagccaggcatggtgacaggcgcctgtaatctcagctgctcgggaggttgagacaggagaatcacttgaacccagggggcagaggttgcagtgagccaagattgagccattgcactccagcctgggtgacgagtgaaataccatctcaaaaaaaaaaaaagaaaaagattgctcaggttgcagaatatgtatgtgtgcgagtgtgcatggtgcgtggcaggggaggggagataagttagggggaggcagagagaaggtgggtagagcaactggaggctcctgcagctgcccaggcaggagatggtggtgcctgtgttaatggaatggcagaagagttagagatatggagcaactttggagatatttgaaaacagaaatgacagaacttgctgataaatgagaagatgagcaagagggaaaaccagagaacaatttccagggttctggcttgaagaaccaagcgatggatggtgaagatgtttctgagatgggcaaaggcaagggggagggtcagcactagtggggtgggaggacaaggaggcagaaaccgagtgagctgttttggatgtgttaagggaagcatccaggtgaaggtgtgcagtgggcagcggggccaggctagggatacatctgggagtcgacaggcatggggggtttgttaaggtcgtggacctggctgggataatggagagagggagcttggcaacagaagaggtggggactgaggaccgagccttaaactctgaatattccattgtctagaggccggggaggtgagaaggagcagcaacgagacagaggaggagggccagggaggcagaggagaccaggagtgtgaagccagaagccaagggaggaaagaggctcaagtgggagggagggtcggtgtgtggatggtgctggcccacaggtaagatgggaaccggaagattgtgctgtgctgggcactgtgggtgagtcaggctaatgggagccatttcagtgatgggctggagccagaagtcagactggcctgtgtaggatggtgagggaggtgaagacgttagcctggagagccctttggagacgttgggctgtgagggctgcagagaaggacatgatcgctggaaagggagattacatttttttattatgggtgattctaagcagacacaataccagagagaagcatataagaaactgccatatactcatcaccccagttcaacagttgctgggatttggcctcatttcttcctctcttgccccctatctgttctttcattttcctttgcttaagcttaaaattttttaaattgtggtaaaatatacataacttaaactttaccatcataaccatttctaagtgtacagttcagttgtggtaggtacattcacactgttttgcaaccaatctctggaactctttcatcttctcaaactgaaactctgcacctattaaacgacagcccccatcctcctctgtctccagctcctggcacccaccattctactttctgtctctatgacttggactactctagatacctcaagtaattggaataatgtagtatctgtctttttgtgactggtttttaagtttacttagcataacgtcttcaagttttacccatgttgtagcatgtgacaggatttccttcctttttatggccacataatattccagtgtatggacagaccacatccatccaacaccagacacttgggttgctttcacattttagctattgtgagtaatgctgctatgaacataagtgtacaaatatctcttcaagatcctgcttccaattctttcagatgtatacctagaagtacgcttgctggatcacacagtcattctattttttggtttttgaggaactgccatactgttttctgtatctttttacattcccacggacagtgtacaggggtttcagtttctccacatccttgccaacatgtgttattttctgttcttttttttcttttattttttaatggtagccatcctaatgggtgtggggtgacatttcattgtggttttgatttgcatttccctaatgattagtgaagttgagcatcttttcatgtgctggttggccacttgtatatcttctttgggaaaatgttgattcaagtcctttgcccatttaaaacattgggttgtttgcttttttgttgttattgaattgcaggggttctttatatattccagatattacctctttatcagataaaagctttgcaaatatttttctcccatttcataggttgcttcgctgaaatatgttaaagcaaatcccagacatgatgtcatttcaccaaaggtagactttttttttggtggggggagctttccggtgaagactgaaaaacctgctagacaaattctaaaatagatgtgactttggatttttgttttttaaggctaggaggtcctggatgatgctgaaatgtaacagtgacacagagccagtgtggaactgtgtctgatgctgtgtgagggtgacatggtggctttgggaacatgggtgcaacactgaagatatgggagactccaagtgagggtgacagtgagagatcactgtgtgtgtggccctgtgacacccagtgacatgggacagtgggacgctgtggaccctgaaatgactgtgtgtcaccgagcaggtgggacctgctgtgtgaaggccacaggtgtcatgtcttcttgtgtcatcctggttgatgagtgtgacacagtgcaggactctgcatgggagtaagagggactgaagctgtgctataggtgaccgggctgcatgtgattcaagtgggctcagccccagcttcagctgctgagtatgggagggagcatggacattgtagggtagatgaggagaaacactgaatgggaacagaaatggtgtctgtgcccagatgcgagctcctcccttctctgaatacccaggaaggcttcctggaggcaggatgtgggcacttcagcaggatgttgtaggtgctgattaagagcagggcctgtggtgtcagacagccctgtctaggctctgacattcagcaggtcattttatctcttgagcctcaatttcctcaagtataaaatgggagctcttaggaggattgcatgaagcagtgctccaatgcatgcagtctctggcacttggtaaatactctatggtctcttggggagcagcaacctcaacacctgcaccccaggtccccaaataacaggagcaccagtaggagcacagtgaaggtgcgctgagtgaggtgtcctcttacacccacagccctcctctctccctctcccccaacttctgtcccctgcttggtgttgtcagcgataccccctcctgcccactcactcctgccccctcctctcccctgccgtccttaccactgtcagcctccagcccaggctcctgcagcctcatccaattaggccaatgcaatttgctcaagaaaaagccccataatttggttaatcacaccagtaggggatctggtcccggtcgggagggtgggggtggataggagtccatacccgcagctgaggcacaggtgtcaaagtgcctgtcttttgggacctttacccacttccttgggctcctttcaggagccaacagagtccaaagcttgggtcttctcaaacccaactacagaggccttgaaacaggagtctggacttcctgggttcgcttgtgttcctgggagggtccctgctactctctgggcctcagtctccctttccaaaaatgggagtggaactggggagtctcagaggccccagttggcctagctctgcatcccagctctggtcagtcccccttgtggcttctgaggggccttctcctgggccttggggagggagcactgaggggtaggtggagagcacagggccccagggaagtgaggaggggtaagtgtcctctgagtctcatctggaatgtgtctaccccagtcctataatcagagaccctctagttccaggctgcacacctgaaggtggggcaggaagaaaggaagctgccctttcttggtcacctgcaaggccaaagtctcttaaccgtgcaggctataccttgcacaggagctccagcagaggtggggtggtgctgaaactgagcccactctccctcaccaagcctttcccctcaggcccgcatctgcccagagaattggggtccctcctttctaatgtgcacacaggtggccccagccccctgctgggagtcagcttaggcaaggtttgatggctcagcttaatcttctcagcagctctgggggaagagaccattttacggatgaggaactgagcccaggaaggtccaaagacttgtccagtacatgtggtgtgtggcagggcaggcagatgagcccgcatctgagggaggcgatgggagaagtgacaggggtgcgcagaggaggagaattagaccctctcagattccaccactctcagccacacgttcactcactcatttggagacaagactaaccaccagcgcattcacagcaccccagacagccacatactgactataccactgtcacatggacatcaatgacctgaatcacatatgcatagatgcaggcccacatggtcactcccacgtgcagatggccagtgcacacacatagacacagggtactcacacatgtttacactctcacgacccatgtgggttacagattcctacagagacacagacctacatactttcacaaggaaattctcccagtgacccagggaacatagtctgccatgatgatgtgatggtccgtaggggctcgccactatggaccattaatgggcaggctgcacacatgcttaggtccccagcaaagcgggagttctgcacagagtgagaggagaggtcagttctgatgagtgtatccagaattttgcaatcagaaaaaccacacaaaaactattttaattttcatttccaagataaaatttagtttgaattgtatagagggtccgagggtctggtgggagggcatcatcatcttttcaaggctttggggttctaaggcacccacagattcacaacagtcccacaagatatcccaggctgacatatttacccagcccagtgtgtgcgtgtgtgtgtgtgtgtgtgcgcacgctgtgtgcatgctcatgctggctcccagatcctcgggatgtgaggaaggaaagtaggagagattccagagactccggatgtttgttctctggcttcctgggcccttcaaaggaaaataactctggatgtcagcctgcctgcctggcgggctgggtggagaggtgggctgtttatgttgggaggtgggctgtatgacagcctgcctcagcccctgtggccccactgaccgggaccctgtgtaatgaggcagagtgaccaaggcccatggccagcgtcccatgggctcgtaggcccatcgcctcccctctctggggcttggctctctcatctgaaaaatggaggtgggaaggagatgagactggatgggctttctcctggagactgattagagagacagagactcaggcccggggtccagaaaagacaaccaaagctggggagggcacatgaaggggggcaaagaaggtctgggttcaggggagtgcgtggggccccagagcctgccatgtctccgccaactctctccctcactggaggagggctctgtgccttggtgccccacctgcccagggccctgtggctcagccccttgcttgctctgtgagggggacgggagaaggatgagagtcccagtgatagggggaggacaagaccaggggagagggctgggggtttctggagggccagagcaggaagagcaggagagaagagaggacaccacagtgcaggaaacggaggagcaaaggctgggagtggggaggctggaggggtgcagggaatcagactggggcgctgcgaagaggcctgaggccagagcaggcagtgcctggatggagggagcgagcagctcctcaccctcagctccttgatgaggtaaggtgaccacgagccctgctccaggctgtgtgctgagcactttgctcggagcctgtcactctggaggaggggagggggtgttcccaggagctatgacagtcttgtgcaagggagggacagggtcacatttatgtttaacaaagcactgcgctgggagagaggagctgagagaccccggccctggggagcatggtggctgggaccccggagggcaggcgtgccccagacggaccccactcagaagattgcttatcccaaccccccaaagagaaaggctatttttaggaacaataaaagtgctcacacattcctgcaggggcagagagagggaaagggggcaggagtcagtgcagaggaagagggtggaccccgctcttctcccaactctgccttggtcttcagggacttctcctcaggggcttccccagccagccctgcctctccagcctccgcctgtccctggggttccctaccggctcttatgtctatccctctgcttctgaattggtacttgttctgtccctgtctctctttctcatacttccactttccccctccccctggggtttggggaacagctgggatgggccaagctctgttgagagagccaaatacagtcataggacaaagcagcgggaggctgtgggatacacacatgccgcagagcacagacagagagaggtggccaggcacagagagagcgcccagggaggctgagaggcagggagaaaacacgctgggacagtcagggagagccccagggcaggcatcaccgggcagccagcctctgtgccctgctctctatcttgtccctaagaagaccagcatggctgggcttgcctcccgccatccaccccaccagccctaccccaggctggcccttcctccccgccctctgcaggcccacactaaccctaggccaggccgcctccttcagcatttacctcccacacacaatgggcacagtgaggacataagagacccagtctctggcctggaggcagatactcagccttacccgacatctgagagggctcagcccatcccctggccaaggcaggtattagaggggccccaaagacaagcaggactctgggacaaggtgtcctagtgtggcccaaagggctgggctgaagcatgggtctcctggctccagatgagagcctgggtgaatccttccctgcctcctctggccttagtctaccccatcaagcttgggattggactacatgaggcctgaggccctgtagcccctggtccctgggaattctcagaaggcctgggagggggacaggtgaccacgcaggaaggcttcctggaggaggtgtcctcactcatgaaagaaggtgatagtgacagtgctcctcttggggaagagccctccatcctgacctgctgcccccacccggtctgcacgtggagatgatcctgaagcacaaagggcctcccggcctgcagaggtgcctgggagaggttgccaaaggctctcagtaggagacaccccattcctcaggctccttctctgagactgtaactgtgccagactggggaggctttgagaggtctcagctatctcccctgcctagatccttcctccacacccctcttctccctgatggcatgtagccctcacagtacagtagtcctgggcacacaggagtttacccagtcatttacagctcagcaaacgcctaccaacacctatgaggggctgggtaatgctggagacctggagaggggcaggacacaatctctgccctccaaaagctcccagtctgttgtgggagccagacgggaaagggtggcactgcattgatgcacacagtgcatgccatggtgggggaaaggggggcagtgggagccccaggtgggagggtcagacttgcctggagagagaacaacaacagactctccctggaggggatccagagaagggagatcactccattcattcattcgtcattcatccatccacccattcaattattcctttggccatcatttcctgagggatgtaaactctcttctgacactgacccagcgggacactcagcgtcctcctcctctcctgcttgagccaccatgcctgcctcttggaggctcctggacttgctttgctcagctcccaacccaccctgagggggtgaggctgaggagggtgtacagacattcagggtcaccaaactcagagctggaggcctgccacctcaccaggggcctttctcagggcacaggctccctggtggcagggccttggcccttgcttgcacacccttggggactaggagccccctcatccatcctgctcaggctctcttttgtggcgcgactctgattcacagtgtgcccaaatctgcctccttgtgactgccgcgagctgcctcgtgggccccaggccagaggacaaggatagctagaatgccaggtgaccaggatgactgtgatggcatggagagggggatgctgtgatgtgtttgggaggaagtttgtggtgtccaggagaatgtgggcagcagaaatgggaccactctcggttcttccctgtagatgaagcagctgaaggtgggagggggtgggaggagacctgagctggctctgccccgcttgatctgatgtctgccttgcagggccatcctccccctccccacactcagctcctgcctccctccctctacccactctgactgttccctcctttcctgactccagactctgggtgagggactgaggtgattccagtgagtcaggccctcagggaactgatcgtgcaggcaactcttgcctgccttctcctgctctttccctcttcccattccttcatccacccccaaacctagctcctgatggatccaagggtgcgggggacaaccgggaggtcattttggaggaggcaggagctggaatagaagctgggactggcttgggaagggcgagaggccggggcggagctggttgtgggcgctggaagggaggagccaacagtgtggggtcaggctcctgtggatggggacacccttgggaggcactgggactggctcaggtgtattctacagtgcacgtgtctccagtgtggctcggaggctggagacgcggccctgttggagtaacaactgaagccggagtctgcgaagggtgggcaggagggtggagggatgggggcatggagcgggagggggtaagtagaggagggaggggaggaagagaaagagggaggaggaaaggtctctggcaggtccctcctttaagactgggctcctgcgctgcgagtggccccgtccatactgccttgttatccatatctccccaccactagtctccctctgtccttccacccccagcctctcccctccattgggaccttccctggggcgtcccctcattggctgttctcacctgagcaaggcccctcccctccagtccttagcctcttcacctgtacaatgggatgacccaaacaggcacctcttgggcttgtaggaggatccaagatagtgtcagtgggtctcgaggtgtggtcccccgaccagcagcatcagtgtcatctaggaatgtttggaaacgcaagttcttggacctcgtcccagacctactgtatcagaaaccctgggggtggggccagcaatctgcactttaacaagcactctgggtggttctggtgcacatgaaaattggggaacggctggtggaaacctctagccacaggaggtgcttgggaaaggtaccttcccctccccaaagcctgatgcctcactcaagcatgacactgacagttgggctagttcagctgcgttctgggtctctgtcttgcctcctccttcagactaagcctcccaagggttgccaagcctctttcctctattctcctcaccctgatccagctcagcctcattgagagaagtctggggctgcaagatcttcgcactcacaggcagttcctctttgcacatccaaggcaccagtgtctttgagaggcgtctccttggccaggtggcaggcgtgggtgtgtggggaggaaggaggaggaaccgccttgttctgctttcttgtctctgactctgcaggctgggggtgctgtaaggctgcgaggaggcatagagtcagcttgggtgctgggctgaggccaggggccgaggctcagctgaagcgggcttctctggtctgagcctacaggatgcctcctttggggcagttctgccagtcaccctgactgggcggctgtgcttgctagtgccagacccatgctaggcacagaggtcgatacgttctcctgtgctcttgaagggccctgtcctctgggaagataagaggctgtgtatattgcccaccggaacaggaggcaggaagcaaaagaggcgtagatgacacttgcctggcaccccctgtttcccctctagctgccttcctgggtttcccattctgtgggcgcttctcttgagttaggtgctttctcccagtgttctcaaggtgactatttggaggtttgtgggaggagtgggctggagacacaggagtaggtgggggcaggaagtatgcaggagagagatggagagtgggaggagaagctatgagaggaagagaggacgcggaggtgggaaaagacgtcaagactcctggagaggaacaggagtgcagcctgggacagaggtggacgtcggccgggggaggcagggaggaaggcagggaggtccacccgaaaggaagggaagggatgatggacagagaatgagagggctccgaggtcctgggggatctagaaggacccttccctttacagaaggggacaccaaggcccagagagagaggagggcctcacagaggacctaacacaagcagagttgcatgaatcagtgtgaacggacagtcccaagagcacagccggaccttgggaggtacttgactcttgagtttgatgttattgccttcctgtaggccagtgtgaggggcactgtgaggcttccttccagagaaggaggcatggagccagtgccaggcagtggggtgagccataggaggacctgtggagatggggaaaggcatagagactcatgaagatgaaacaggaaagatcttatggcagcgaccccaaccctcaggaagggcgttggtcttgtgcttgtggctccaaaggggataagaccaaggtctctggtttcatagaatcttaggctttaagaacgagttagaagtaatttagtccagaccctctcctctccccagataagtgcagaaatgcagatctagcccacggctgagccccaaccctggcttcagaggaggcctgactcagaacaggctcccctttcttggtacctggggtgaatgaaagctaagtccgtggtaatggtgctgtctgtggtgctgactggccttaccttggactacagagctgcaggtggagctggagagagcagaaaggctccatctatccatctacccacccacccagccacccatctacctatccacccaccatccacccacccatccatccaccatccctcccccaacccatcctgcacccattcatctatccacctacccactcatccatccagcctcattgaattaaaccatagaactatatgctgcagagctagaaagatccattttttagtaatgacaaaactgaggctcagaagaggaaaggtgttgcgtaaggccacacagaacttctgtagtcagtctggtacaggattggaaattgcggctcttttctacacaccacaagttctcctctgtggtctgggaaattgcctggtttttatgctgatatctatactgatatttgttccaaaaagctgtgaaggcaggaaatgtgacctccttcaccccatcccgagcctgagttctgtgtgtgtgtgtgtgtgtgtgtgtgtgtgtgtgtgtgtgtgtgtggatgtgatgtgcatgtctaagtgcaaccttgtatatgcattgaatatatgattgccttttgatctgtctgtgtgcgtgtttgtgtgagagcctgtgcatatacgtatgagtagaggagtgcgtagcaatatgtatttgtgtggcatgtgtagatgggcatgtgagcaggtaaagctgtgtctgtatttttcctttcctcttccttttaagatcgaagccccctgacttgagccttgctccccatctgtgcctccaattcaggaatctccctgcttcccattagcagctgctccccactgattctctccttccttcactgaagcagcaactcttccctctgagcccacacctcatgggctttgcaatttgagctatttcctcccctgagttggtgcaatgggggtgaagttgctttgagatctgaggaagattcatggaggagatggcatttgagcaagccttgaaggcccctttgagtgccagatctgaagtggcccttcccagctgcagttcctgcacccaacaccctccattcctggggcatgctgggcaggaccaggaggtggattgacagaaggatgcccacaaagagccctgggcttcatcagtcacattaccatccagtccgctctagcacagatgggaagcccttccctgctgctgccccaactctccccaactttcctttcctgctctccttattgctactatcctgcacttggcctgaaaagtcacagaaaactgaacaatcagagcaaaggtcaggcaggcacccaccaattccagtaaaggacagttgagggcattccccaattgaagcaaagggcaggttgaggagtccaccaatcagaataaaggacagactgttctttctgagcaccctagggtgggagctggggatcgggtgctgagcaggaaccagacagggctagagatccagaggtttgggttctggacctggctctgctctgactggctgtctgaccacaggttgatcattgcttctcattgaacctcagcttcctcatcggtcaaatggggagacttagctctctgaaggctgtggctttgaagaatttctccccctgtatcaggctcactccgtcacctgggtctctcttccccaagtccacatcacatgcatcagactccaccaagggcagggcctctcaggagtcagcttgtgggctcctctgcctccaagaaggaatagacacaaaccaacaccaccttctgtgctgtctttagagcccccgtctggggagcgtgcatctggaagactttatcttgggagtactgggggcatcagctcttcctcccctttttagtcttcagaattgaccttggaaggccataatagcctgcgtgtattgtgcacaggtatcactcgagctcttgccctgtgaatctttaaggaactgtaccagtgagaacgtgtgtgtgtgtgcgcacatggatggtgtctgaaggcctgctgggatgtctgcgaggacgtgggatctgtggctgtgtggtgctgaagttgtctgtgctgtgatgaggagtgcctaagggtcaaaagacaagtgatccaatttgggtattgtgttgtctggaatcagtagcttctgatgtctgagggtagacatcttcccatgaccaagatatgtgtcttcatccttgagcagtgggagggaccaaggaagcctgggggttggggaaagcgatgctgagtaagcatctggggagaaggcccactactgccctcctcctgggaacactggattgggtgggggaaggggaggaaactgcagccaagaagacccaggagtgaaatttggagctgaagcctggatgcaagtcttcattgagagcccagcgtggaactttctggcaaataggcattcagcccactcttgtgcacccttgaggatgggaagctcacttcctccctctctcctggtgacctgtggcatgcctttgtagcatggccctacctggaagaaggtccttcagcccactagaccaaggccagcctcctgtgaaatcctatgggtccccaggctgtccatggggccacagagttcagatcccccatctaggagggtctgagagattggagttggagactgataaccctgggtctcctctgctttagatgaggcatccctgggttatccagtcttagtcacatgcaaaacttggtttccaattccctcgtttcataggtcgcctcctctggatgagtgtcatcttgtcagcccctgggacacaatgaacaggggatggtctaactagactataaaagtgggggaactgtcatcttcccaattgggttaacagacctctattaatatggcctgcaatttgagcatttttatttcttgccagtcatgcttacactgtgggctcatgctgaactgtggtcttttaagaccctcaacctcatatcatgttcacatgaatggggacccagccatgtctccttcatcttgcagttaatcactttgctttctgaacacagacccaaccttccactgggaagacatctgaaaggacttccaagggcttgcgggagggcatggctggtggctggtatgagtcacgatcttgccttggccctcgtttcctttgttctgttacctttctctttgatccccatggctctggccaagttaatagagcgagaagcagggacttttgtctccgttccggctctgcaaggacgagttctgttcctgggatgggaaggctgtgagacagtcaaggctgacgtctccttctcctcctatagttgccaggggtggcccagctgttctcccaccttatgggttatgcaccccataggctcttgctactctcaacccagcccctcactaggctggaaaatgagactaggtgagaccaccttccttctggggaaagtgagcgggacccagcttcagcgaatattcagctgagcatctactctgtgttgggcattctgtgaggcacttttaggactctgatttttattttcatttttaagggctcaatttcattttatcttcatgtcagcctgtagggggcaatagccccagctgcttccaacttacagataggagactgaggctcagtgactgaaccaagacactcactgctcatacacagcggagctaggattcaaatttgggtgtttttttgtttgcttgttttgttttaatttggagccttgtggtttccctactgtgccagaattgtcctcgactagagaacaagagacctggggtctaggccaggcttgacctgttgactcactatgaggcctttgctaagtccctggcccttctctgcgcctcagtttccccacctgtaagatgagggtacttggacattctgtggccttaagactgtttgattttgagatcctaagatcctgggattcctgtgcctgaaagactcgggctctggactaagctggggggttttgctcacagtcctttgggcagatggggctgccctggcctgcctggcaaagcctctcactgccctctcctctcttccaggacgccttgctgagtctgggctctgtcatcgacatttcaggcctgcaacgtgctgtcaaggaggccctgtcagctgtgctcccccgagtggtaggtgcccgcccttgccccacgcttcccaccccacccccaaatcctttgaccagctctatgctgtacctcactcagggccaaggaggaaggaagaggcagggtccctgcccagaggactttcatggggaagtgaagggtctggatgggtgttctgagacagctttctggaggaggaagcctgaagctaagcatcaaggaatgaacttgcataggaatcctgcaatggctgagccagaaggggccttagaggttaagtggaaaagctgtgtctcagataatgaaagggattcacctaggataacaggacgtggtggagccagctgagttttggaatacatgcagcaggagaagttgagggtagacatgtagaagaacttcctggaagccaggtctgggaggtactagaatagggctcagctttgatgaatagacatgcattgggttaaagtgccctgcctggagatgggaggctggaaaaatggcctctagcagccttttagcagctttctttctgtcccatcccaataccatggatgagttgcaggtttggggcaggtttggggtgatcatggttgcctgagcccagagtgccttactggggagattgtgcccctcatcatctgttccaggccactcccctacctggcttcaatggccactgttcatcccttaggcaggaggatgggtaaaccagcccttgaggcccaaagtagcagggtgttagttgcaccagaaagagggaagcaggggacgtttgaagcctggagaagggagtctgatccagcctaaggggcatggaagacttcctggaggaggagatgccctaactgagtcctgatagccttgaatgtcctcttccctactctaaacccggccaagggcagcctctgctccaggaaatatggccaactcagaatgtgaccttcccatccctccagagcccattgtccctgaatctgcttgatggatgaaccaccggaggcccagagagagagggcacttgtcccaaggtcacacagcatgacagggataaatgggacttggtatctaagcagccccattccctctcctcagctctgccttccccaaacctcctagaagttcagagcccaggaggagggctaatgagtgagctttattgagtgtgaaattggtaggaagtgggtggtgtgttggcgcccaaaaataaatcctcctggagaaggacgggactaaggcaacatctgggctggggtgaaggcacatctggaaagggagggtggtggaaactggcaggtcggtttctgtagggctgccccgagagcctctgtggccactgaggctgccgtagggtgggaggaggaagtgactggctctgtttcacaggcagggtgccctggcggctgtgccagcctagatgctctgcaacagattaattgtctccccaaagctgggggctgggatgacagctgtggtccaggttcctgggacagtgggaaatgtcagccctggcccacccaagagccctataggagctagggaagccctgactttcgggagtcctggcttgattgcacggaggggctcagcccccagtgaggtaagggagctgaggtctgctctgctgcccccagggagggaagcagagatggggaggggacccccgcccagggaggagagctgctggcacctggcttcctcatcagcacccattgtggcaggcagccccgaatgcagatggtgctgatgtgtctgaaatggttccctccttctctccaatagactcagctaattttaacccagagggctgagagtaagggggtgggagacatacggacatgcggaagtgaagcgagaatctgtccccctctgcccccatggactacccacccctccctctgcctgggcaggactttctgtgtaaccccggctggtctcttaacctctttgggccaaataactcaggcccctcccaggctgctggaagagatggatgacaaggaggctagatatagccgaagagtgggcggcctccttcccactgaattctttatccctgaacatcccacttaggtttccttccagccaaacaagagggtgtctgcccctctcactcccttcaggccttatcattcccaccccatgccacacccaccacggaacctggctcagtgtctctggaagtagtggccaggcatctcctgtggtgggggctggctggcgacagctgatgacaagaagagtggctggcaggattgtggacgctctcagagtcatggaaggcaactgcttcttctgggaaggattccacacttactgagggtgggccttcaacacgtagctccactgtcagctcctcccaaagccctccaggataccctcagctgggaggcaagcccttctccatcctcctgcggagaaaacagcagagttgtggacaaggctgcgttgcatgggggttggtcagggatcccgaagggttgccagttctgcttggaaggaatgtggatttttgcctgtaggtcagtgagggcaactacttctgccaagacatggcctggaactgaggccagagctgctctgggcccttggggagggaggattaaagagcaagagctttgatctccctctgaggagtaatcggtccaaaatacaaatctgctcacgtctccctgtgcacgtcctgccctgccccagttctgttcgtaagcccatcccactcagccctactgaccttgggcccagcccctgtgccccttccctcactgtctgttcctaaatgctccatgctttatacgcctctggacctacctgtgtacctgctataaggcctgggagcccattctgcaccctgcccactccctgaatgtgtctaattcccactcagtgacagctgaaaggtcacttcctccaggaagccctctccagccccaccggaggatggcgcagtgccctgctctgtgttcctcccctggctggggttatgggtgtgtggtttcttgtagaggtgaaggagggatgcttcctagaacattctgagccccatccctggtacagctcagagtggatgctcagttattgtttgctgaatgcctgaggctggagtcaggcagggaaatatcccaggtgggaggtgatttgtctgcaccctcagtccttgaaactctttacctggcacattgggttttgggtggtaaaaaaggtcataggttcatgaatcattgcctgcttagaattccgtccaagaggagaggacgaggtgcttagttcaccgggtgttttgctgccctggctgcatcttagaatcacctggagagaaaaacaaacagatcattgccagagctccactcccacaggttccatgaccttgccccacagacccctgtgtacaggctgggactgggcagctgggagggcctctccacagggtctcataagtgccttctgtcctaggaaactgtctacacctacctactggatggtgagtcccagctggtgtgtgaggaccccccacatgagctgccccaggaggggaaagtccggtgagccattctctgcacccccattgccctcttgcatggccaaggattctcagggctgaggcaccatccaaggtcatctggtctgaccctccccttccaacattgatccccgcctccctgccaggtgggattccttggccaggttgctgactccagcacagaagggcagaagcaatgtcttctcttccttggggaaatggataggcacagagaaaataccaattgatggtaaattttctccttctaattgcttctaaatggctgcagcctcctcagagcagagtctcagaacattggggctatggggtgtatcagttagaacaccggcatgctgtgagaactactgcgaggctggacctggaatcccagcatgctgggcctgcaggagctcacagtgccaactccttgcatctgagaacagggagatcacaggcagcgtcctgctgagggttctggagccccactgcctgggttcaaatctcagctccctgtttactagctgtgtaaccttgggcaaatgacacaacctctctgtgcctcagttttgtttatgaaatggtgataataatggtgcttataggattgtggggaggattaaatgtgtcacacatgtaaagcatttaaatcaggcctgatccatggtgagggctgtctgttggggattaccattgtgagagaatgctggaatcactgacttcaggatcatgggatcagggcacttggccccctgataccttgatgcccatttaattcagcctcctcatcttccagatgggtggatatcatgagacatgaccaaggccacatgccaggtatgaggcagagccaggcctaggactcgggtcttctgactcctggctgtttaggggaaagtgagaggaagtggaactcatcagatgagaaaaccttgggggcaggcatgctgctgggaggaggcaggctctgaaggatgtggccattgcctgctaagcactgaatgcagggccattgtggggcccagggagcactgggcaggagctgagggcagagtgggcaccagtggggatgtcccaagaaggcagctctctacccctgtgaggagggcttttccagcaggccaggtggtccagggatgtggctttttcaggtagcagctgagcctggcaagccactcacctttcacagggaccatggaaagaattcctgtttgaggatgctggactcatggtcctgaggcccctccttgtgctggaaaccctggtttctaggatgctggtctctcctcagccctttcccgtggaaggagttggttctgctctgatagccaccttcccatttcctattctcccactgagctcctttcaccttcccctaacaacttctccgtcaaggagcatgggaacaaagccattaccacctctctctagcctttgtgtcccgtctgtaagaggatggtctgaaaggtctttagaaccttaaggggaaaaatgtggtcatgtccccctttctcctctaattccaaagaacttcgctctcctccagcatcccccacctctaattctaaagaactttgcttcatataagctccactcctccaggaaggctcctcggagcagcctgggaggccttcctgggagggatgcaggaaaacaggctcaggaggcagcggggagcagcctgcaggtttgcttcactccctaggacccacacatgctcccctcagctgtctgggcatgtagagtgggtgcgtatctgcggtccaggcatttttgagagggctcagatccttggcatcagctgccctttcaacatcctccttccaaccacttcagactcagtaaggcctttggaaaaaataccaaaaaaaaaagcaattaaaagtgaatattcaaatccaattatcccagagctcagtggagatggggaggtgagtgcctgctggtagacaggggctgaagattccaggaggagggccaggggatgagaaggcaagagagtgaggacagcaaggacctcccaggggacatacccatcatcaggacacacccgtcatcatccccaaacaggaattctttccatggcccctgtgaaaggtgagtggcttgccaggctcagctgctacctgaaaaaggattgggggaaggcccaggcccagtgctctctctggtatctgagctctgcttgcccacctttgtgcctggtgtctggtggtgagcccatctccacagttagggcggagaggccccagggttggctgggccctgctctcaggagctcccagcaggatggggacttgagacccaggtgtatggacgagggaagagcactggaatgggattcagacaggtctggattctagctcagccccctccctgtctctctgctttcctacctgaggcccggtctattggcttaatggggtaacaggggccaagtgcttggcacagtgcccagcacacagtaggagctcagtgattgctacttgcactcccaagtcccaaccaatgattagccttgagtgaccttgagaaaacgacttctcttctggccttttttctgtgaaatgggtggggttgggtacagggtccttccgatggtgacctttgtggctctggtccccccaggagggagagggactgacctacaggctgccgtggagcctgaggctctagcagtgcccgaggaggtgggggtgtggggagggtgctactccaggaaaccctggactgtgggcaaacagcagcaggtgtggcgtggaggctggatcatagagacagataaggaggcccgaggcaatgggcagggaatgggatcagggcagtgtggggagagacagggtggaaaagggtcaaggcgggagtgaggaggcccccgccagctcccagccccacctgtccctgttcctgccgctgtttgggctctcagatgcccagctgcatccccccagtgtgtttggctttcctgtcttcttgtgcttgtaagggctgcttgctcccttgcaaagaccgtccctgctccactttcatctcagccaatcccattgtaattatctttcatggcctgaccagaagctgtcttggggaagcctgctccacagttccctgacactgagaaggaaccaagtttcagaaaaggggtctgggccatattggcctcccttagggttcttccacaggaagaaccttgggctgggagtcagagacctgggatccaggacaacatggctgcaatcacaatccgatgccctcttcctgggcctccatatgcccttctgtaaaatgatacgctgaacattctgatattgagggctggtgaggctctgaattgtaagggctgcaaacgaccttggggctggagaggagagaatcctggaaggctgcctgggccagggtcttcctgaaaggaggcttcacttccctcttgttggtgccccacctccatctcccagactgtttcaggccccagctctgccgccttcctcttcttgtgtctcctgctatcttaaagcctctgattacctgatgctgagtgcagcaaaaatctcaggcctttcagctgcaactgaagcacccaccgcccacctcggcccaggctggctgtctccctctgctaccattttggggtccccagggcccatccctaagaaatttcttcccctaagctgaccaggtcttctttcattgcagaatctgaccatccctaggggttgtctcagaggacaccgggaacggtctgctcccatctcgggatcctcacatgctgggggaaggagggcaagaagagggtccaggtcctgggggctcagtgagagtggggggcttagtgaggggatgggggcccagtgacagtgggcagcctcagtgaggtgatgggggcccagtgaggatatgagggctcagtgagagtggggtggcccagtgaggggattggggcacagtgagagtgaggggctctgtgagggggtagggacttaagtgaggggatggagacttagtgagagtcggggggctcagtgagggtgggggttccctggggggatggggttccgtgggaggatgggctcagcaacaggcttggctgcttactgatgcctgggacctagtgggtgttggaggggggcttctccaaagtagagaacgcgagaaggacacacacaggggctcagagaagtgcaggggacccagctctttccaggctgttggccctaccagcagagaacctttccctcgattctttttccattaaacaaatagttgttaaagggacggaactgccataaagtccacgcctgttcctctctccactctgtgcccatctgtccttatcttcagtggggcaggccatgaccacccaggcacccagtgctgtcattagccttcgcctgggcagctggccctgggttgtggagttccccacaacccccagcatgagcctggaaggcagggtgggggtggggtagtagtaagggaggaactggagaggagcagggagcggctctgagttgagcaaggagctatcgggggtctgagcagtggacgaagctcccgctcccatgtgggtgggggagactcagccttggcacattccccctcgcagtctgtgggcatctttggagacttcaggaggacagcagttctgggagggctatggcagaggaaaggggctcccatgggggtaggttgaggtgagtgtgggctatggggtcccgcaaagccgggggagggcaggctgcagagcaaggtgccgaggctgcctaagaattgagggtccttggaagccccagtgcttgggggcatctcggcttatcaagattggtctatcccagctcagcctctgtcttgtccagggccactaagatgataggaccctcactgagaccaggtttccagtgtcacagtctccttatgtggagagttttacccaggcagcatgatcgttctgaaatcatacctgaccattaccgtccctgctcaaatccctcccagggcaccccctgccctcaggctcaagcccagctccatagggccctggcccctgtctagccttgctctcggctgtccagtcacaccaacctccttgtggccatacctttcagcaggcacacaatcttctcgcctccaagccttcacaattgcaattccctggacatcctttcctgtctgcctcgataacctctgcctgtcctttaggactcaactcagatgtctccctctacaggaagccttctctgactccatcacaccctgcacctgagtgggctggggcctgctcttcctgcctttggcagagctctcatctcccgactgaagcgtgggtctgtacgttgatctctgcgtgttcttggcctcctcaagtgaggcatatgtctgacccctctgctcatctcagccctcagcactgaacctgacccagaaggacccagtgaaatgagagactttaagtagaatgctccccgaggtttttcatctagaacacttattcttgctctgccatggagaatggattgaagagacccagctaggaggctagaggcttggggagaggctgcttcagggttcagggaaaaggtgtctccatgtgagctgggcagtggcttgggcatagagagcagaggacagttgtgagagacaactgggaggtgactcactgatcggatgggggaggtgaggaaagaaggcaggtttttggacaagccgtgaaggacctggtggatggttgtgctgctttgttgtgaggtggagggagtggagataataattcagatggtatgggggtccctgggccacctcagggacgtggtggggaggctccaggtggcctttgggtatctggggtctggagctcatgagtgagggctggagagtcatgaggccgtgagcacagaggaggggttttgtgcaaaagagaagaaaggctgaggacagattccttcatcagggtcctgggaaagagaggccaagcagctccagtccaggggtgggaggggaaatagttgggagtcggcaggatgaggctgcagtgcgcactgaccagcaacgcaaggaccagtgccaccttgtggcctccggttaaccagattgtctgaggccaaggagctgggcagggtttggccaggggtcaccccctgcctccgtgaagcctcagccttcatcagtttaatcatcaggaaacgtggctcccgttgccctcctgccaccctacgtccctctccttcccggggtgactggcaatgtggacagccgggaactggagcccagcacttcaggaaccttaaaggtcctgggtgtaggggctggaaggtgggagacaccaccggttcctgtagatcctggattacttaaagtggccaggaaggaatgggtttggttcagaatgctgcgtgagcttgaacgagatgctcaacctctttggtcctcgatttgtctagagtctctgacctagtgatctcgtgacttgcaggccaccccctccttttcctcatgtgacctttgctgggcttcccttagtgaccctgtatgcacacagttccccaagtttctcttctgtccaggccaggcagttcctacaagcacaattaagtggaggcagcatgagggatgaagaacccaggacaattaatcatcaaggagtgacatttggtgcaaactcaggtgcttaattaagcgggatgagccagaggctggggggtagaggaggtgggttgtgtggtgggacagagagaaactcattcttcccataccaacctcccctgccttggttcccaccacccctctgccactgtcataccctgccactcacacctgccccctgttcaaagctcacacctccacaggtatttgggaaggttccagcatagtggttagacctagccctggtgccacctacctgggttcaaatcctggctctaccgcttattcactgtgtaaccctgggcaagtgaattagcctcttggtgccatagcttctccatctgaaaatgaagatatctaattcatagaattgctgggaattctgagttcatctatgtgagttgcttgggctgtgcacgggacataggaaatggccaataaactttagttatgatgattacctcctgtgcttagcactaaaagctgatcaacaattgttttctgaggatggtgacagggagggttcttctctctccaccctagttctccttgggaagatcagagaggtcaggtcatgtgcctaaggtcagattgtagcaggcagcctagctttgagcccctgcattcacttcctctgctctcccactgcctggaagatctgcactgggccccacccgagcctttaccagcaaggggcaccagaggccaaactgtggctgcctgtttctccacatagggtccagggtcccctacttttttacttgtgctgtcatcgtgtccaacctgaggcaggtcagcttgcccagatccttgcacatgtgcagggtccaaactgtcctgtgttcccaggccaggcctcgttcctccctgagtcgggggctctcaaggtggcatcatgtcctcttttcagggaggctatcatctcccagaagcggctgggctgcaatgggctgggcttctcagacctgccagggaagcccttggccaggctggtggctccactggctcctgatacccaaggtaagggctaggggctgggcaggggcaggggcaggggcagggagggactgtggcccctgcactccaggtcatgtgtgtcttctattcctcttcatctctgtctccttctttctcttgctctgtgtctctagcagtccctccatctaattctctctctattgtactactaaattctctgagcctcaacttcctgactataaaatgggacaatagtatttaccttgagggggtgtttcaaggaggtgcaagtgagatcatgcatgttaggggcctggcacaagcgagggctcagtggcccgtggctgtggttgtgatgtgcctgtgcctgatgctggatggggctgtagttgttctcacattctctctgtcactgtcattggccctatttctctttttcttctcctccatgcctcctgtccgccatgtccctctctgcctcgtgtctcagtctctctaggtctctgtcctctgtctcgatgtggaaagtgcacaagactgggagtcaggagacctgacttgctgtgtgatcttgggcaagtcacttcccctttctagacctcagtttcccaatctgtaaaatagaggtgctcagcctcacctgccttcctccctgcaaccctgggaggatcacaagaaggttgtgagtgaaggggtttccttccatgcagaggctgttgctgtggttgtttttgttgctgcctcaggacccgcctctgtgtttctgtgggttttggggtctctgtgtgtctctgtcctggcctctctttgtctgcatctttgtctcccccacctgggtcccggctcggtatctctgagcctcgccagccctgcaggagcacctcattgccctctccccctcagtgctggtcatgccgctagcggacaaggaggctggggccgtggcagctgtcatcttggtaagagcctgcctaggcggtgggatgtagggagaggagaccatgggagggagtggtggatggagcctgtccagggtgtgtgtgtgtgtgtgtgtgtgtgtgtgtgtgagagagagagagagagagagagagagatgggagccataagcgaggatggagtgaggggaaatgggggtgtgggggtgggaggagttggggcatctcccacaccccagccttctgccccacctcgaataggtaggatgaagccattggcccagtcagcagctttctgaggggtgtgcaagcccctgctggactctcagcccccataaggttagaaggcccagcctttggcgtacgcagcactaaccttggtttctctttgggatcctccagatggggtggggataatgtccaggagggcatgaaccaagtgaggtgtgaagagagatgctgcggagggacagatggacataagggcctgaccaatagagatagtgtggaaaactagccagagatttggagtggctggagctgggggccttgaggagagaaaggccatggtcaggccagccagacccagggctgaggctgggcggaagacaggcagctaggggggctttctggagtggctgaggaaggagtgttagtgggaagtggtggatgctctgccagagccccagaacccagacaagcctccctctgcagcccctcgaggagttcccagggtttctgctccgtggaggggattgtggaagtgcagagcctgtggggacgggattctgccgctctttccgtttcttctcctgtatggaggtgggggttcaaactcgttctatcctagtaaccaaaggatgagttccccaaattgctattattgggggtctgcttctgtcgagggggctgccattccagtaaagggcaggcttgggggcatggacagataaatgagcaggtgttggttccccggggactcctctccagctcattaaaatggaattaaacgcttcccaggcgcctgacctttctgagctgctggcaggagagggcagtgggagtcagggatggctgagaggggaggagaggggggaggggaggaggggtacttggctgggtctcctctgcacccatcttcctgactgagggagccaaggccgctgcttggtttctccgcaagctgctccccccacccccggtttctggaacggagctgctgttgcacggagttctcagggggtcgcctccccctattctttgctcttggtctgccccagggctggtcagctttgaggggcactgaggtgaggggctgtgtgcagaggtggggattgggaggtggtggctgggtcacgcacctccttctctgctgagggcaaagggcctggggtgccaggtgcctgagaaggacttccttagattgaggctatgaggactgggtcaggagggaagtaaggggaagacatttggaaggttgcttcccttgtgggcggaatgcttgccatggccgctgctcaccttggctcaggctgggccagaggccaatgtgtgtgtgtgtgtgtgtgtgtgtgtgtgtgtctcagggacgctggtgggatcagatcacttacacttaactcacccagtagaactctggtctggtcctgcggcaggctgggtgctggagccgactctgccttcagggagctctcagtctgggggaaggcagggacaccctccccaccacaggccagatgaaatactgttgccagcaggtgttctggtggcaaagcctggagcagcaagtggtacctcatcacagagaaagcatttgtgtggggccttggggcacaggtaggaggtccacaggcagggaagaagggaaaggggattctaggcagaggaggaatgtgagcaaggcaggaaggaggccgggggaaggggtggtgtgctgaggggagagtgtggtcctggggaagctgaagtaggggtgcatgctgttgagcaggatgctagccagctgggctctggctgccaggagttttcaacaaccgtcccttcacctcctcaaataccctgggcagggaagaactcttgaaaggtgtttagattattcacatctgcctctcctctaagcctgcaccttcccactcatgtgtaaatgcacttccctaggatgccccctccccaaggcatacatgtctgacagatgcaccctggctcacaggatctcactgcctcccagaggtagcacaggcagccccagacttcccagctgctgccagatcctgagggcagagggtgcagaaggaagatggagagccacagggtcggttgatcttttgggaaggccgagtcaccagctccttcctggacaagccccattcccctctctcagtctctgctcttagtattcatccactgatccacctacccatccaccccctcatccatcagttgaacaactatttcttgagtacccactgtatgtcaggcatggagtgctaggtgctgggaacacagaagtgaccaagacagattagacaggccctgccttcacagaccatatggtctggagggttggtggtgagaagcactaaagtgagcataaccccagctacttgggagtattccttgagctcaggagtttgaatctggcctggagaatagagtgcgactccatctctaaagacaataaaaataacaaaaatactgcaaaacaagtgagcaaaataaggataggatcacacgtgatggcaagtgctagcaaggaaacccctcgagggagtcctgcaaaggaatgctggggtccagtggcgacgccatcagcgagggctctctgaggaatatgctggccaggtgcagggctgtgtggctgacttctgggcctttacagctcactgctcaaagcaccttgattgcaaattttttgtgtggaaagtctttggctctgttccttaatcctgggataataagtccctttgaggagtggcagcccttggtctctggcatttgatgcctgatttgtgcccactcttcccccagctgcaccagccacaccagctccctgcacggggatggggtgttcatgccattaaccattttgaacttggttagggtggggacctgggggctgtgctgggttttaaccctctcttacagccacagtgcccaatgttgagtgttcccactgggtcccagacacttgccctgattagcaagagcaggtgtaagtgtgtgttcctgttggcgaacaaaaagccatgagtgtgtgggggtgattgtgtgtgtttgtgtatgggggcgccaggtgcatgtgcatggcttttgggtaagtgaactatttcctgtgtacaggcatgaatgtgcctgtggggatgctgtggacactgtaagggtgggtgtgtggatgtctttgtgtctgtgactgcaccgtgtgtgtgtgtgtgtgtgtaccacctccatgggagattgagtgtaagtgcatgtgtgtgagggcctgacgttcttcatgagagtgtaggtgtgtgtgtttgtgcacatgctgggtgcaagtaggccaaggcagcccgagaactggttgcccccacagccttagaggggtcccagccttctctattcttgagagatgggaccaggtggaaggaacaagaaccacgtcctcctccatgtgctaacagtaaaatgccaacatatttatataagccatatgcaaatgaaccatagccccagcttctcctccctcccgcccccgctgtcctgtaggagtcacagattgagcctcatccagagcttaagtttaaacaccatccttgacagcccaggtctcttccaggtcttcctgcctccaatctccctccctcaaattcaccctacaccccacagacagtggccctcagatgctaaagtctgccatggctccccagtactctcaggctaaagtctaacttcttagcctggcactcaaggcccttccttctgtggtaccatggaccacacccctacctggatcctcatctccccgcaccacctaccgccagtgtcctggtctcttcaaggtctacttgtcctccccatgccaattcaggaagccttccaaatgtcctcccctctgagctacccacctagttttctctctccttcctcaggtatgaggctccacacctcctcccagtcatgtctccccactcgtcccaccccagacagactgtgagcttcccgagaacctgctggtctcctcctccccatctgctcctggcaggagacccagagctgaggcaggcattggctgctgactggggagggaggaggaaggaggagcccccagtgcaggcgctgtggggagctctgcaggtggtgagcagctttgagtaagctccggaagctagtgacgcaggtggggagccttgctggcagggcctgtagtgggtccctaggctgccaccctccctccccaccgtctctcattttcctcgacaagcacccaagtaggagtgggggaagggacttcacagagtatgaaagatgggctgagttccctggtgactggcacagggagcttggagagggacaggatgatgggggtggtggagagagtggatctagaggggggaaggtgtgggcagagaacgggagggagtgggtggtgctgtcttcactctgccactttctgctatgtgattttgggcaagtcactccacttttctggccatggcttgcctgccaggtggaggcttgcatcacagtggtgagaatcacatgtaaggcaaagcacttcacgaacccatttatccatttattcattcacccgtccatcctcaccatggcaggtgcatcatactgagcccattcctttatccaagacttaggggcagctcaaaccctaactcagacaggatagagccgggaggctgaggctaataccaccaattctaaaatcaggacctgcagcgctccataatctgtgagctaaaaaggggtctaaggtccctccatcccctgaaccatacacccggactgtgctcttgatgagacagtgattgaaaaggcagagacaaaaaagtttcacgtccttaggttagtcctaggagacttcctacaggagggattttcctggagctgtctgagtggtcagaaagatggggttatcactgaggcccacagactggagtgtgtatgtgttggtggggaccagtgtgtgctgcgcatggggagggcactctggcagagacagacactgagagaggtcacagctagttcccttctcccatccctccaggtgcactgtggccagctgagtgataatgaggaatggagcctgcaggcggtggagaagcatgtgagtgggagtggggccatgtgcaatgaggctgaagacccttatcacagctggtgggaagatggcctggccagggagctggacagacctgggtttcagcttcggctttgctgcttttgagctgtgtgaccttgagcaagtcactaaacgtctctgggcctcagtttcacacctgaaaatggggataatgatagcaccgactgacctagggcagtggtgaaacaaaactggtcaaatatcttgtaaatacacacggttgccaacttacaattttcgactttttgatggatttatggggaagcaaccctatcctaagtccaggagcatctgtacttagaaagaaccctccacataatgatactgaggctctttcatgcctgagactttatgattttgtgactttaacaaggacttacgacttcctgagggggctggagacagaaatctgacatcttgtcttggaagaatctaggggctagggatggagatagaccctgtaccctcctgttcctggaccgccggacgctccaggggctgtgggagcccccgggggagccctcaggaaggtagagtccagggatgaggtgtttgggacggcggcggggtccctgggcccggcaggcagagggaacggcgggagcaaaggcaggaatcccgctgcagcaagcgcagcgagcttggggcgagcggcgcgctaaccgctcggcctgccccagaccctggtcgccctgcggagggtgcaggtcctgcagcagcgcgggcccagggaggctccccgagccgtccagaaccccccggaggggacggcggaagaccagaagggcggggcggcgtacaccgaccgcgaccgcaagatcctccaactgtgcggtgagggcccggcctggacaggtcacgagggcggggccgggcagaacttggaggggaggtgggcgggttaggcgatcccgggagccggcggcgggcccggcgcggagctgagcggcgcctgagggacccggacacggaggtgcggaggggccctctctctgaccggcgcctggcccttgcaggggaactctacgacctggatgcctcttccctgcagctcaaagtgctccaatacgtgagtccctgcgcccctgccggccacctccccgtcctgtctccctccggggaccaacttccccttgagccctccatctcagttccaattacgatgtccttccttcctctctcctccacccgcctgaagagccccggagaggggagcaggtggggagtggggtgacccggatccgcggtcaccccctcgccctgcctgtccctctctcagctgcagcaggagacccgggcatcccgctgctgcctcctgctggtgtcggaggacaatctccagctttcttgcaaggtgagggcccaggtccactgtagagcgggggcggggctgggcgaggaactcgggtctccgagggggaaatccattgcctttcctttaaccagccccctgcactccgttcctcaggtcatcggagacaaagtgctcggggaagaggtcagctttcccgtgagtcccgcgtctgtcttctcgttggagtctgcaggggcggttgaggccgggtagacactcctgggatctgcctggagtatttggatcttctagactcttggaatccgatggaattatctggatcttgggactacttagaaatgctgcagggatcacaacctgtgatcagcaggctctattaggaagaatctcttagcatctacagaaaggcttacctgggacctgttcacttctgttggagtatttctggatatggatctgctagaatctgttgacgagaatccttggagtctgcttatctctctcgtagttagggaagactctagagtcctttatagcgaattctgccagactcccctccatctctgctcatcaatgctgaccctgtccaccatttggactgactgaagggttctttgaaacttccagatttgagggtggggacaggttgagatcccctgacctggggagtactgggccctgactcagtctctcctcaccccctagttgacaggatgcctgggccaggtggtggaagacaagaagtccatccagctgaaggacctcacctccgtaagtcatggcctggctgacccagaggggaaagaggagaccccactgccagcccctagagccagggtctctgttacagagcagcctaggaatggggcagataagacctggggactttctactgtcccatctccatgacacagagcttccagccttgcatgagtcccttagaactgcctgttgcaaaatgtgatggagggctggaggagggaagcatactgcgccctgcttccctgccctgacttgcctcgcctttgcaggaggatgtacaacagctgcagagcatgttgggctgtgagctgcaggccatgctctgtgtccctgtcatcagccgggccactgaccaggtggtggccttggcctgcgccttcaacaagctagaaggagacttgtgagtctttgtgggatgatgcagatcaggagatgtcactgagaggctggctagggctccacgagggtaacaatgtgggatgggtactgggcaggggctactgtctcagcagcagtgggttgaacagtgtgttagtgcaagagaatgaaagtcatgttgaggtccaagctagttcctcttctcttctcctgcttcctgaagtttgggtaatctgctcttggggtattgggttccctcccttgccatccctgtttttgcattactgctataaactgctagatggaggggtgggtgtgctctgggttggatgaaccctctgggacccacaaagcatcatcaacacagtggacagtggctaaagggaatatgcttggggactgggaaaagctgtggatcttttgagcccctgacagggcagctataaaaatgatacacaaaaatctctttttttgtgggcagggcacagtggacaggaaagcaggcttggaggcttagttggaaaggatatctcgagaactgaggacaaacctggggtctagaaatggtgtcataaataaatttcatatcctacaccaactcataaacaggcagtaggtgcctgaattttattgcaaatggatcttagttcagggagaaacagtgctgcgtctgatgagccatttctgtcctgggtgcaggttcacacttgggctggcaggatgagcagtttgtgctgtgtcacataggtggggagaagtagacagatgaggggctgagtcctgatgcaaagagatgctgataggatgctggtctctggagtccaagcaaacaggctgggtttcagggcctggagctcctgcaggaggtggacactagagagcctgggactaggtaggtgtcagagcccgggcctgaggtctgctggggtagggtggagatccaggagtcctaggtctgagctgcagaacctaccagcatggaactgtgttgacagttgggtgggcctggagaaacaaagataggggcaaggcagaatcagctgaggcagggagaatgtgggattggtggcatttggaacttgtgggcatcctaatggtgggagaatttatgccattcagcaaacaaatattgagcacttaatgttgccatcccagtgctgaccagatggccttgggaaggcctttggggaagggaaggtagagtgaatgggggtccagcaggggccatgacttcttgctgctggctgtgagattgggttctaggatggccccagagctggagaagaggtggtatcagcaggaaataaggatggggccttggtggcagctttgaggcccagggcaggggcagggctatctctgtgtcccacgcatttcagggagtgagtgttgaatgactgcatgagccagggtggggctcagctcagtgcagtgactacagagaagcttcctgaaacacagctaagtagccagagaacaggggctccagaagcccttcagctgtgagtgggatggggctggtggcaaggccagggataggatacactgacgacattagcaaagacctccgaagtgtttcctctgtaccaggctctgcactgggcatgggtgatatagtcatggccccatttcataagactcgaagctcattttcagggcatagagggaagagagtgagaagggtattctaggccgagggaacagtgtagaaaaaaaagcatgaaggtgtgaaagagcccaaggttttctcagaatgatgaggatctttgtgtggctgaagctgagagatgttctgggttgaggggtgacaggtgggtggggctagctgagggaccacaaatgtaagaaaggtgtgcagacagacccaggatggtggggatgggatctagatccgaatcactggatggcaagcatgaatgggggatgccccaccagggtggagcaccaaggccagccaaaaagtggggaagggcttaggcagggacacctcagggcagcgtgatgtgggctaaggcaggctcttcccatgacccacaccattggtccacccagccccatgcagctccccagtgacaaatcatttggtggccagattgaatgacgtgagcaggatttggggcttatcttgtctcaccagagctagctccatgagcagggcaagcagtcctctccacaccaccaccctaagatttctggaggcaccgaatcagggccagcggagtccagggagagtggggtagtgacaggagctgcacaagatagggcagtgccaccgcccctccccaaggctggaggtgtgcctggggaagagcagaacaccagcttgagcccaggcaatctctagtctgagggaggagacccagctttgggctgggtaaatcccaaatcagagacgggaggtatggctctggtttcaagcatctaaggaggactggagccctccccttgggcagcccccagtctgcagggtcatgggggtgggaagctgttccaagggcctgtgcagtggttatatagttggcaggtgggtacccctgtgggcttctgatggaacagaagtaaggagagtggggagagaagccagtcttcccttccctcctgagtgagcccaccccctcctccaggttcaccgacgaggacgagcatgtgatccagcactgcttccactacaccagcaccgtgctcaccagcaccctggccttccagaaggaacagaaactcaagtgtgagtgccaggtgagtgacctgccttcagcctctctcgggcaccgactcgctcagttttcagccccgagagccattcagaagggaaatgcccatgtctttctggactggtggcagcccttccccaggtggctccataacctcataacttgaaggcttgcagttgttcaggacccgcgccactgcccgcaggcactgtatgtgatcgccctctagtgttcaatttgggcactacagcaacacctaggcagctagagctggcgtgaaggcggctgagacactcaggagactcctcacctgcaccggggctattccctcactccttcacttagtagccaaatgatataattagacactgacagtttctggcttgtccagtgagccctagggaaggaaggagaagacccgggtgctgttggaggcaggaggttggatagggtgacccctacaccccgacccccctatgatctccatttccttcattccaggctcttctccaagtggcaaagaacctcttcacccacctgggtgagtgcactgttctctctgcctggctgtgtgtgggcatgggggctggcatttgcagaggagaggcgggaggtcttggcagcctggtctcaccctgcctggtcttctcccttccccagatgacgtctctgtcctgctccaggagatcatcacggaggccagaaacctcagcaacgcagagatgtgagtgactctacccaggggacagggcgagagaggctgtggccttcagtccccatcatctcctttcctgccccacccacttccctttctctgccttctgcgggacttcatcaccttttgagggatcctttatttcatgcctgtctccctcgctagactgtaggctccaatacagcagggacagggctggctttggatcctcagctcctatcacagtgcctggcacatagtaggtgcttccaaaaaaaaaaaaaaacaaaacacttgaatggacacgtttctggagccagccagccctgagcagagtgtcttaccttggagcactcctcccaggcctcggaaatccggcctttgcctccttatgggacgtgagggcgatcagagggggttgtcaggccccagaggaccaaacccctccctccacagctgctctgtgttcctgctggatcagaatgagctggtggccaaggtgttcgacgggggcgtggtggatgatgaggtgagagggtgtggagggagtatgtggccctaggggtgtccgggagtccgccggcggcgctggggagcggcccgaggtttaacagtcccctctgtggccgggtcactaacttcttcctctcgactccatctctgctccggcagagctatgagatccgcatcccggccgatcagggcatcgcgggacacgtggcgaccacgggccagatcctgaacatccctgacgcatatgcccatccgcttttctaccgcggcgtggacgacagcaccggcttccgcacgcgcaacatcctctgcttccccatcaagaacgagaaccagggtgcgcgtggcggcccgggcggaggggcggggcctgcgccgggcggggcgggtccgagcgagcgggggtggcaacacttccccaccgcctccagcgtcccggagcataagggagtcgggttccatgcctgggacgtacgtaacctgcggaaactgcgagggcaggtcccggccggatccctccctccaaccgatccctccctccaccggtggttccttgcccctctcccttccccagaggtcatcggtgtggccgagctggtgaacaagatcaatgggccatggttcagcaagttcgacgaggacctggcgacggccttctccatctactgcggcatcagcatcgcccatgtgagggcggggttgggagtggggtgtggggtgatagggggcggggcccacgaaggaccctcggttctcctcctccgactgactctccttgtggattgatcccttggtctggcactcagagtcccgccgctggggtgcagccttcaggacacgctggccacctctgggctcagtttcccatctaaaaattgggcatacgatttcctgccctgtccactcagcctcctgggaccatgagaaactcccgttgtcaaaacctcctctcttccctggaagcagtctcaacccaagccgagtgcttttttggaagtgctgggtctcggtgtccaggcctactggcgctctggcctgggaatccagccccaaggtccctgacatgatcccctccttgcttctccttccctgccatgggccttgggctccatcactgaagcctggatcaggtgtgggggagtgcaaagggccagaccaaatgctgggagaacttgatgaggaggaaccggcgcggggtctggatgaaagtgggggtggggtctttactgtggactggagcttgaaggttttgactggggccagaatgggacaggaagtggggtgtctttttgaccccttcatcccagtcctgggcattgctaaattttcacagccaccttccttgagccccatctttccctctttcccctagtctctcctatacaaaaaagtgaatgaggctcagtatcgcagccacctggccaatgagatgatgatgtaccacatgaaggtgaggcttgcagagacctctggtcctcctcccagattccccggggacccagggccaggcagggcttcctgatcaatctctactgaggatgagaggataggcccagagccacagcaggcctcctgccctccttaggggcagctcccacccctgcttagagacctctcctccaagctgcttctgagctcagtcccaaggctggaagtagccagaggaaccagcccagggagtaattggttcagccaggtattccccatgttcagggaataattcccatcttgggaattactgagggctaggaagctcacccaggacccgtccccatggcttccctaggtacaatgcccatgcagccctgggcagtcttaattgctgataatctatcccattccctaccctgggtcacaaaagctggcttagttccatgtatatggtagtcgctgttcatttggacatttcctctcacctgtgtccaaaccagagaggcccagaccttgtgagttggatcaaaactgtagtaggaagagttaaggttagagagtagaaaggtctccacaaaaggaggactgctacagttactgtgtatgaaatgctgccatggttagggggtgtcatgaaggggtgttgtcgatctttgccaaggttatgctgttacagataaagggtggtcacctgcagggaggcgcgcggggtgggctgcagggctgtgaggggagggtggtgatttcctgcccagttacagtccacagcgtggtggcccaactgtggtacattctgggtgacggatcccccacctgccatgggaatttgagggtgaagacaccagatggggtgaaggctgtcttctaatgctctggctggtctcctctaggtctccgatgatgagtataccaaacttctccatgatgggatccagcctgtggctgccattgactccaattttgcaagtttcacctatacccctcgttccctgcccgaggatgacacgtccatggtgagttgctctcctccacttgactggccaggccgaaggtatgtagccagaggcttaagttaaatgcgcatcaagaacttcctgggaagacagagtcatcaaggaaggctgtggagggtccctcagagatggaggggcttgtagtctgccatcaggaagccatagggcctgcccaggggctagaggctggactggatgatcccaagggctgctcttggaccaaccatgcccagggcatgtgacctcagggtttgcatccctcccaaccctgtttttctaacattttgtgtgggcttggtttcaagagttcttagttcttagatctctaaaaatgcatagctccgagaacggttgcttcaactattttgtggttctctagtttagatgtaagtttctaagactccagattttgagtgtggagcttgaagaaggacccaggcaagggccccgtcttgatactggcagcccctctgatacctccctctgccctctccaggccatcctgagcatgctgcaggacatgaatttcatcaacaactacaaaattgactgcccgaccctggcccggttcgtgcgcccacagacagccccagtcttcgcctccctctttcctctactgtcacatccgttgcccccggcattctggagaggatctctctaaggatgactggggagacccagtcttatgggggtggggaggatccatgaatgagaagcaattcctagacactgaactgtcaataaaggcaagaaatgaggcaaggcaaagcctggaggcaaggccgagagtgtgtagccagaggtttaagttagatgtgcataggaacttcctgctaagacagagtcatcaaggaaggctgtggagggtccctcagggatggaggggacatgtagtttgccatcatggggccgtgatggaggaggagaggctgaggcccctcttctgccctcttccctcccccaggttctgtttgatggtgaagaagggctaccgggatcccccctaccacaactggatgcacgccttttctgtctcccacttctgctacctgctctacaagaacctggagctcaccaactacctcgagtgagtggctgcatctcccccacatctggcagccactggggtcccctccctgggacagggaagcaccccctgtgtgtcaggcactttacacgcactgcctcatgggatcttcttagccccaggggactagaggggaaggctgtgagccccatcttccaggaggggcttgctcacagccaagcagctagtgaagactgagcctgatttaaacccgggtctgctgggctccaaaccagtgcttctttccaggaagggaacccaggtgttccaacctcctgtcccagtggctcctgggcatgtcatctcctgtctgtcctcttggggatttagggagggaactgtgggctgacctcttttttttctcctttctgcctctcaaccagggacatcgagatctttgccttgtttatttcctgcatgtgtcatgacctggaccacagaggcacaaacaactctttccaggtggcctcggtaagaccctgccctgctcacagtggggaccctccatggggtgtctgggagtctcatcctctcccagcctgaagatgggtgggagcgagtgagaccaggagccaggtttagacacaggaggaggttcccccagggtttgcccctggctctgagatagggaggaggggagaaaggtggaagggcaggacactgctcagcctaaagcagtggcacttggatccggatgtgaggagtgaccacagttttcctgggcttttccagaaatctgtgctggctgcgctctacagctctgagggctccgtcatggaggtatcactcttctgtcccaccccgtccttcttcccctttaaggccagtgacttgcaaagttatgacccagctcctcctattcccaaaccatgctctccagacaggctgcgagagctgcagccacacctaggacatgtctggctcattttcctggagtgggcttggaagggtgcaggtgcggatgatagcaaggatttgtgttcagcgtgtttccctttggctgcctgggaacaccccattcagccccctcctgccaaacttgggatgggctccactcccatcacttagcgtcaccttagattgtttggtttgggtctgcctacctcctcgtgcacaaggtctgagccatttctgagttccctgcacttggcacagggcttggcacagagtaggagacacatttccaaggtcaccttgcctcatgctacttcccacaacacccctccagaggctgcccctgcttgcacacccccagagacgaggttctctgtctctctcccaggaggcctggtggcagtgctggttctgccctctgcccccctgagataagctgctccttttctgagtgacagcccttcagcatccggaaatgggggccttgcccttgcctcatcactgcctctccttgtcagcaaacaaatgtgttctgcatgatttggtgtctaggactccaaaggatcatttcaaaaatgttccagctttcagggaccccagagcttaccttgttgggtccctgcatgtgacagctgaggagtctgaggctcagagtggtctagggactcaccctgggtcacacagagggttgaaacagagctcagaaagggaactggggcccctgactccccctttctgactgctctgctgacctgggggctggagctggacgaggcccctgcttcctctcttggggtcaatggtaagggagcccatctgccccagctgggcccccatcactcctctccccccagaggcaccactttgctcaggccatcgccatcctcaacacccacggctgcaacatctttgatcatttctcccggaaggtgatggggttgggggtggggtggggattgagggggagctgggagctggctggaggtgggataaggagccaaggagtggaggctcactgggatgggcaaatgggtgggggtgtccagtaggagggcatgacacccctgccctcgcctcaggactatcagcgcatgctggatctgatgcgggacatcatcttggccacagacctggcccaccatctccgcatcttcaaggacctccagaagatggctgagggtgactgctgttagccccagtccttggggctggggaggaacaaccaggggaaggatttgccaggggagcattcccagggtgcagacccatcccctgcaacatcaacccttctctggctgcacggccccccccaggcagacccagcactggccccttggctcccatcaagggtgcccaattccctggaccgctctgggttgggccctgggagccttgtcctcagaagggcaaagaggctgggccccgctccttgaccccatcctcccctcaacagtgggctacgaccgaaacaacaagcagcaccacagacttctcctctgcctcctcatgacctcctgtgacctctctgaccagaccaagggctggaagactacgagaaagatcgcggtaggtgtagtcctccctgggaaggcacaggctgcccaccctgcccagctttgggtgccccctgtgcctgaataccctctctctgctcagctcagcctggctgtgttctggggagacagaaacctagaccatctcagggtgacaaatggagactcagagaggggaacagacctagcaagtcagtggctggtggaaggtgggccccaacccagccactccctgcctcaggccatcccactgccaagctggggctggtggggacggctcctgagctgggactgaatccctgggcctcagttttctctcctgggaacgggctgtcagaggagcttgggtggatgtatcctacatagaggatgtgatgagagtgttggcctttcaggagctgatctacaaagaattcttctcccagggagacctggtatgtgtggagtgaccccaggatgtccaggatgggggagggttcctggcctgggacagggagggcttgaactagcctgaccctggtacccgatggaggaatgagagggacaggcctgacgactcgatgcctgcaggagaaggccatgggcaacaggccgatggagatgatggaccgggagaaggcctatatccctgagctgcaaatcagcttcatggagcacattgcaatgcccatctacaagtgagtgagctcatggggacaagctgcaccctgcacagagagggtaggctggagtggggacatcacaggaaacacaggtgctgagattggcctggcccaggtccaactgattcatccccttgcctctgggcataactgtctcccgctgtgcccctcagtgggtccttcacttcatccttggtcctcagtggaaagagaccatcatgctttcctaggtgtcctcctctgtctcacattcttgtggaagttcttgttttttttgagatggagtctcactctgttgcccaggctggagtgcaatggcacgatcttggctcactgcaacctccccctcctgggttcaagcgattctcctgcctcagcctcccaagtagctgggattacaggcatgcaccaccacgcccagctaattttgtatttttagtagagatggggcttcaccattttggtcaggctggtcttgaactcctgacttcaggtgatccacacacctcggcatctctgagtgttgggattacaggcgtgagctaccgtacctggcccttgtggaagttctatttgttgtgtagccctagtctttcttgctgcccatggtctgatttctggcctctcgccctctgccccccatgcacccgcaggctgttgcaggacctgttccccaaagcggcagagctgtacgagcgcgtggcctccaaccgtgagcactggaccaaggtgtcccacaagttcaccatccgcggcctcccaagtaacaactcgctggacttcctggatgaggagtacgaggtgcctgatctggatggcactagggcccccatcaatggctgctgcagccttgatgctgagtgatcccctccagggacacttccctgcccaggccacctcccacagccctccactggtctggccagatgcactgggaacagagccacgggtcctgggtcctagaccaggacttcctgtgtgaccctggacaagtactaccttcctgggcctcagctttctcgtctgtataatggaagcaagacttccaacctcacggagactttgtaatttgttttctgagagcacaggggtgaccaatgagcagtgggccctactctgcacctctgaccacaccttggcaagtctttcccaagccattctttgtctgagcagcttgatggtttctccttgccccatttctgccccaccagatctttgctcctttccctttgaggactcccaccctttggggtctccaggatcctcatggaaggggaaggtgagacatctgagtgagcagagtgtggcatcttggaaacagtccttagttctgtgggaggactagaaacagccgcggggcgaaggccccctgaggaccactactatactgatggtgggattgggacctgggggatacaggggccccaggaagaagctgccagaggggcagctcagtgctctgcagagaggggccctggggagaagcaggatgggattgatgggcaggagggatccccgcactgggagacaggcccaggtatgaatgagccagccatgcttcctcctgcctgtgtgacgctgggcgagtctcttcccctgtctgggccaaacagggagcgggtaagacaatccatgctctaagatccattttagatcaatgtctaaaatagctctatcgctctgcggagtcccagcagaggctatggaatgtttctgcaaccctaaggcacagagagcccaaccctgagtgtctcagaggccccctgagtgttccccttggcctgagccccttacccattcctgcagccagtgagagacctggcctcagccctggcagggctctctcttcaaggccatatccacctgtgccctggggcttgggagaccccatagggccgggactcttgggtcagcccggccactggcttctctctttttctctgtttcattctgtgtgcgttgtggggtgggggagggggtccacctgccttacctttctgagttgcctttagagagatgcgtttttctaggactctgtgcaactgtcgtatatggtcccgtgggctgaccgctttgtacatgagaataaatctatttctttctacc

SEQ ID NO: 36547 - DNA, 281370 bp, Homo sapiens
acacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgtcttcagagcatgaaggacactgcccggagagggaagagggcaatatttagtgtttgggcctacttgttgttgggctccccactgcctctcctttgcagagctatcactggcccctggttgcaaactctcggtggctttcaagcctacaaaacaaaaactgagagggtgtccaaaaagagaagaagaaaacgttgttgttggtcctggattccactgttggattttggtggggatgagaagaaggaattaccaggtgtgatcaacacctgcacggtacctgcacggtaagctaagtgtccccatccttgctgagaagaggctttgggatgtttctgtgttattcaccagctaggagcggccaacaccactctccaaaagtaggatcttgtgaatattatgcaagggaacgtagtatgattaagagcttatgacagatgatgacttttaggctaaaatgactaagagttgcttgcaaaatagaggaactatcctgacagtaggtaagttttactatagtgatacacatgaaagaaaaccaaaatgaaactttaaattgttatcctgttaagagtaagatggatagtcaaaaattaaagaaaaagtatgtttggataaatggctttccttcttaatagcttgattttgtaagctgatgtgaatgatcaatatacagtgtcaaaatcatcacaatgtgttgaaaatggagaattatactgaataggttaaattgcagaggaggaattctcttttcatggaaagattaatggaagaaactaacattttcaaatggcaactatattgtatcttttttcttttgtttgtttaccttctgttgatgttaagatttaatgaatgagagccagagaacagaagcaggtttctgagataaggtttttggcaggtcttgggagatacctatcaagaacttgttctgtaacaccccacagaagatgactggatatccatgggcacatcacatctggatataaatgggaaatgatgctaggctgctgccaaatgatatcacagaaaattctgctcactgtactcctcaatgggaggattattcaatgtttagggtggctgcacagttttgtatataggcgctccactgaagagagatatgtgttcagttaaaatggttgtgacatattcagttattcttttttctttccataccaattaatgattacatatctttctttattcattatctgttcacatctcaggaaggaatagaagaggtgcaacacatacactgtttaactacactaccatattccacgtgtgtattagatatgcataaaggagaacatggtgtagttaatactagagagaatgcattgcaattacagcaatgttcctttagctacagttaaacttgtttttcctgtgatgacattttctgatttatcaatctgctatctcccaaagccaaatattccaagtaaacatttctctacatttatcagttgacactattatgaaactctcattatgcttaattaaaaatcagcataaatactgtaagagctgtttgttaataaaaacttctaaaggcagcaataatattcatgggctctttccacctgggtaattaaggtctactactctgatgagaattttctcagtaatttcccaaagcaatgtggggtttggattcttatactaaccaatacaaagatactctgtaaaagttctgcagcaaagaaaagcattcattatttaaagagtgacaatttatttttagagtttaccttctattaaagttcatgtgtaattgtcttttttgcttaagctttatttaagcaataaattagcaataaatttaagtaataaatttagtcaagacttggtcttaggtagtggcgctggcactggaaatgaagatattttattgtgccattgaaatgatggtgcctttaatagagtgctattgtaggagactgccattgcaacttgccgagagtcaggcaggtccaaggatgcaaaaaacctaaatgtaatgggctctatcttcttttcttctgattacagtccatattattctatgttctaacctaaagcaaaattttcattaccaatgtaatacccgcttcacctttctaatatgttacattaaaaaacatttaaagaaaaagtgctagtagcttttattttccttagagtagaactagtgcctaccagcaatacacagtaagtttgtttagttatattaggggaacacttttatagtaatagcttagtttgtttgctcatttgttcattcattcatcaactattttagaatgcctactctgtgccaggccccgtgctggttattgggattataacagtgaatgaggcaaacatggtctccagatgccctgagtgtaggaatctgcacagagagtctgattactagtgatttgaatctgtgtattgtgcatgttgttcaacatagatatggagacaattttagataccatctcagcatcaaataattgaattagaaaacacattttagtgcaaatacttgagccttctttgagggatgttgacattttggtgcaagctatagatgttagacaaaaactttacatactaataccatctggttcttcagaattgggtcagacaggaagtctaagacagaagaaaatttgtattatagcctcttagaagtctagggttcaaatctgacagtagttcaagattttctgtttaatctgatggtcaatcactggagcctacactgaaagagcagccctactgtgcttctcatcttggttgaggagacttttcataatggcattaacaatgtcatttatacctacaaggtgttttatattgtgtataaaactcgcatatcaattacgcacttgaccctatgtagtaggaaaggcaggtattaccattccctgttcagcagatagataaactaagttttagatatttaagggactagcccagctaatgttttctctaacgcacagcctcatggagtaatctcttaaataaagttctagaaaaattctgcattttcaacatgagtactcatagccctgacctattgtttgaaagtggtattagcaaacaggaaaacatgcaggtagaggaaagtttcactcctccccctaccatcctctttctgcctccattgcccttctaggtccttaccctagagttcttccttctggcccttgaaaattcagtttagttgctaaaagagatataagctactgcctttttcttcttctttttgggtggaatgatgaagtagaatatggcgaactgggctgtaaagctctgaattgactcctattattgtaatgaaataaaaaattattctgagtaataagattttaaaaagtttgtgactgtttaggacaggaacagtatagtatattagtatatccacctacatgcaaaatacaaatggaattttacactgctggttagtaccaccagcctagcaacataaaacattgtcacatcagatcagacaattttctacccagtccagatcctgcttctggtgcaagcataagtaggctgttgtgaagaagcagtttatcatgggtaagaggaaaaattcacaagaaaaaatactctatatggaaaaatggtaagcacaggtaatggagagctatacagagctgagcagagcagtgaatggagaaggtttttctgatggattttgagagttaagccacatagctagtattgtctattattagctatgaccaagcaaatacacgactttatttctttttttacgttcttcctggaatttcctgtacatgtatttaaagtttgttgtaattccttggaggcttttagctacttttttctctatttgtggcttgaaatggatgacaggtatcttcatgatggatccagggacaatcacttgactaggaaattggaatgcaggggaggatagcaaacgggataaagctgcttctgtgcttctccttagagttgctgctcctgaccctgaaacaaaaaaatacagaggcagctgcttctgagccatgatattaaactgacaggttgtgactagggacaccagctccttgtttcagctgcccctaacatctctaaatgaagctattttaagaacctttgcatttgatcagggagcatgtggggttaaccttatgttttcccctccagttttagattctaagcaggtgcagttagtagttcaaatttttaaaacttattattgcatttccttccaatcaatgtaaaaatattatattcccaaagctaccaggggtgtattagtgacttgatttatcttcgggctggttctatttcagatgacatctcctaatctttcttcttcgaacaagaaaaaaaatggttgccaacagtttgaagggtgggtatgggtacagaagttactaaggattctttggctggggggtggtgctggggggggggggtcataaaagaaacatttgcagatgcagattgcagtgcctatctcttccttcaatgattcctgagtttgatgctttttaatctactttagcagctaacttatatatcattaaccttagaatgttaggtaacaatatttacagtggcttcattcataattgccaaaacctggaaacaaccccttcaattggtaaatgaataatcaaactatagtatatcaatactatgaattactcagcaataccaatgaaacacacaacaatatgcatgaacctcaattgcattatgccaattgaaagaatccagactgaaaaagctgcatcctgaatgagttcatttatacaacattgtgggaaaaaacccccaaaaactatagggacagaaaacacatcagtggttgccaacagctgacgctgaggggaggaactgactacaaaagggtgagcaggaacatctcgggtgatggaactgctttatgtcttgactataatggtggttacatgattgcatgagcttgtcaaaattttcagaattgtacgttatataagaggtaattttactatatgtaaagcataccttattgtgtggctctatattgagagaatcccacttcaaacttcaaccagcgtatcctgctttggtgttgtatggaattcttgcagattttcattgaaaaatttttttttaggatattaaaacacacaaaagaaaaagaacccttaaaaaatgattaatagagtccaaccaccttgatttacagcggaagaattgaggcctgagaaagttagtggcagagaaatatgcttttttttttttttaagagacagttaaaaacgatcatcctgtagaacccagaaaactcaactctgttcttgtataataccgactgtcaaactgcattgaaaaagccatgggaccaaaaactacgcaataaactctaagtacctgccttccaaatgccatgttgcgaaactggccagaagctgctggcttctgacagatacacagttacaagggaatatgatctgattttagtattcagatagacatagcaagcctactgtttgtcaaaaacaacagccaccacaaccacacgctgtgctgagcatgaggtgtaccacaaaagaagacccaagccatgtttggaaggggcatacatttgttcatttgcttacttagttatctaacaaacaaacgagtgccagacactgtcttgggtcctgtaatccaatgttgatctcggaattgtaacacagtagcatctagatacagggcaatgcccaaccactagaatacagtgaggactgtttgaattgaatacatgaatatcaaacaaaatcagagtcaaaaccagaatgtaccacaatgcatttaatgtctaagggcatagattttcccagatggcatcactggcttctaattccatttcagtgtgttcctcaacaagttaccctctaaagcctcatgtttcctcagccataaaatgcagataagaattgtacctgccttggtaagtaataagcacagttagtgacacataagtgctcaataatgagaggctgttattatcattatcattaatatagaaaactcccactatggtgctataccttggatctataaaaaataatcagtcttgacaacgtggtcagttccttctgaaaggctgaaaaatgctacaagacctagttagattgcacacagacacaaaactttggattccctggaccgaattaagaagccatgggctagaaatgtcatctataaataaaaggaactagcatttgaatcatgtattttctttgggaccctaagttaagaaccagtgctctagagtacacatccacggacaggtatgaatttaaaatgcctcatttcatggttttggcattaagaaaaatcccagaaaattgattattaaatgtaaaccagaaattttcttgaccgatgttagaaaggtagaaacatccttttcccttccctgagattctctggccctaagcaagtaacttttttttttttttttttaattctcttgctctcttctaccataaaatataaatcatgtaatgaagattccataatcaaaaaagtgttagtttatggcctcacagtccagaggattctgaggagacaatgaaatttctaaaagtgcaaaattattccataatgggaaatgactcttcctgtctagcagtaattatttatgtaatactaccttgggagaatgttaacagtagagcgttaaattactccttttaaaacaaggaatttccaacagggttttatttgttctttcctaatttaaaaagacagcatttatactcacaagactgcaagttttactagcctatcgtttagtggttaggttagtttcagaaagactgtactgaagcattaaatacctgccaaatgtgcggaaggaaagctccaattcaaatcatgacacacccgtggattcatcactctcaaagtaaacaaagtgttcagaaattctaccaacaaagtgtcagaagaggctataatgcttactgaagggagaaaaactttagtttacttaaaacccacatgcactttgtcattttcccagatggcatcataaaactgcaatcatgacctaaataacctagttttttcagcatagaattctattattatattcccatctacatctggacagttcatctttaaaaggcaatttcagttgaaaagagaactcaaaaggtccagctaggtctagtggaattaatctgtatataaaacaaggatttttttttaactgtatggaagaatataaagattttcacctgtacctgcagcactaagcattttgaactggtagctacaaatttatatctcttggctgtgtaacaaaatccataagtatttattctttgagagttaggtcagacacacattggtggcaaaatgccagtcaccactgtaatggggctcccttcatctactgaccagaaaatatttttctcagagtttcccttagcatacttctgttatcttattaactttctgcatatttttaaaaagcaacaatataacctctggcatcttaaattttccagacatatgaaaacatactacagggatcagggcattaggttaggagtagtacaaccaccagttagacacaatttgagtgaatcagatggggtataactcatctaaagcattcaaaaggaagcttacatttacagcaggaaggtgagcaacatgctttaggccaggtgagcatgcatatgcttctggatcctacagcccttaccagggaaacacagttagagaaaatgatacccacacatgaaggcagatctttttcaactaagaaatcattctccagctctcaacctttctttgggtaaagagtcaaagtggggtttctgggtgcagttttcagatgggtggctccagatcatctgccaccattaccctcatttctgctggagtccttcttgtccctggggccatatcttgcataatcctgagattaataaatctggctagatgggagggtccttggaacagatccagattaggttacatgtagaatcagtcatgcctaggctggcctggaagaggactgagctttcagtctgacattatcatctgcaagtgtaaatccctggagagtattccacagctggaagcttgcacctctgctcataatggtatcctggctgtactgacttgttgctgcatccttttgataagtcaacctcttctgatttactatgtggtatctgtatctgattgttccatcaatcctagtctaccattgacagtaatatcatattttctccatatgctatacacagcacatatggatattttatttaattgaaacccctaggaggtataatctgtctgtcttgacttctagactcccaggcacaactttctgtccacaccatctgatggtgagaagctatgtgaattgaatgacttccaagatgatgtttctaagtttgaagtgagaaaagaaagctcattgattaaaaaaaagtttttgtttgataaacagagaacttacaactcctttcaaaaaactacttgcatcccaggaggttaaaagcctgagtatgaggtatgctatttggagaaggaagagtgacaacagtaagaagcatgggcttctaaaaaggaaactgatcttctgaaatgtctcctgggattgcatcagcttgacctagcagttgtttttcatttctactttccagaccacctttgtgtaagaattaatgaccttccctcagcctattaactcagaatgtcattaatctctaggaaataccttatcaattctgcttaaagggtatatgagaagtgctatgttttcggttaatcttatagccctttaaccaccctgttcaatgattactgaaccttcctggaagtcccttttgccccagaattagttaacattttaatagcagtcttacttgtaagctatgaaattgttagatacgaattgcagttgattcaaaagaaatgccttccagggagccaaactgagttgtgagaaatatgtgtctaaaaagatattactagtccaaattcctattgctcatgtctttcctgagtacttaacaaactaaatattgccactcccaaatcagtattaatggtcagcttcaattatatgttatttcaactttaagctctggtaggagaatacattatctactaaatcagccttgtcaacaggccagaaaaatctttacaggcataaatgtttgtatgctgttagaggaaagtatatgagacttaaacaatgcttacttgtgaacaccctttccaagactaggctaagagaacaatagctacacctaagtatagtaaaagaaacaatctgtaaatgaagattcttatatacataaatcatgtcatgagcagaaagttaaataaaggcagatacttttacagaaagattagagttaatgcataggtgaggttttggctgttacagacagaagaaactatagaggtagaaaaacatggaagtgaagaaacaaggatggcaatagctagatattgagctagctaagctgtaaatggtgattctcagccagttttgggggtaagggaaaataacaggggtgactcttttcatccctgttttttctgagtttctcttgatgaaagtttttcttgatgaaagctaacaagctgagaacatcagtgcaaatcaccaaagcaatcgggtcaaattcactgctactactcctgcaaaacaggaaaaggccctcaagcttaacttttagattcctgggcatgcaaagcaggccttggtcagccagatctgtactcggttcttctctgccttggtcactgtcctctgggtcttgggaacacaggcctatgttccaagccattgttctttaaacaaagttgtgaactgctaacagttttatttaaaagtttataaaatggtaaccacattgctacatctttctggagtatctcaaacaaagtgtgggtcacatttcttgtgtaaaaaaaagtgtagctcagagttattgaataaacaaagacaactgatgtagttaacgggctttgtgtgaccacagctatgtcatcttggtcttgattccagtttcaggcagaggtcagggtgagccatcccacaaaggggcctcctaccagtcagtccatctagatgctttgcctgagcaagcttctttgcagtccctaccctgtaacttggcatgactggcaatgggggtgggggtgagagagggccactctcattgtaacctgtgctctccaatccaaacacacacagagagcagttggcttcatttcagagaaatgaaaagtcacctctcctcagtggatggctagaagccccaatttggtgacatggcctctgggcctttaagcaaataaggtaagaggacgcttctactaactgaaaacctctgagttaatgcgcctgattaaacaagctgtcaggaaccttggcagacccgtgctcatgattcttattaataaggttgatatttacataaatatcagctgttcattgataatgctgccaacacacagggcatagactcttttctttaggataacacagacagatttatcttaatgcaacaatttgttatttgaacaaacatgtttattgcaaggccagtgaagtgaaacccaaaggttttcttgtttgaatttcccagggggcagtttgtaatagctgctggaagagaccattccatggcttctaatacagtgcaatgctggcaaccaatattctctcctccatctcaactttggctcttaactgcccacacctcctttttgctcaacatgaagaatggttgttgttacctgcccaatccgtgcttccaacttgcctagaaaaaacctgattcaagttttgaggaataaactcctaaagactctagatcttcagttacacaaaggagctcacacctagagtggattttgcaaatattaaaacagttatcccaacactagtttgctttcatgccagtacttgtgtggcagcccccagtggggccataataaccttcagaatggagcagctttgcccaacctcctgctgtgctcaagacttcgggttctgcatgtgtgtttctggctgactcttgctgtctcatagctcttgctgccactgtgagctgctgccttctccatggtctgagtgggcttctttcaaaaagctgcttggtctgcttatgtggggagacttcaaatcaccagtttcctattaaagactcctggcctacaatcacagggtgaacaggaatatacaaaagtcagggaaggtatttcacaaagactagatctgtgtacccacagtcggtctgcttcatttttacagcacttagtctcccaagcctcaacctcacacttttttcctccactggcacctgtagtgccataagcagagggcattacattgctttttcctttcaactgctcttgccaatctgctatgctctggcagaacttagtggtagatggaaaggttatttttgatgacagggcttagcaacattccctaaacagaaaacctctctcctatacacttatagcactgcaaaatacttttaatataatttagtcactgatctcagaaaaaggagaaagttggctttgcaaattattgtctttcatagccaagtaaatgaacaaacccagaggaagcacagtgtccctggggtcatgaatttagtcaaacacggagtaactactgaatgcaaagcatggcggaggacacagaatgcagcttggcattgtccttgccttcaaagaattaatagtttagtaatggaagtaggaaaaacacaaaaaatataaaacaatatggaatataaaaagtgttacaagagacgtacagataaaatactggagtaatttgaagaaaagagagatctcacacctgtggagaagcagaaatcacgctgatgaggatccaatttcttctgtgcacatcttaggctactttcacttctctttccttattatcccatttccaaggatatttagttatcctcttaacacccgagaaatgcaaatcaaaaccacaatgagataccatctcataccagttagaatggcgatcattaaaaagtcaggaaacaacaggtgctggagaggatgtggagaaataggaacacttttacactgttgatgggactgtaaactagttcaaccattgtggaagtcggtgtggtgattcctcagggatctagaactagaaataccatttgacccagcaatcccattactgggtatatacccaaaggattataaatcttgctgctataaagacacatgcacacgtatgtttattgtggcactattcacaatagcaaagacttggaaccaagccaaatgtccaacaatgatcgactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacactgcatgttctcactcgtaggtgggaattgaacaatgagaacacatggacacaggaaggggaacatcacacactggggcctgttgtggggtgaggggagcggggagggatagcattaggagatacacctaatgttaaatgatgagttaatgggtgcagcacaccaacatggcacatgtatacatatgtaactaacctgcacattgtgcacatgtaccctaaaacttaaagtataattaaaaaaacaaaaacaaacaaaaaacatcccaacccctcctgtgttggactggatcagagagtgcatgtgttactttgaagggtatatttatttccaccacaatcaagaattccaatggaagtacttcaccgaaagcaaggttgtgagagtctcttcagttgctgcctctctgcatttttctttgcttcttctaacccgatctactttacctgaggccactgctacctgcctgcaaagctggactgctcctcccgccaaatatcaaagcttcttcccacaaaagtctctggtcctggtctgtgtcctcagtcaacgaagtcaatgcactccctctcctcataggcagtggggagctgtcattttagctgtagtattaactgtccctcagtaaaggaaagtaggacattacctgtgcctgggattctttctcagtcttagtataacgctgtctcagaaagtaactggttactaccactcaggagaggctaatacatgtgtttacttttcaccatagtctaatgagaattccagtatgtaccacccagctccagaggcccccaggtacaaaagtggtcaaggtactccaaaatctgaaggctgctatcctacatgcatgcaagtgagatgccactgtcatcacacactttcttctctgttctccatatacctgggctaaaaaactgaccactaacacacaaggaagctaaatcttggtcaaccactccaccaggaatggaagaatcaggaaaaactgatcttcctcatgaactgcctgaaagaattctcttcaaaagacaccaggacaccttctccacagcacttcaccagaatatgcagcaaggcgatactaaccttgcgaggtctcacactccaccagatatcttagtgatgctatttctcatcatcttggtattctcagctaccaacaaaaatgtaagcctcaagggtcaatagtcctttcatttactgtattttcattcctgtataattttgcattcttccctctgattcttcccttcctctctgacttgcctccaaatccttcccatggtgtgctctgaatctctctgaagacatgtagaaccatgcaaaagcacagctttgcagccaggctgaactggatttaatgattcaaatgtggacttgctgtgtaatcttaaatgcatatggcctcactgtgccttatgacctaatctgtaaaatccagatgatagtaattactttgcagggtctgataatattataatgtataagacagccaagtatagtacatggtacattctaggtgttcaacaaatgacaaatattgctatttttgggactactacattttacccttttcacagactcctcattctaagtcctgttctatctcttgtccaaccctttcctcaggatgtacaacccttgaatatctcaggagaaggctacttgtgcccccagagcccacacaccaaaatctgagtggcagcattgtcccagcccaccatgccacttccaggccattcctttccattctcttatcaaaatacctctgctctcacggctcatgccacacttgcccactcctcagttctgcctctcctcatcattgcactttctttaataaggactttgacaactgtgtcaaacttttttctctcctaattccctcccagttgtggttagtctcaacttgagcatggatgatctttataacactgtggcttcagaattcttcaactccaaaaccctctgcccactctcagcaactcagttccataaccacacctggaatgttctaccgctgcatacttatgatactttaccatacttaagtggttcaaatgtctggctctccttggtggcctgttaggttcccactgctacagaacatatcttatgagaggttttaatcttatccctaggacagtgtctggcacacggtgggtatttaataaatatttatggaatgaataacatggtatatttatatagttttctagagataatcttgtttgcttatcaccttaggaagacagaaacattattgtaattcccctgtgtaaacagggaaatgaggctcagaaaagttaaatgacttagttaaggatacataattagaccgatacaaatacttttatatcacctagaggctggcaggggcttttcctaccatcctagctacaagatcagctctcttcttcctctaccttccttacccttgtatacttgtttcttataaaatcttatcagaaaatttggaaagtgatagcttactcgtttaatgcacatatgcataattctgataggattatgcatctctgtgctttaaagggtgtactgaaatgagactcttggtatctttttaaaggaactatgtaatgttatatttgattgctcctagtgtgcgtactaagatgataaatattcagtctattacctacattaagtcaatttcaaaactaaaaaatgcagaaatccagtattgtattctctgattaattcaatcctgcatttaagcttcctgaaaaagcctgcagaatgacagttcaaaacttctctgggttacaaatgaaaaatgatcattggtagaaatttgaaaactcccttttaatatataaagaagagttctgcaatcaggaaagcaaaaacctgctgaatcactctactccacatcccatgcatggctgaatccaacaccatcttaactggcattatttataatcccaaattgagaagtatctagttccaggcaatgaatcaaaaatatttcttatcagctggaatctttaaaaatgttttcctagtttaaggaagccatttgagatccctaaaatattttcctagtttaagaaaggcatttttaaaaacagatccttgctaatggtttgttttcatggtgagtttccacctctgtatacggcaatgacattcaacattcttcagaaggcactgctatgctacacagtgaggcatgtaaagttttcagggctgtaggtacttatactccagtagggaagaaatatatgcacaaaaataacttccttgcatgtactggtattgattagcagcaagagccgaagttcaattatgaataatacaaataaaacttatagagtcagtcaattatagctaacaattcttgagtgcttgctatctgcctggtaccatgctgaatactttaatacactaacttatttaatttcaagaatcctgtgaggtagccattctagtcatcatgttacagatgagaaagtttagcctgagagaagttcagtaactggcctaaggtcaaagagcagtttaaatggtggaaatggcattcaaatatagggtttttcactctaaaacacagtgcttgtttctttacttctcgttacctccttctactgaagcttatcatcaccaatacaggtaccgtgtagtttgtttttttacctgtcataaaatgtgaatctgctaactggtgagggaatcacagggaggctttcagctggctgtgctgcaagcagtacagactccagtgggttggcaataacaaattacagcacagccaagagtcaaagtagtccctgacctatgatcttgttgctattcttgttttactagatttttcaaatagcaatgtggcacgtaccattactatgcctagctaaacattaaaaatcactattaccttgtcagatatgctaccgttgatgaaattttaaaaaaccaacaaaataaatgataagagtttctactgagtaaaaatataacacaaagctattcagaaaaagtgcaacaaagccattgcaacttagaaggtagcaagtatccagctgagtattttgttgaaatggaggcctaatcctgggctaggaaaaatttaataaccaagtagtctttgtgatatttgccaaataacgaagaatattcaaatccagaactaattattagagtctattaatggtgctgaaaataacctaatagtttagaaaatattcatgacgtacatgttcacaaatacatggctttaaaaacagagtgcaatctcacttttagatgtaaatccaacaaaacatgtatatatataggcttgtatactgaaaactacaaaatgctcatgaaagacatcaaatatctaaaaatagagagatatactgtgttcgtggattagaataccgggttgtccctccatatccacagaagattggttccaggactcccttcagataccaaaatctgaggatgttcaagtcagtgatataaaatagcacagtatttgcatataatccatgcagatcctcctgtagcctttaaaaaatgtctagattacttacaatatctaatacaacagtggttcccaaccttttaggcaccagggactggttttgtggaagacaatttttccacggatgggatggttggtggtttggggatgaaactgttcatctcagggcaactggaattagtctttctcataaggagcatgtaacctagatctctcgcatgtgcagttctgtagttcacaatagggtttgtgctcctatgagaatctaatgctgctgatctcacaggaagtggagtaatgacagtaatgctggcttgcctgctgctcacctcctgctttgtggcctggttcctaacaggccacagagtggtatgatctgtggcccagggtgtaatgcaatataaatgctatgtaaatagttgttatactgtattggctttcatttaaaatttttttatttttaatttttgtgggtacatagtaggtgtatatatttatggggtatatgagatattttgatacaggaaagcaatgtataataatcacatcatgggaaataaggtatccattccctcacacatttatcctttgtgttacaaacaatccaattatactctttcagttattttaaaatgtacaattaaattaatttgactgtagtcactctgttgtgctatcaaatacctggtgttattcattctttcttttttttttttgtactccttaactaaccccatctcctccccaccccctactactcttcccagactctggtaaccatccctctactctccatcaacatgtgttcaattattttgatttctacatcctacaaataagtcagaacatgtgatgtttgtctttttgtgcgtggcttatttcacttaacataatgacctccagttccatccatgttgttgtaaatgacaggatctcattatcttttatggctgaatagtatccattgtgtttaagtaccacattttctttatccattcatctgttgatggacacttaggttgcttccaaatcttggctattgtgaacagtgctgcaatgaacatgggagtgtagatctctctttgctatactgatttcatttctttggggtatgtacctagtagtgggattgctggatcatatggtagctctagttttagttttctgaggaacctccaaactgttgtccacagtggttgtaccaattttcattcccaccaacagtgtatgagagttcccttttctccacatcctttccagcctgtgttttggataaaagtcattttaactggggtaagataatatctcattacagttttgatgtgcagttttctgatgatcaatgattttgagcaccttttcatatgcctgtttgtcatctgtatgtcttcgtttgagaaatgtctattcaaatcttatgcctattttttaaattggattattcatttttttcttatgtagttgtttgagctccttatatactgcagttattaatctcttgtcagatgggtagtttgcaaatattttctcccgttctgtgggtttctcttcactttgttgattgtttcctttgctgggcagaagctttttaagttgatgtgatcccatttgtccatttttgctttggttgcctgtgctggtggggtattgttcaataaatttttacccagaccaatgtcttgaaaagtttctccaatgttttcctgtttcagtttcaaagtctgaagtcttatatatttaagtctttaattcattttggtttaatttttgtattaggcaagagataggggtcaagtttcattcttctgcacataaatgtccagttttcctagcaccatttattggagagactgtcttttctccaatgcatgttctcggtatgactgtcaaaattaagttcactgtagtatattgtttttaaatatgtattatttttaattgttttttaaatagtttttaaaaaatattcttgatatgtagttggttgaattcacggatacagaacccaagggtatgaagggccaactgtgtttaacatagcaaacacgtcgatttatccctaattgatatatagtgttaatggaattctaactaaaatctccgcaagatttttgtagatataggcaagatgatctaaaatttatatggaaagggaaaggtaaatagaataactaaaacagtgttgaaaaagaagagaaagtgggaggaatcagtgtacctatttcaagacttttttaactatagtaatcaagactgtatgtactggtaaagggatagtcacatagatcaatgaaaaagaacagagaatctgtgaacagaccatgcaaatatgcctgcctggtttttcacaacagtgcaaaagcaactcagccaacaaaagacagcttttggccaggcgcagtggctcactcctgtaatcccagcactttgggaggccgaggcgggtggatcacgaggtcaggagatcaagaccatcctggctaatatgataaaaccccgtctctactaaaaaaacacacacacaaaattgccaggtgtggtggcaggtgcctgtagtcccagctacttgggaggctgaggcaggagaatggcatgaacccgggaggcagagcttgccgtgagccgagattgtgccactgcactccagctcgggtgacagagcgagactgtctcaaaaaaaaaaaaaaaaaaaaaaaaaaaaaggcagcttttccaacaaatggtgctggagaaattggacatccataggaaaaaaatgaatctgaactcaagtctaccaccttaaacaaaaatgaattcaaaatggatcatgaagctaaatgtaaaacataaaattctcttagaaaataagagaaaatctttgggatctctgtctagacaaagagtttttatacttaacaccaaaagtataatccataaaaaaattgataagttacactgtatcaaaacaaaagacttttgccacatgaaagatcctgttaagggaatgaaaataatatcttgatattgggagaaaatataccaaactacatatgtgagaaaggacaaccatttaaaaaatataaggaactcttaaaacttaacaataaagaacaatccaatcaattcaattagaaaatgggcaaaagacatgagccagcatttcattcaaatggatatatagatgacaagtgacgaaaagatgtcccacatcattaactgctagggaaatgcaaatgaaaatcaaaatgaaatatcactacacatctatcagaattactaaaattaaaaaaatagtgatgacaccaaatgttggcaaggatgcagggaaattacatcactcatacattgctggtaggaatgtaagttggtacagtaactctataaaactaccatatgaacccagcaactgcactcctgggcattcatcccagggaaatgaaaacttgtgttcacacaacaacctgtacacaaatctttatggtggttttatttgtaatagccaaaaaatggaaaaaactcagatgtcctagataactcttcagaaaattgtgctatgtgataagtgaaaaaaatgtcaatcctaaaaggttacatgttgtatgattctatttatatactgtttttgaagtgacaaaattatataaattgagaagtagtgattgccagggtttcaggagagagtaggggatgggaggaaaatggttgtggctataaaaggtgaacatgagggatccttgtggtgacagaaatgttttctaagctgtatcaatgtaaatatactggttgtgacattccactacagttctgtaagatgttaccattggaggaaactggttgaagtgtatgtggaatcactctgcattattccgtacaaatgcatgtgaatcacaattatctcaaagtaaaaagtttacttaaaaaattaaaagtatatattttttgtaaaaaagtatatattttttgtaagaaaaataatgtaagtatatattttttgtaagaaaaaatatgtatcaaaatctttatccctaggtggtagtatatcagtgactttcattttctccttctggattatctgactttttctaaaatgaacatacattgttttggtaactaaaaagttacagaagacatcagctataaaaacacagaactaatatctaatgacataagctgctcaactcagtatatctggtaatatgttaggccagaggtccctgttttgattttgagatttctaagtgtctgatgaccagtgcatagagtatgtttaaaatgagctaaccttttcttttaaaattttacacttcaattttttccattctgtattctatttctgcagttatctagtaacctctactccttcaacgtatttatgaaaccccacaaattctcaatttatggaacctttagcatcaggctggatccataggtagtgagagttatgtgtatccaggagaatgtcatatttatagatagctaaactgaatagaatttgaccagaaagtccccgctgttaactcctggaatgagtttgtcttgtgagaagaatggaaccatgatcccaatacagaggtaatagatacttctgatccttagtcacttaattctaaaggatgctgaatgcagggagataagacatgaggacaaggtaggacctcagagtaagtatgaatatttttttctctaaagggagaacctaaaataataatagcaataatgtatgtttgctcagtgcatactagataccaggcgttattctaggagcttaacatgcattgactcatttaaccctcataactagtggccttccaactggggtatgtgtactgggcatgcaaatacaagatatacacatgcaagggtattttaaggaaatttgtctttagaccttaacttccatttgtactttatttttcagctgcctgagaatccaactacattcatattggcttttccatgttaaaaaaaagccaaacttctcactcaaaacaaatcttattacagttcattatcttgtataccattgtctttggggtaaacagactcctggaatccaaaatatgctatgacgggaaatctactggtttcagggacacatgctttcatcaggacatctttagccagcatgtcaactatttccaatcacaatcaattcttatttaatactgttatagaatatttactcttttctacctcctatttaacaaaaataaactttgaaagccatgataaaaagttttagatccaacttaaaaatgtgtgaggaagtatgcattttttctaaattctttacagagtacatttttaaggaccactgctcataatagccctatgaaatagatattaatatccgcaaccccattttacatatgtggcacaaataaggtccagagagatcaagcaacttgccctaggacagatagctggtaaagatcagcgttaagattctaacctgagaaatctgaccctagaacctgagttcttaaccaccatgttatatactgcctttacagtttcaattaatatttactcaggcccaacgtggaatcggaacaatgtacctgtgaatcacgagaggagacgctgagcaaataatcctgtcttaaggaaaatattggaaatatgtctagaaaaaggattttactctgactaatgatactggtagaaaatggttagttttccattatttttattcttgtcagagatggcagaaacaggaatttgggatactcaagtggctgcagataaaaagattatgtgggaaattgagaagctagttatacttttgtaatgtaagtcaggcacgtaagttagaacatggctacacttttggtgacagaataacttatgatgcttatggctgggaacagggtagaaggcttgtgctgcaaagcatttatcagcatgcatctttaaaactggctgctcttgttacctaatttcttacacttcttcttcccttacaaaacatgagtctttccaatcaaattccacaaagttcatttattaaaacattttgttttggaagaagaaggtgaacatacatacacatacatacatgcacaccccttaaaggcagggtttcttttttcttttttttttttttttttgagacggagtctcgctctgtcgcctagtctggagtgcagtggcgcaatctcggctcactgcaagttccgccttccaggttcacgccattctcctgcctcagcctcccgagtagctgggactacaggtgcccgccaccatgcccagctaagtttttgtatttttagtagagacggggtttcaccgtgttagccaggatggtctcgatctcctgatctcgtgatccgcccacctcggcctcccaaagttctgggattacaggcgtgagccactgtgcccgggcctaaggtagggtttcaggaatgacattttccaaatgaccttgggttaaaattacttgtaatcccaagctactttgaaatgtttaacctctgcactcatttcaagttttcttaaaatatactttagactacatgggatggaatgaagcaggcaagctctagggaggataggagataccatattcctgaggccagtcagcctgtcagcactggcatacctgcagagagctcctaggacagtggtgatcagacaagttgtgcagttctgatggagaggttttcctgagcatttgggtgtcctaattaaatacagccttatttcatgataggagtgactcagggtcaaaggcaatgggaaatgctacagagaacacgactgcaacaccaggaaggctttggaaaggcagaggctagtgttgcagagaaagagcccaggcaggggattgcagaacagtttcataacctaccactgggagggcctgggcaagtcatgcatctctgtcgcctggttttgctctcaaagactatgactcagaaaatcagaggtggaattgctttctctaaatttcttagaaaatgttataaggtagaggaataatctcttccctgaaaaatcacgaccagcatgattgaatcccatgcttgcattcccagctgcacttttccaaaaggtgttttcaattattttcagtgagctaatgttcccttgactatcttaaagactcagaagatcgggacagttaaatttgaatcttgaagaaaacaatagcaaacagctgcacaatggacccatgtggacaaaggtgcctggggccttactagaaggggcattcatagagtgcttcatagtttagggagggactgcccttggaacaagccctccatggaaggagctcagaaggatcagctgcagacagtgaagcaatgagctttgagataaacatcagtgaagttttctgtggctccacgcactcctatcaggagaaaagctagctggctttgcagttgcgggggagtagggaagatgagtgtactatttcctccctccaattttgttcagtactagaggaggtcttagagatcatctgagtcaattcctacagttcacagcctaggaaacggaagacaagacttgctccaggtcactgaactagtaggtggcaaaaatggagactagaatccagttgttcctaatatgacattctacttaaaaagcctgactaaatcttcctcaattagccacgggtgtcttcttttccagattattaacgagcaatgaattcttacttcatacaaatgcctatgaaatttgtatttatattatactaccttttcactcaatgtaagacatcagtaaagtgattcagttatcaaatatcatataaagaaccataatgggaaatgcttagttctagtctgttaaattgttcagttttagaaatgtttctgcttcctatcctttttgcttgacatgaggctttgacttataggtggatgcagaaaaatcttcatatcttcatctccatctactctttagggctttaaattcagttaatccattacttgcataaagttagtaaaaacaaagaatatttaattttgaagagtattagctagcattgttgagtaggaaagaacaggaaaaccaagtaaatctctctggatggttttgcttgtggatatgcgtgtagtaatagaaaatgcaactgaactctaaataataaaatacttcctgtagggcaaatacagccagaaaaattggaaagcagatcaataagattactacatatctttaagccactgaaaacaagagctagacgttggaatgtattagcaaagtagctatgtctagacacttcatgttaactatattatataacttttactcttggatactttactggtagggaaatggataaaatgatcctcactgatgccttctaatactggtgccttacagagcagaggtgggtaatgtccttatttcatcaaaggatactttctctctggagagtgtaaaccatgattgattcaagtacatgcaaacagtgacttacttagtgcttctgaaaaatttctgagtcagaaggacaaaaaataaacataacaaaaaacaaacatttacatcacaaaaaggaaaaaaaagctcactaaataaatactacccagagaaagaaactggtttcatattgtagtgaattaaaagatacaaaaaagtggggcagatagagaagagagacaaaaatatgaagaaaaagaaattacaaggcacaaggacaagaaaatatgtcaggattagcaagaaaaatgggagactcaagggagtgatgaggagaaaaagaagagagagaaaactgcagagaaggagagaaagtgcaagaacttgatgtctctgtaagactgaggaaactggtgtgctttgacacttttgaaaatgtaatcgttttctcagcaatttattatgaattattaatgtgcagaatattcatttcctacaaatataaagattttgaaatgattcaggttttaaaagttaatttcaatcagaaaatgaataatttagttatccatatattagctatatcttcatatatttcctctgacaataataacttactcatttgcattatttgtagttttgggggatctaggtatctgtattccataatgtctgagcgttacactgaaaacctatattaacttctgaaatgaaactatttttttctgtatcaatttaagcttttggtttaggtaagggatgtccaagggacacatataatgataacttctctgtttcactgccttttccatcccagcaagctcccaaatttcactttaaaaacctacaaaagtagtttaaaaaaattatagttagagccaggtgcagtggctcatgcctgtaatcccagcactttgggaggccgaggcaggcagatcacttcaggtcaggagttcctgaccagcctggccaacatggtaaaaccccatctctactacaaatataaaaattagccaggcatggtggtgggcacctgtaatcccagctacttgagaggctgaggcaggagaattgcttgaaccctggaggtggaggttgcagtgagtcgagatcttgccactgcactccagcctgggtgacagagtgagactcaaaaaaaaaaaaaaaaaaaaaagttgaaacaataggagaaaatctttgtgagtttgtgttaggaaaagattccttaggtacaataccagaagcacagtccacaagagaacactgatcaattggtcttcttcaaaaacttttcctttgtgaaagacattattaatataatgaaatggcaaaccaaagactggggaaaaaaactcgcaagttatatatctgaaaaagaattgtattcagaatatataaataaatctcaaaactcaataataagaaaacaattaaacaaaaaaagcaaaaggtttgaaaagatgcctcactaaagactatacttggatgaaaaataggtctatgaaaagatgctcaacaccattagtcattgtggaaatacaaattaaaaccacaaggagataccactattagaatgaccagaaaaacaaaagaaaacaaaacccagtcaaccaaaaccaaaaccaaactaacccactgacaataccaattgctggtgaggttgctgagcaactggaatttctcatacactgttggtgggaacacaaaatagtacaatcactttggaaaacagtttggcagttctttataagatgctaaacattcatttacaacaaagcccagtaattccactcctagagaaacactcacaagaaagctacattcacttaaaacctgtacgtgaacattaatagtggctttattcataattgccccaaacagaaaataaaccaaatgtccttcaactcgtaattggattagcaaactatggtacagctgtatgacagcacattaaacagcagcaaaaaggaacaaactgttggtacacatgacaatttggatagtatctcaagtacattctgctaagtaaaagaaaccagattcaaaatactgtgattccatttatatgacattcaggaaaaggtaaaattagaggaacagaaaaaaaatcagtagttactaggggttgagaatagagagagggactgattaaaaagggagcctgaaggatttctgggggtgatggaagtgctttgcattttgattatggtggtgatcacactgctgtatgcatttgtctgaatcacagacctgtcctagacacaaaagtgaattttaccatatgtaaattttaaaaagtgaaaaaatgggttagccattgctcccaactctccaatgatttttatcaaaaatttaaagaggctctacactaaattgctgcaatgattcataggaaggcacatattttggacgttagcctggtgggtaataaataccagtttaatttttcttaaaaaggtatttgatttgggtaaacaggcttagggctaaaacaaattgtaaaaaaagtatttgagtatcaactaggagttaggtactgttataagtgagaaagcacagataagagtagaacctggattttttttccccctttatggtattagaactagagggggtcagctgattccaagacatttctcagtagtaatacttggaatgatataatcaatgatattgatgtccaaacaagtacaactaacttcgtggcttttctgtccctttcttctgtggtactgaatgacttctagttgttttctaatcagctcaataggttaactatttgagactgaataaaataaagcagcccatggcaggtcaaagactctctaccactgccagaaaggaaacgcaactgttctatgctctttatgcaggttcgctgcagaaagatacatgtttatttcattaaaagctattttattacctggaggaaaccaaacatcaagtttagctctctaacacgaatcatattttattcaaatgcagatgtacttttcaactacagcagccatttgattaacttgtccaatgactaaactcatgaccctctatattaaaagtggtgacctttatgctgaagaatctaacccagagctaagttatccattaaaatgcaacttgggagtatattactcttcatgaaaatgtaaccacctcttttcctgctagtcgaggtctccagagaaacacagagtgaataaaagacatatgtaacttcttttatttggccacttaggagggggtcatcatccacgtgcatagctctgattcccagatgacagacaaaaatgacagaacactgcagtggctgaagagtacttcagaaacatttcagttggaggaaaggcacttcattccctcatgagagacggaaagcctgtaagcttgaggatgttatttgcctgcatcttagagctatgctgagatgaaggatgaaagaggaacacagaggggtcttggttgataagagaggaagaaatggggatatttttgcttctgagataaaaaagcaaaggaactttggattgatgtatggttttgagaaattacaagcacttggagaaagcatagtcccaaatgggcaacatttgtataaaaagaccctgctattatagtaaaagtcagtcatttttccctacatgaggaagcagaaagaaatgaattccttaaggagaagggaagatataaaacatcagtcctcttagtgtgaaacattttaactagtttataatcacactatctacaataataagctgttctaaaatattaatgttctcttctggcaaacttcaggttggttgtacggtataatcaccttagatacttttaaaacaattccatatccagggattctaattcaactgatcaggactgtttctcttgtgattctattgagcagcctgggctggaaaccaccactttaggggatacggcttagtttaggagattcagcagagatctgtaccatacatacatatttaaaagtgcgccacaattcaacaaatgacagaaaaatctgaagctaaagacatggacagagaatgagtttctgcattataagataatttttggattcattacattacctttacatagtggctacttcatttataattccctaacttgatgcaaggctgggactgattggggataggtattttagcaaccaaattccacctacgcaagtgaaaaagaagctacagctctgagatgataatatgaaccaagtgaaaactatgatttgatttataaatattcagttttcggaacacaaataagtggaaaaagtgaggttgatctgtaatatccatatcctcatgtttatacgtaagtgacaatttctctaacttatggctttacggtcaaatcccttgcatagacatagtaaaaccacatcagttcctctttataaagctctgtttaagagacacggctatcataaggttcttacttcccataacactgtattgttttcccgtttttagtggctgttccttttaaacaaatctttggagcactgaaaggctttattcattttctttgagtttttctatatatctgaaatctgaaagtaagcccaaaatgtgaatttgcaagcagccttgatcaaaattcatatttaggtccaaattaactagtttgatggacctaagcttataaatatttgcatatttttatgtgggtagcatgaaaaacccctctactcaatgggctagtgaaaaatagcaggtaggagactaaaagggacttttaaaatgagccactccaaaggctgctattaaagttatttaaacatgtacatgaaataacaatacggagcttttgcttaactggggcacaaatgcataatctagaagtctagacatgcagcaaatgacatgggtctcatggcccgaggctttattttaaaaattgagctcctttctgctggcatgggggtagcagaaattttaatacaagcattattattattttatgaaaggaagaaataacacaaattaactataacggagaaatattctttgtaattcagctgtcaacttcagcatacataaattttattttgataattatgctcacaaccttagtacttctgaccaaaatctactatagaacttccaatggcaagaatcacgccaggcaccgtggctcatgccttaatactagcactttgggaggccaaggtgggaggactgcttgagcccagaagtttgaaaccagcctgggcaacatagggagacccccttctctaaacaaacaaacaaacaaagaaatggtgatgttaaaaattttttttatgaagttgaaaacacaatttagttaagactgattattctaacactttaaaaaatatgacactaaatgtaggcctcatatttcaaacaagataaagaagcatgcactaagcaactaatatttgtttcttggcaaaaatcatttgcttttcatggcatcagagacaagacgggaaaatgtcacaatgattatggtctgaaacaatggttctgaaatctcgctgtgcattagaatcagacggagagcttgctaaaatacagatcactgggctccacccctagggtttctgattcagtaggcctggggttgggtctaggaagtttcatgtcttgcaagttcccaggtaatgctgatgctgctgttccacacaacatacgttaagggctacttatctaaaataatcctttggcaattaactagtcggtcaagataaaaacaaataattacaggcgcaagcaagcccaagataaagtaaaactatttagttaattcttatgttgaatattctggagagtcttatgttgaatatcctgaagcattaagtaaaaaaactctcactttgaccctgtcaggtactgactgccaatatgtctgaccctaaacaataaaatccatacatgattttatttagacctggaaattgctggaaaataattgtaatttcataaatatagccagtagaatatacacatcccaaagtactagactaaacttgaatttttctaaacattaaataaaaccacaagggcaagagttctcaatttgttcttttttcaaaaccacaggcaagctaattctacagattgtggaatgtacaataggccattctcacaaaataaacccaaggggtgaattatatctcttcaaactaggtggtgtcttaagtcaacgaaggtaagtctatgactaccatgctgaaaaacagattttgtgacatgtatggacctcacagaaacagaaacatgtaacaataaatttaagtaagggtataaaaaatgggtgtgtttgtgtggcatctataaaggcttcctaaataaaatttgttggagctcgactataaccaaaaaatagttaccctgtgggaccctgtttcccagagctgcattcttctgaccagaaatatgaatgccatgctgctgtttagggtcttcaaagctggctcattcctcactcagatattatgggctgtcttctccaagagattcctggaaacgaataatttctcactgatagaagaaaatagaaaccattaactaactaccagtcttaaagctgtaagttatgataacagtgagttttcttatctgtgatgacaaaaaattttgacctctctccccagcagtacagaggagttccttttaagtttttgctatactgtatttgtaaattcttgcctatgaattatatgagtaataagtagtatttactttttacatgtgcagcttaggtcagtatgttaaacagattctattctatgaattctatgcagcacacttcatgatatatgactctttagcaataatgttcttggtttgttataaacaacataatgggaaaataaagagttgtttgtattttgcaatttcattttaaagactgaactgaactaaaaatgtctaggaacatgccagtattttcagaggctcatgtagcactttttggaagatggggagagaatatcataagatactggaacagtttttcctcagatagcctaaagtctaaatatgccatacctcctactctaaaacagcaattgaaggcaatgttatcttgggaagacatctgacagtgtctggagacatttttaattgtcacaactcggagggtgctactggcatggtagaggccaaggatgctgctaaacatcctacaatgcacaggacagccctctgcaactaagacccagaacagaaggagaaacctggctctaaaacaactaagaaaagacattgataataaaaataataaaaagatgtgatgtatcattgtaacatttactatttacctgtattgatggatatattttaaaaaatcccttcttagagaacttttcatgactgttactctcataaaatcacactatactggcatgcagacttcaaggaggcaacaattagggtgcagaggccaaactacacaatgttattcccaaccaaagaatcttcatgagtcgttaatccctgagctatccacagagatatctttctacataagtatacatggaagataagggttgtcaagtataatcagattcctctaagagactagcattgacagacaagattaaaatttgcttaagagtatgacagtgggctttcaaagaatcctgctgggtttccaaaagcataaactgaccatcagtgtatctgctggataataataaaccatggtatataatttgttttacatgaaaggtgatttgttctccatttttattgctgacaaaaaaagagataaaagatgatttatctcttgaacatgtgaagattagaaggactcttgggtggcttcggtgaagttccatcttgagagaggattatgaaccatggaggtggtctgaagttctgcaattcttttcaaaaattaaggctcatcaaataagggggctagaaatatcagcaagactaatggatataacattggctgttgagagtgtctaaaataacaccttcattacacaagatgctcaacagatagttcttgaataaataatgacataaatacatgactcctttttatcttctgcaaacacagacctaaaaccaattaatactctcaactcatcctttaggacagaaccatgggctggtttcaaagggattgctttggtaaccatggcaggaaaagtgtacacatccatcctaaaataggactatgcaagaaaaggcagtccttgccttatttggttaataactgactggtgaaacattccatatctattctcacaagccttccagttccaatgcaaataaagaattagctgatatgaccaagaaatggcatcgattctaatcatgtgacaaacccacattaagtctttctgccatccccactgcctcttgctatcgggagaacagaacaaggcatcactccttcatacctaaccagtttcagcctttctgagactggcaggagaaaatctaagctggatttctcaaaatgtggtccacagatcacctatatctgcattgccccaggtactaaattcagatcctgggccccatctcttactataaaattgaaattgtctagggtactccccaaaatctacattttaacatgttccctgggtgattgttatgctcactaaagtctgagaaaccctctgtaaagggatagtttgttcagggagagtcagaaccctagagttattaaatttttttttccccctcttagctaggttatgagagctttaagaaaaatgatggccgggtgcagtggttcatgcttgtaatcccaatactttgggaggccaaggcaggtggatggttgagctcaggagtttgagaccagcctgggcaatatggcgagatccccgtctctattaaaaaaatagaaatttttaattttttattaattaaagaaaagaaaaatagcttatttcagcagagggatggagtaaaagttaaaagagggtgcagaagacccagtgttgacaccgttaattttgtgaagcatttaatttctcatatggtgaattctgagttgcttgatctagccactccaagccactctgtttctcaatatgccatgaaaacctttgttagagatgacattacccatatatgcattatttaaactttaataaaaagaaaaaatcccaacatctatgtttattttatgttagttattttttaaataatagagatatcaaatcttgatttttttttttaggttatcatgagagtaatgaggcatagaaattgtaaaacggtagtaactcctcaaatctgggatttgctgtgggattaatttttgttctaaagtgtgaatacaggtacctaatgtttggggcattcatataatctcacataaaataatggaacctcacaatgaattgaaaatcagaaggatttgaaagaggattctgattccacacccttacaaagatttttaataatcaaaagtgacactgactgtatctattcaaaaataaaaaatctacttttttgctgacatgataaaataactcttttgatttttcatgaactatgaagtaaactctaccacaaaataataacataaacatcacttcagtgcaaccaaggacataaagaagttcaaatgcaatattcgtactatcagtcaacaaatatttactaagcaactatatggaaattaaagatggttacaaattctttgccatccatcctgtcaagaagtgaaggctatttcctctaccttgaatctaggctggctttttgaatacttcgaccaacagaaagcatcgatagtaactctttaccactttggggtgtaaacaagcctcaaaatggcctggcgactctcacctttgcattctcgtaagccagtcaccatgctgtaaagactgtaaaagactgctaacgctgagaggactggggagagaggcctggattatgaggggtcattttgtacatttcagcctcagctgaatgctattgcagaggtcttgcccacctcatttggaaaagagagccatctagttgaacctagtccaagcttgtccaacgtgggccacatgtggcccaggacagctttgaatgtggcccaacacaaattagtgaactttcttaaaatattatgagattttttgcaatctttttttccgttttttttgatatggagtcccactctgtcgctcaggctggagtgcagtggtgtgatcttggctcactgcagcctccacctcccaggttcaagggattttccggccttagcctcccgagtagcttggattacaggcacccgccatgatgctcggctaatttttgtatttttagtagagatggggtttcgccgtgttggctaggctggtcttgaactcctgacttcaagtgatctgcctgcctcggcctcccaaagtgctgggattacaggccagcgagccaccatgccaggccaattttttttttctttacctcatcagctatcgctagtgttggtgtattttacgtgtggcccaagacaattcttgcaatgtggcccagggaagccaaagattggacacccttgacctagtcaataaaaaataaattattgctgttttaaacgactacattttggagtggtttgctatgtagcaatagagaattaagacaaccattatgttttatattacatatgtgttatgtcatcgttctacatgtaagaactgtaacagaaaaaaaaattaggcaaagttctacgttttctctggatttatcaattattggctaaaatgcaagggtgcatttctagagggtgttttatttcaataactactgttactttccctcctatatacttcaacactttgaaaagttaatttacttttctttagttgttctgaggaatgggagcaaatatattagcaccaatatgatgtttgtatactaaaatactgacatgaaatttttatcaaaccagcatatattatcttttttttttttaaagcaagcccaattctaacttataaataggataactcaatattgttagtacaattaataatgttttagctggctgttaaacgactgacattccattttagagtctgagtaagtgaaactgggtgtcctaaatttctattttaataattccttattattcttattttttttgagacagggtcttattctgtcacccaggttggagtgtagtgatgcgaacacagcttactatagcctctacctcctgggctcaagtgatcctcctgtctcagcctcccagtagcgggaccacagacatgcacagccatgcttggctaatttttttatttcttgtagagacagggtcttgccatgttgcccaggctggtcttgaactactaggctcaattcattgtcccacctcactgtgattataggtgtgagccactgggcaaagccaattccttattatttttactgaatttatctcattctgtactgttttactatgttaattcttgtggggatgaaggctatcttgcaattcctctacctggaatgttactcttctcccctctccatttccttaaatcctccttatcttaaatacacactgccttgcattaactttttgtgctataaaatccagccatggcttaatagctaaccaccttttttgtttaactactcttatttttaaactggttgctgtcctgaaacactctcagtgaagtacaaacatacttgcttctcagattgtaagagaaagaaatgactttggctgttgcctgagtctacttcttaagaacaccatgcatcactgattgggagctcacaggataacggcagatagagagtttctgcatgatggtgtgttcccatttgcttggaacctacgagcaacatgtgaaagtatgcagttcctaagttctttgcatgtcaagtacaagctatccaagcatccactcttctttcaaaggacgctaaatgcaaaacacagctgtctgtgaccttgggagacctaaccggaatctgcaaacaagcttatgtaagcgtaccctggccagccttgttccgaaagccctctctaattaaatgagagttttgatttcttatgtggaacagtaaagggtcttctgggaagagacatctcttgcaggaactgtaatttgaaaagtaatttttgtctctattgcatccttaactacacaggacataatagtgggcaagaaatgatagcagagctgtaaatactgagtaagtctgactaattcccaggctgcacaaaagatcttattaaacaactttattaatgacctggaaatctgagaagacgttacattaataagttcctcacatggcactaaaggtggagatggtagaagaaacagaggtgaagtcaaacaatattcatggatccctggagatcagaaaaatgaacagtaaagtacacagtgagttcagtctggcaaaatacaattaagtacaagtatccaggaaaaaataactcagaagactgacattcagtggggatgaaacctcgaaagcatgtcaaaagcaaccagatagatactgtaacccacagattagataggattttgcaatataacagaaatagcaaagcataaagtagatgtgaagctgtccatcagaggggctcagcacatgctgacaatgataaaagaaaaagaagggtgttgggcgggtggtgagtaaaaacagctcagttattaagtccaaaagtgtaagcacctggactttggctttaaacattctttcagaaagatgaaaagcatctgagaggcctttagagagggaaaaatatatttacagagataagcatatgatgagagattaaaggaatgaaacagacaagcctccactgagcagtgacaaaaagaggtacttaactctgatcaaaattattgtttacatttttaagggttttccgggcaagataactaacaaatatatttcttaattatacatatggcagatgaaacagtgagtttccaggaagcatcagccctgcccaaagccatgtagttgaaagaagactcagaatcacagaattttaggcaggaaatgatcttagaaattacatagttttgtgtcttcaaagtgaggtctgagggcctattgcctggagagcttatcagaaatgaagatttctaggctccaactcagctctcctgaatcgaatcctaataccccagaaggattagctcaagaagcttgtagagtttaagataagtttatagataagaaaagtcaagctcagagataaattgccccaggtcagtcatcaataggtcctggtttcaggtccaacgatgttactatcactgtgggatgaaattctccccaaatctataaattgcctttataattagttattaccatgttgtgtaatttttccgagaatttatattatagatgttgcttcatttaattcttgtgtaataaggaaaagaagataaaagaaaacagagtctgccatcagtgggtataggagacagttaaaaaaaaaaaaagaaaaagaaaagagaagacaaagattgggatatgaagtaaaaagcaaaaacccgaagcttcgaataaagctttgaaggtaagagaacttataaaaatgcaagagatgtttaaagaacaaattatggtcttcctaacctctaagcttcctaaaataaaagtggaatctctgctcgttatcataagcccttctctcctgtagggtaaaggacacgaggatgagaaccagactgtgggttgtctctgtatccatttctgtggcagcaactagcatgctctagattgttctcttgtgtcattagaagtccattatttgaaaggtaatcatattgcattgatatatcttcttttagcaaaagctgaccaggaagtgtttcaggttgatcatttctggttttgacgatctctatctaatgtaatccttgtagggagaatctgggtttgaccccaggataaaccaaaacaaagggaactaacatagaccaataaaatatatcctaaaaaaatataagcaattaaaatagctttatacaaacaaaggtttataaaaaatcattattataaaagaaaatcaggccgggcatgttggctcatgcctgtaatcccagcactttgggaggataaggctggtggatcacttgaggtcaggagttcgagaccagcctggccaacacggcgaaaccctgtctctattaaaaagacaaaaattagccaggagtggtggtgcgcacctgtaatccaagctactctggaagctgaggtaagagaatcgcttgaacccagtaggcagaggttgcagtgagccaagatcgtgccattgtactctagcctggacaacagagtgagacttcgtctcaaaaaaaaaaaaaaaaaaaaaaaaaaaaaaaaaaaatcaaatgttgcacatgcatagaaaataagattaaaagaaacattgggaaccaaacttcaacagaaagatgtatttctcaagcatagtttttactagtttttagataaataagaaagcttattttattataattttgccaaacatactggctatagaataaatttgcaaaatgatttctggaacatgataagagatccacagagaaaaatgtagcagaaagatgggtattcaagttacattttagagtagaaaaggcctctggaaaacagatttcaaagaacaagttaatacaagggaagaaagcctctgatttttaataaagccacaacattgacatcttgtctgttcccagagtgtagggattcagcaacggaaacctttgccttgcattttggagctggcctgggaaagcagcgaagagctctccacagtctgtgcctggaggcccaggggggctgtcagatttagagctctcggactccactgcaggataaacagcttgggattcttctttaatgacaacagcgtatcagctctttttgaggttacagcatacataaacaagatctgcctcatattttccagttgtggaggagggaagggaaaaaaaaggcccccacaaaccttttcccgcagttaacagtagaagacgacttgcttttacttgaatgcaagactgaaaaaagggaaggagaaccatggcgtgcaaaatggccacaccgaaaggaaacaggaaaaccattacttcctctgtgaaaacttcagtgggcaatcaaagggaagaaaggtaatgaatgttgaattctggtgttttaaaaggaaagggacataagcttaaaaagagtgagtggaaagattcttaataaagccctcctggagacaagacccacagaggaatcaaacaggagatcttgcccggcacacaccctactctgcatttgaatgtagagtgaacaccggctgtcatgttagaagacagaccagtgggttatttcctaggcttcctcaaggtttattactggcatgaaaaacttcctggccttctttgaggagctctaacaaaatgtgctaaatgaagatatttactcatagaattccctctcttgcatcctggacccaagttccttatttctttttggattcaagaaaacctcaagatttctgttttcttgacctaagcctacaattccctgcaatctcctctaccccagtcttttcgaggaagctgcagacaacatttactctatttgtatttaaatgtatactttcatgacaggacagcttgcttcattttgctgtcctgggccagcaaactttttttgtgaaggacttgatagtaaatatttcagcctctgtaggctatgcaatctctatcacaagaactcaacttttctgttgtaggatgaaaatagtcagataatatataaataaatgagtatggtggagttccaataaaactttatttataaaaacaggtggcaaaccagatttggcccacaggctataatttgtgactcctggtactagttctcccctgttctataatataacagcattcttaaaaagtggtgggcagatgaaagaaacatgatggtttccattttattatgaacatacacataaactaattatgctttgcctctgatattaatcaagatatatattaaggaagtggatgtaaaaaaaaactttaaaaagtgctcttcaaacatatgctatcatcattattctccctaccctgtgacaaaagcagcctcagtgttcactcttctggcgaggttttcagtgacaagttagaggaagtgggtaggtagtttatgggggaaggagaggattatttcttgtattgaagtgactcatgagtccctagaatttgagaacctctgttctttagcaagctgtcccaattaaataactatacattatcaagtgaggtcaggtgataagtcctcatcacctctgtccagtagataatctgtatttcagctgtgttcaagcaatcccatatttctggaaggcaataaagatttcctaattgttgcaaagaagactgtaccagctggggattggaggtggggtgcgatggtcggttgacagttaaaatgctggaactggatgccagagaaggtgtcacaactttacaaagtaatgcaagatattgcaccactgcaaatgcctcagttgatgaaatcagtcataagagaaaatcaggcaccattaagggccatctagaaaggggggaatccaggaagtcagccagagacaactctgttacttgagctccaagcctgaatcaaggagagctctcagagccatgttcaagtttgagcccagatttggaaatgcacagaatgaactagggcaggaggccaatgagaaaattatctcctatcaattttacacacattctatttctgactgaataatccttgggtttgggcttggggagatagagctgaaagactttggcacatgagatttgcagtggccaagatcagtagacctttagttcacagcatattgcctagtgtttggtcttaaaatatggtccatgtaacgctcaagtgggtgatgagtccatctttctcttctggaagaatgacagttttaagtccatcaaagatgacagttttatcctaacgtgctaattactttgccacggagacaactggtcctctgaactgctgcagatgagagagttccctatatttcagtttcagtctgccgatcaagacaccaaattgtaaaaatgtaattagctgatatggcaaagtccccctgaagacacctggttgatgggtcactggttcacacctgggaaataatgaagttgggtgcccaataagtgtaagccttgagagctgacaggaaaagggaccagggcaggaagaagacaataagaggtgaaaagtcaggaggtagagccagacaaggatcatttggggaggagcagtcttggccaagaaagagcaattatggagcagaataaaagaaagacctaagaatggaccaaggaagatctgtccaggataaagatgtgtccagaagttgacttccaacactggcccgaggacatcaaaaatggggcttggctctgactggaaccagtaggacagaagacccacacccttgggctattctgtactctgccccccacccttctcccatgtaaattttagtgaatgctttgaaatccaggcaggctcaggaagaggaaacagtatctactttgactgtctttctcaggtgaaggccaggctacagttaagatggggaggctggcagtctcagcaggaactgagcattactgaggcagttcttccccatagaacaggaggtcacagtccctgtcccttactgtcttcttgatgtacaagtttctccatcttacccagctagttatgtagcaaattcagctctcaggagatgaagtgagtaagagaaaatcaggataaaatctaatttcttttctccacttccccagcataaattgacagtgatatgtctgaaatagggggtaattataagaacttaaaaagaaagtttggaaatgctaatccatccaaaaaaaaaaaaaaaaaaaaagagagagtagcttctcttaaaaacaaacaaacccctttcttttaaaaaaagaacttggcttatttttttctgtataactgaatagcttaaaagcaaaacaaaaaaagggcattacatagtgagaatttaataaggaaaatcatacacaaagaaaaccacaggccaggcgcggtgactcatgcctataatcctagcactttgggaggtcaaggcaggcagatcgcctgaagtcaggagttcgtgaatatcctggccaacatggtgagacccggtctctactaaaaatacaaaattagccaggcatggtggcacatgcctttaatcccagctacttgggaggctgaggcaggagaactgcttgaacccgggaggtggaggttgcagtgagccgagattgcgccactgcactccagcgtgggccaaaagagtgaaactccgtctcaaaaaaagaaaaacaacaacaacaaaaaaaccccacgatgatatgaagtctttattcatagacaacttttgatggggatgggcagtatcttattacaaccccatacatccacttaaattggcacaaggtttatctgtaagttttataccttaaaatgtatttaagttgaaaactaaactgatggggagaataaatcaacattatttaatattcaagtcctaagtaaaacagagtactcaaaattggcactagtataaaattttctttaaaatttcattaattagaagagatcaaacagtcatttcagatatgtctattaattttactctgatcacactctttcaagtattatggtgatcaattttccccacaaacttgcaagggagaaacaactgacctccccacaaaatctaacttcaattaactatctaaggatgatattcagtgtttctcacattaaaggagttcagaatcatgctctggctgtaacaggaatgagcacagagcacttcatgttagctgtttggtatcactgtccaaatccacggcctctttctgcataccttatgacagtgccatgtgtacatccttaatcaaatactgttaatttttaacgcatgagttttttatttgaggatcaaacaagaattatgtttgaaataaaaggaaaaaaaaggagaaaaatatcttaatgtaccatagacttgaattaccctatcaaaccagattttctttttttaagtttccaacaaaatgaactggatagtgtgagtcctctatttctcatatccagggtagatatcagctccctctcgtagggcaaatatttctgcttatgccctcacaaatagactggccctccattctgccacctcctcttaccacaaattctgaaatttctggcagaaaagagatctgtcaaaacaggttacttgtatttttattggttcctccagaccatgacgacatttcctgataggcaatgccaggaaactattaatgtctgtgaaaagcagtgaaaattcttaagagtataaactgtctggtgcctcaggagactgaagcctgaaggaaccactagtttttagactgtgacattgattccattggctgccgtatcagaaatccaaaacaccactatcagaggagaagaaaaagtgtctttccaaaaagaaaggtctggaacacacaaccagccatctcctttctcttaaccacttgcctgcttagaacagagcaggtgagcattatgtgggcagctaatggctggctcagttaaggctgttgcaaaaattaggtaatttattcaagaaattaatagatcttttcccaagcaggaggggtaataatgcctacaacaggatgaagagagtgtggctttccctacaaatgatagaaagaatgcaactaacatccatgtgcagaaatagaattgcacctttttaaaggacctcagtgatccgctcagtatgtgagcacttgatgccactgaccttaaaggagtaggagccttacagaagacatgaaactaaatggaacaaaactagtttgaggcaccagacttgtatgagactttcaagtatatcaactgatctattatgaagtgcccaaatcacgtgggtacttgctaacgttctatctgggtttgtggagcagaacggcagctccctgcactgtcatgtccctctatttcacagtgccacctgctgggcgagggtgagagcaagctgaactttcttgggagtggtacctgtgaattcacaaaataacctctgaaatcacaaacagaagaaacatctttgagaccagcctggccaacatggtgaaaccccatttgtactaaaaatacaaaaattagctgggcatggtggtgggcgcctgtattcccagctacttgggaggctgaggcaggaaaatcgcttgaacctgggagatagaggttgcagtaagccgagatcgtgcaactgcactccagcctgggtaacagagcaagactcagtctcaaaaatacaaaaaacaaaaaaactattgtttcagaatttttcatgttttagaaaagtaaactgatacatatactatgtattatatgaaacttgcagtgggttctttggcagcacccactaatccaacattaatattcctatagcaagatgtatgaatatttacattaaattgttaaagaatctagatagacttgtgtgttagttcagatgatgttttgtagttaaatgtgtttactgagtcaaaagatactatatctctctgacacacacacacacacacacacacacacacacagaggctctttcatcattcatgtttgtctcactatgcatccatccaggtttataataacatggcaaaattgctttaaaggccatttacacatctactagcagtgtgcaagtgcacgtcctaattcactgtatctttgtcaataccaggaatcaccattaaaaaatttgccaatttgacatgcaaacaatggtatttctttgattaaatgtgcatttctctgattgccttggagttttacatatgctccatgtaatctttcacaattttaggaagtagttattcctaaattcccatcattagtggtggatccaggttggcttgactttaaagcttatgctgtggaggcacttaaaagagggttcttggaggtgccttgggtctttgggacacagactaacacaaggacatgaatgacttgcctgggtggtagggtagggaaagctttgattgcatctgtttactaatattgtgcttctctactgtgcttccctattgtactatacccagagtcctcctgggtggccattaaagcctctttgaaatgtcagcccacttcactcaaggcttggatagagaccacagagactatttcaaagtagtgtggtatatatttagcacctactcagtgtgcagtacacagtttttaaactagttaatcattaatcagtttattatcaaaccagtatactactgaaaattgaatcatctagataatcttgtgaattctagttgttcttctttccccctaagggcttatatttacattaaataaacctgtatctgaatcaaatctgcaaaattcagatgatttgacagcattttagatgaagtgaattttgtcagatttcacctgaaaaacactcactatcctcaatcatgtatactaatggaggaatgggaataattggagccagggattcaacagacattccaaaagcctccacctttcttatatatacaaccttcaccagggtgcttagttacctgctttccaaggtatgagtctctagactttcacctgcaccataggtaggccagaataacttgtataaatgccaagaaagccaagaagagagaaaaggtcatggtaattcagtttgagtagggataccttacttttgttcaactgtgatgctaaaatttccctatttaaaacaaacaaacaaacaaacaaacaaacaaacgagatcaaaaacatagccagggcttcagagttgcaaaactcctgtattctaggtgactggtgccctgggaacatgcatctcagtggccctgtgacagttaacctaatcacagtccacgcttgcccttctgaatacaaagcacacttgactgaggaatctcactcaatatgtgtatgggacacacatttttatgtgtcttctaaagaagacaaatattcttttgaaacagaatatcctgtgagaaaacaagtaatgactggctataaatatggtatggtcaagtaaaaatctttaaactgtgacccaggatttcaggagttggtctggtccctgggtggtttaagaagcaaagccacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagaagcaaagccttccacatcatccttgctttaatcaccactatccatgacatcaccattcaaaccatttatttagtctgttttcaagatcaccacatggcaaatgactgcctacataaacaaaacaatccagttccataagaattctttgcaaatcagacccctggagaaataaaaaagtgtaactgtcatctgaaacatactttaatttctgtaagaggttttataaatgagtgattgactctcattaaaataataaaaagaaaagaatcccacagagagctgcaggaggcatttctgaatctagcagacatggtaaaacaaaatcattatactgctgtcagctcttagctatcagaaattccagtttgaattcagacactgacaggtgggcaagggaaaatagatggtaatctcttaaagagtaaagaccatctctctaagttctcttatcccttatagcagtggctctcaaactttaatgtgcattagaataatctggaagggttttaaaagtacatattgctgggtcgcattcccagagtttctgattcagaaggtccagtgtggggcctaatactttacatatctgaaaagtccccaggtgatgctgttgatccaggagccatattttgagcaccactaccttacagcatagaacacagtattaggtaaatgatacctggccaataaacatttattgatggaattgaattagtattgaaatataacgttttattctccaccttgaatctgaatatgaactgagaggctgttggactaattagatacaagaatacaggtggtgatgacatagcaaggaaaacaaatcaagtgtcatttgcacctcagctttataatggtgacaactatggggcactatggcagtggtaaaatggttaaagtgaatacttttttcattaggaagaaagagtaagatgaaaagtggaagaccaagaatgaaatcttagaaaaaatggcttatatgtggttgacaatagtttctaggatgaggcagccacgggtagatggaggatacagacaatatgtggttcaacagaactgggattgaatctagactgccataatgttagcaggatgattttaggcaaagttactttattcctctgactctccacttccttacctgtgagtggataataatgcctatcatgaaggttagattggcctgagaattgcaatttagagcaatggttctcaaactatagcaggaaaaagcattatctggatattctcgttaaaacataggagctaattaaaacacagattgctggatggtactcccagagattcagattcagtaagtctggggtggggcctgggaacccgcattgttacatcacactaagtagactgcccagtgtatatattaattatatatacattccatactgtcttataattcaggcatttgggctcatagtttacaatcttatgagactgaccctaaagcaagaactgtatcttgttcctcatctcacacataatgcctagcatagtgttttgttacacacacatgtgtatgtgtgtgtttaacatatgttagtagatatacattgcataggcagcaacagcaatacatgtttgttagtccccctgccccaccaccccacccccaggcccctggccaaatctctgccctctaccaatctttttactgtgtggaaatccaactgctgaattccttaaaaaattagctgtttgtcaaattgactctcatgtagtagacagcaacacggaacttattagaatgttcttacagatgagtatgatttgccaacatgcccttaatgaatctgaagctaaagaaaatcagcaagtggaaataaaaagttccattaggtctgtaagcattttccaagcccttttgccagtctcccttcctctgctccagggccttctatcctctggagagccaaaggatcttaaagttctctacatataatagtgggtggcatttgtcaaaacataaagaatgaaaaccagctacatcacaaattaaaccaagaagtcacagcacacttaatgcagtaaggggctggcaaacacgaacactgttgcacattgaatgagtggctttaatgttgaaaaaaaaaaaagggtgttgggggggtcaggattagctggaaaaagagaggccgtgggactggggagctggtggcaaattggtcctttaggatacacaggaaatcgtcagaagttttgtctattagtaagttaaactgcaaagcagaagctcatgaaatgtttactttgatacatcctcctctttcccaatccaccacacgtcctaaatacattcccggaagacaaccccacaatcctaacaggaaagagcccttgaaggtttacagcagacctcaaattcactttcaaaatctccattcttctgggttctctgaaaccagaagcaacaaaacaaagaacaaacaaaacaagaactcttccacctgcttctagaggtccgaggtttgagaggagaactagaagcaacttttccaaccttaagtgtgaacattcagtactggcaccaatgggtttggctgacggtatgtactcctgacagtcttggggtaaacatgtggagagattttaacatttgattaggtttttctctatacttcaagtaacagaacaaatcactttatttctttaatggaatcctctttacagagagaagaaattagatgctttaaaaattagttttcctctgtaccctgaagtccagagttttgatatgaaattttattcaggttgactttttttcttgcaaccttgcaaactagaaaaaaacccaacacacacaactcactaaccagttaaaaagtggtatttaatgaaaagtcaagtccccagattaaaataatccttaaaataacttttaaaagactaccaaagtctggatgagaaagtattcagatctgcacattagttgctaattatgcagggtgggatggaagcttaggagcctttaaatttgatttataaagtttttcttttttttaaagtaaattcacctggagaaaattaaggccatcattctgagttacagtaaaaagctattcagataataatactataataataattacaccaagaagaatacaataattcagatatatagtaataagtcattcagaccctttaatggttggttgagatcattataatactgagtgtggaaccaatttttaaattttctgttaaaattttatttctaaactgaggagaaaggaaaaatgagaagcagtaccagggcttatttgggaacaagtgagccagaggtgaagttctagggtaagcagattttaaatggacaacaagtagtgggtgagggtactgatacctcagcagtaaaaacaaaacaaaacagggtgccaactgataaaataatgacaaagaggcatataatatagttcaaagttcttctgactttggcctcaatgaactccaaatgccatcttgaggatgcctgagaactcctagaaattttgcctttatgtgtcaaaaggaaacatctatttctatcctcctttcgtgctgaacaaaacgtctgctggctcagagagattaagcaagctgctcaaggttataagactagaaccaggtctcatgatgtccactttgtacaagtaactgagagttgggggactagtcatcacagtaatccaggctggaggggaggaggcttgggccagacaggtgtagggcgaatgctgaggaaccaggacaaagctttttcacaacgacatctcagccaggacaaagagtttatttctttaagcctaagatataggggcttttaaatttcttttagggttttgagatttttgaaattagtatgcagcttagaatcaatgttaaaagacaggcagcagaggtgatgtagctctaattgcccatgcatatgccaacacacaaatctcttggaaaaaacagaagcacttcagagcctggagaggttggtgtgactgacccccgtatgagggactggctgcaaggcatgcataacacagaggactaatggagaagtaatgaagttaaggcttaaagggctcaaaatcttctgttaaaagaagacaggatagaccgggcgcggtggctcacacctgtaatcctagcactttgagaggccgagacgggtggatcgcgaggtcaggagatcgagaccattctggctaacacggtgaaacctcgtctccactaaaaatacaaaaaaatagctgggcgtggtggcgagcgcctgtagtcccagctactcgggcagctgaggcaggagaatggcctgaacccgggaggcggagcttgcagtgagccaagatcgcgccactgcactccagcctgggggacagagcaacactccgtctcaaaaaaaaaaaaaaaaaaaaaaaaaaaaaaaaaaaagaagaagacaggataaccacaagtggatatttccagatctctaagtattactagggaagtaatatagagtagtaaaggctttcaatttgggaagatgaaaaagtttgtggagatgggtagtagtcttggttgcataacaatgtgaatgttcttaatgctattaaactgcacagttagcaatagttaaaatgacagattttgtattatatatattttaccacaataaatgaataaatgaaaaaagtgaagtctctggaatcagtcttcttggcttcaaatcttgcctctgatatttcctagctgtgagtccttgggtattgcattaccttctctgtgcttcagttttctcacctcagaatgggaggataacgacatgcacctcggaggtagtgagggttaaatgaattaaatgaattcatatgtgtaaagcacttagcacctagaatgcaataaaagtccaagaaatgctagtggttgttaatggtgttgtaattattagtactgctcttattatgaggtaaagcaattttttaaaaaagttccatcttctttctcttcttcttttcattctctgcaggaggtattaataagaaataaaatagtgaaaatgtgggtaggaggagaaagaaagtaaaacaagggcctgggaaaattaacaccctggaataaccaagaattgcctacatcagccaaacatttaagttttaatctctaagcaaaactgtgcagggtcctcaaccacctgtgaagattttcgaatgtcatgtgcttggccccaacttggactcaccccatctggctgtccagagataaggagcctctcattacacaaacatactcagtgtgtacagagggatcacttgtttttggtattttaggtttatttagaagaagtatagtttttaaaatctaaaaattgtacccttccttccttttaaaattttttttttttttaaattttaacagtgcctttctgccttgattagaagtaaaggtcaacttctatgtgcacatctattggccacttaagagagaaagccctgctaataaatcttggggcaaagggtgtggtttcttgtgtgtggctattgctatgctgcaactcatcacctcgtgcggttaatgaggatgtggttctgcaacttgcacttccatttcaaagccatgcaggccattgatagatctgtatggctcaaagagatgccctatttgttttttatttttattttttcgagacaagatctggctctattgcccaggatggagtgcagtggtgtgtgatcttggcttagtgcaacctccgcctcccacgctcgttatcctcccacctcagcttccagagtagctgggactacaggcacacaccctgtgcctggctaaatcttgtgtttttctattttttgtggagatggggtttcactatattgcccaggctggtctcaaatttgtgagctcaaggtatctgtctgcttcagcctcccaaagtgctgggattacaggtgtgagccactgcgccgagcccctatttgtttcttaagtggtggtttttactcagtgagaggtggtagctaagcatttttatgtattttttttttcttgggtgaagatgctattctaatgtgctctgatttcattttcttgttttcgtttagggcattggcatactttaaagctaccttgctaggccaaggagctgccttctcttagaagggcatcaggaagatggtttttggatgtggtataaagggatggaagaggaggtggagtgggaaacagttaaagtactaaggcaagagtctcctcatggtttctccttgcatggtacttcactcctttacctcccagtagattttattttctaaaatagtagatcaaaaaaatctttaggggctcctcatgacatagaaagtaaatctcaacctcttcagtctggcaccgtagcccacccaccatgtgacacacacctccagtttcctcaaatccctttaccatacccggcacagctgagggcacatgtacctggagcccatcttccccccgcccccatttccccaaccgtcctcctccagcaggaaaactgcctgtgccacccctagtcatatgggtcacattttaaattaatcatttcatacatatgtgatttacctcactaacgaggccagaactccccagactggaggctcataggttgaatccagtccacatgcatgttttgtttggcctacatgatgtttttgaagaatatgaattagttgccagagttttttaaaaatcaggagatgatacatacacacagaaatctggatttctgatttctcttgacaaactggaagctctgacaattctaggccggcacatatggatggttccagtcagctggagttgtgtaatgactgacttcttcaggcatgatgggtccttttcattacagtacagtcccagtcactactctgtcctgcacttggcccccgccttctggctcacaaaccttcctggctcctaacgctgtttgaatcttcaacctctgaactacaccctctacccttggaggatagaaactttgtcttcatctcctcacctcctcagggcctagcacaccattatttaataacaggtgctaaaaaaaaatgcttcctgaatgaaaggaagcaaggctagagtgaagaagcaggggaaagcagtgatgatcacggagatgaggctaaaagcaagccacggacaaggacacaggtgtgaagcatttttcattgtctcaaaaaagatgtcacatggaaggctcgtcccattatagcctcaaatgccagagatttataaagccctttaaggaaaaagaaaattaagaggcattgtattttttaaaggatagcttcccagaaactggacagaaacaacctagagtatctaacaaagctcttcaactccaagtatatgtttctgtatcaacagtgaagttagtcaatctgttctttcttttaaggaaaaccatgaaactttaagctttactttgtagtgctgactaggtaaaagagaaattaccctaaaggtagcctttatttcaagtctatctacaaaatctaaaaagaaaaacactggaagagatggatgttaccaaggaccttttcctgaacttgcaccaaatgccttctccatgctgtccaaactgcccctttgctctcaaatgcaagttaagttagaagatcagaaagaaaaaggttctagaatactaaacacatcactcaactactaaactttattttaaacttcacatatgaaactgtggctccagaagagaagtcatggcttaactcagtgttctaacaaaggaggttatacagcgtcctccttctactgaaaagcctctgagtgggacagtcaggaaaaatgggccctgttgtctgttgatgcttctgggtttgagggtgtaaaatgaagtcagtttgtggtgaggtgcttgggaatttagaggagaaaaaaagcggagagaaacttttctctttgtccaccaaggggatttgtgtttgaaatgaaagttggaggagcaaaagctgagcaaagctttagattggggatgtgagtatctcaagctgccgggacagagaggaggtcatcaatgggaagcttgtagaagcacccaagaacagacttgtgcctcacttaactatgtgtcaacttttctctgcctgccttcagaggtgatctcattttacattccaaagaatgacaatggaaaatcatacccgtttataagcatctgattgtacaaagtttcattctgtaagtaggagcttatcacagtttctaaaatctccaactctgttccgtgccttgaacatagaacagtattcagatgcctcttaattttctgcctgagagaggcagtagggtatagagagtaatagcataggctctagagtcagacagataggagtctcagtcttggttctgccagtcagtaaatgtggagccctaggaaagctaggtaacttccccagccagtttcctcaactgcaaaaagaaaataaaaaattgtgcatattgcctgggattactttgaggcatgagtgggagaatggacacaaacacttagcatagtacctcacagagagtcagcctctaataactagctattttcatcagactctcacgatgtcgaaagatttagacagtcagttagttgggtaaaaggtcatcaggatctttgaggaatacatagaagttggaccggcattgtattcacagttgttaattctaaacaaggatgagggcagtgaccctgttaaaaaaacctagggtttgagtgatttttccagtagcaggggtaggttatgctgagccagccacgctcacatccataccttctgcgaccaaatgcatgcatttatgaaacacccgggcaagcagggggcttctctgcatgaaaccaactgtcccatatggggcctgatcccaaagcattggatttcaaccaactgaactaactggtaacagataaccaaggggacattccctgtttgcaggaggggagcagacttttacagagacatatcacgagaactttaataagacgcagaacacaaaatgcattttagtgttacccaagaacatgtaatgtttcagagtttggagaaaccgcagcaactctgtccattccaatttataagcagattctatagcttgaaaggtctgggcttttattggcctttttccttgatgatataatgagtatttgaaactgacatgcctaaggccgggcaagaagcttggcctagagatcatgtcatctttccttaaagtaacatctcactgctttcctggtttcctgcagaaagattagactcttggagaatagtcacagaatattagaacgggacgggtctttagtcacctagtccactggaggggcagagaagccacgtggcaggcaaagattatacagctaaatcctggctctgccagcaccagagcttctctgactgcaggtccaggactttccattaaaatctcctgccctgagcctgccaatcattagttctcttacagagctaccccaaagttgtgggaaaaatcacttgcccaattcttttttttttgagacagagtctcgctctgttgcccaggctggagtgcagtggtgcgatctcggctcactgcaagctccgcctcccaggttcatgccattctcctgcctcagcctcccgagtagctgggactacaggcgcctgccatcacacccggctaattttttgtatttttagtagagacggggtttcactgtgttagccaggatggtctcgatctcctgacctcgtgatccgcccggcctgccttggcctcccaaagggctgggattacaggcgtgagccaccgcgcccggccccatttttttttttttaatggtctagagctgctacctggttgtgtggcagtccaaagcaataagacatttattgtttccagctgcctagaaactcaacattagctgtgttaattagattatgacaaacttgttaatcacaagcagataaagccagtaagggctagcagcatttctgacctggaggctaaaatgttaatgatatctctagctcaacaagagcagattataaacttttgttatctttgtatcaccaggtagtaagcattcagtcactgaaatttatttattttaatatgaaatcacttttgtttaaaataagtatttctaggctgtaagtttctaaaaagcctcccatagaaatttaaaaagtagatgtaaggtctggaaaatgtaacaatatttatggaaggatgcattggagacttgtcaatttatcagctggaaatgttgtggggaaatcccagagctgagagtcagacttggttcctagccagggtcttgccacaccctcagctggtaataatatttggtaccctaccatttttgtaatgtaaaatgcacctatgtagctttcttctctactccctgccttcccttcccttcaggccccagcttaagaccttggtataccatagcttgcacttttatgctactttgagcaaatatgaatcttcttttacctgtgtcttatttccccaaccagatcaactaggctatccttctctgaatgcctaagattaagcttggactccatacacaagtgttatctataatacaatctatcctatcagaaaaatgagggtactatacagataatctttggactccttgaaggtagttatgaaaaacttcatatctacccttcatattgtggaagagtaatttaatataaacaagaaagaatgtgtacaatattaaaaaatttctgaaatttaaggctagatttttctctagcctatctctcttttctaaattactgggataatcacaaaaattactctcctctcaagaatgtttgactactaaagaacagggaaaggaagagattaaaatataaatgtgaaaatgcacatatcaaaatgctggctgtggtttttaatctaggtggtatagcaatgggtaatttatatttttatctttgcatctttgtatattttccacattcaatgaacacaggctactcttataaactctaaaataaaggtaaagacagtctttagtatttacaaatacttaacgagagacaaatcagtttttttctagcattagacagtgattgtcacagtgtgataacatgtcctaggaatttccgagaagagcatatggccacgtggatcatacagtcaccttgattttctatcgcctggatggactgagtgtgccagtgatgttggggataacagaactaagaggtgttcagtaatgctaaagatactgaggaaagcaagagagacattgttcaggatcctcagtgcttgagatgatactcttgtactggaaatcctatgcatacacgaagaaattgataagagtaggacgaggagaactgggagacctgaattgggataggagctgctgagaatgttctgaagggcagaccacgaggactttggtaagagtctgaggcaggagacttccagaaagacaactgtgacctgacaacaaaatactatgggccaggaggtaaagggtaaagcacggaagcagagatgatcagcaagaaggcccaaaagaggctctgcaagctgggaaagggcattcagaagtttctggaaggaactatgttgtgattaatgaaatccaagcttaacagaataacatgagactaaatttgaaatgacctcatacttctgaacatttcagtttttgcatctgaactcaactgtgacaccagtgatggtgagagagagggggcaaggttacgggatccagaggcattgtgatagaagttgtgcatctcatcccagggcttgagggtattggtgggaactgctaaaagacagtgcagcccagagggaagggaaatcagtgatctgccctcctttgatccagttgtccagcatggtttctttgagccacatctgcaagattattcacgttgtattcccaagtcctgggccaggagtggatagttcaaatgccaacaggggcaggtaggtaacaacataacatgacataacataacataacataacataacataacataacataacataacataacaaaacataacataatataatgaacgaagcaggtcagactggctcatggtgcaggcaagagtacgtgctccacttgacgggacagccactccccagctctggccagctacaagaatgtaggcctaggttttccagatctgagctttcaagaaaagccagatatctcaatttctttgtgaaatttgctattactagcaactaactcatgttctttcaaaaaaccatcaagcaagtcaaagagaacatatcaagagggaagggggaatgtgatgtctcggttagtttgtgacctttgctctgaacctccttcacagtacaatggcaactttggttaaggaagggatttaaacactacatgctatcttgaaagcacacaaatgtttgacccttggccagcttttacaatactagggaagctcaagtggtaaaagatttggaaataatgtagctcttcaaagccttggggagaatattacatacttttaagtaagccgaatgtccagatatacaaagaacaaagtatagaatttgggaagaagtgtgggccagagtcaatgcttggaaacacttggatgcaatttactttgattctagtaggaagctgcatatgaataatggagaacaaaatctggccccagggggcagttttataaaataatacagactcagcatgtgttgtggcagtcactaaagaattgattagttagggtttctgtggctttggatagatttccaggtaagaaagataacacagtgaaaacaaacagaatgctcaagtgtagacccctaaatgctcagagaaatgagagaatgtagtaagattcttactggctgtaccaggttgaatacccattctccccactcccccaaatttatgcacctagcaaaacctgtgaatgtgactatatttggaaatagggtgtttgctgacgtaatcaagttaagatgaggtcaaactggattagggtaggccccaatccagtgactggtgtcctcatgagaagacagaaatttggatacagacacaacgagggaagacaactatgtaaagacagcggcagatttgggagttatgctgccacaagccaaggaatgccaaggactgttggcaagcaccagaagctacaaaaagcaagaaagtattcttccctacggcctttgaaggaagcatagccctgctgacactttgatttcaaacttctagcctctagaactgtgagagtatatattcttgttattataaatcacccaatttgtggtaatctgttatggcagtcctaggaaactgtgtcttttcaagacacttctggggcagaaggcttgctatggtgaattatacaatgacttacaactatgccccaaattggagcaatatatagggtttaagagataaaggcacaggaagcatactgtcaacaaggagcacccttgtttcaggagagaatagaaataagaaataatgactggtaaccaaagggagagcaggcgaacaactccacaggtgatatacagagcatttatcccagggatgaactaaatttcatcttatttaggggaaattatatattacaggttttaaaaattcctgtgaaaaaacaaatcctagaaaataataacaaggcacttaaggatatttacatatttaaaaacaagatcaaatatgaatttatttataactttatcttgtatcatatccagaaagtttaccttatacagtatatactcaaacaactggtttacatgaggttggggaaggtaccttccaccttgcctttgtaaaattttagaatatacttatcttaaaatgtggttatagaaagaaacattgcattaacttacccatggattctcagtgttaatacttgctcctgagctatcttcatgtctcaggccctctttcctatactagcattgaattgctaatgtatgcccaagaaaatggaggacagacttcatcagtttcacttagaggttcagttaataaaaccacaataataacacaaatggtgccataagacccatcctccaactgggtgcactcagttctaataggacatgcacacggatacaccactaccatcaccaccactactacccctcagaccttggaacaaaagttccccctggaattttggtgcagagaagtgaatctctcataaatgtgccattcaataagaaggttattgctctgcattagttttttattcgtttctggactgtgccatgtctgctcatgcaaaactccaatggagtgtattagtatagcccacatatgccatagtcaattacatgtcaagaaaagcttgaactcatttgcctattataagtgtgcatcatggggtcctagtcagttctaaaggaactgaactctcagatcacaaattatgcccattagtagcctaaataacatgtgacaaataacacatatgacataataatatagatcatttaagggtgagttggtaaattgcatgtgtttcttgcttgaaatattttatatttatcacatttatatttatgtataaatacataaaatattttatataatatacttcatattataaacatatattttaataacacatattaataaatatatgacatataaaatatattacattaaattatatacttatactataaaaaatatatataataaaatgtttgtttttagaaatataagccattggcactattcacaatagcaaagacttggaaccaagccaaatgtccaacaatgatcgactagattaagaaaatgtggcacatgtacaccatggaatactatgcagccataaaaaggatgagttcatgtcctttgtagggacatggatgaagctgaaaaccatcattctcagcaaactatcgcaaggacaaaaaaccaaacactgcatgttctcactcataggtgggaaatgaacaatgagaacacatggacataggaaggggaacatcacacaccggggcctgttgtggggtggggggaggggggagggttagcattaggagatatacctaatgttaaatgacgagttaatgagtgcagcacaccaacatggcacatgtatacatatgtaactaacctgcacattgtgcacatgtaccctaaaacttaaaatatatatatataaaaagaaatataagccattggtttatattattaaattttgaaataaaattatttactactctttcagtcttctggattattctaattgcacagcatatattgaggtgggtgtccaaatgagttttaaaaacctgtaacaaaacagaatatcggaaaaaataagaagctggactcacagagaagaattgtgatccatttaaatttctgacttatggaaagggtttcactgatcttaacaactgtctttataataagtatatattattcaaatgatggtttaaaaataaatttatactaataaaatatcacttttatgtgatttctctattgaaggtgggtataagattgtttgcaagaagaaactgctacctaaaacatgtgaaaatagtttggtagagggcattatagagctgacttttggatcaaattcttgaagactcttccacaaggagccacttccatgctcccaaagaatgtgtctcacagagttatcttccaaagttaaagccgctaatttaacaaaacctgggggaggctgggtgcggtggttcatgcctgtaatcccagcactttgggaggtcaaggtgggtggatcacctgaggtcaggagttcgagaccagcctggccaacatggtgaaaccccatctgtactaaaaatacaaaattagccaggcaaggtggcgcacacctgtaatcccagctacttggaggctgaggcaggagaatcgcttgaacctgggagatggaggttgcagtgagcagagattgtaccactgcactccagcctgggcaatagagcgagactctgtctcaaaacaaacaaataaacaaataaacaaacaaattgtgggaatttacagagatgcctctaaaaaaacagaaaatgactatgatctaatttggatcttaccataatcagataagcattctattttagcattaaaacattttataatcaattttaagagatttaaaattttcatactgagcatttcacataaatctaaaaaagatatggctttctctgatattgcccaaactccctctctgtgtaagttcctgactcattagagggcacatttaaaaatcactcagagttataagggaggttaatacagcaccacagtgtcatatttttaagaaggattcttctttttatttattgatctatgaaactgatctaccagaaatgctggtaaataaacaaattttaaaaatttgcccccgaacactaccccatgatgcccttaatagattcattccacaggtgagtctgtgtgattaaaaaagcatgttccttttcacttaggccactaggaagcttagagctaaatagtgattaacttctaataaccgtaaagaaccacacagtatatggtcctttgaacaactcagaagttagggtcactgaccctctgtgcagttgaaaatcgcatataacttttgactccccccaaacttaactactagtagcttactgttgaccagaagccttattgataaaataaaaagtcaattaacaagtattttgtatgttgtatatatattataaacagtagtcttacaataaagtgagctagagaaaagaaaatgttagaagacaatcataaggaagagaaagtacatttactatttgttaagaaaatatatttactattcattattcttcaagtaggctgagaaggaggaggaagaagggttgctcttgctgtctcaggaatggcagaagtcgacagagttcaaaaccatgttgttcaagggtcaacttatttctgtttctcactattatctctggctttatattctaatcacttttattccctcaatgaattattttaattttctgtactgcatatgttttggaagtgaggtataaatagatcaatcaataaaaagaagactccctcttaaaaatatgacactctagtgccatattaacctcccttataatgctgagtgattttttaaaaagctctccccaaattaatccttcatcgactttggtaagttcggtaagaccctagggtttcataacaagctagaagagcaatagtctaacctctaatctttgttgagtatgctcaaacctcaaaaacagatgataaatgaaacaagagaacagtttatttgttaccatgatttattgccacgtttctataatgtagagaagatatgtgttcccaaaggtataacttcaaatagtaaggagagaaggtaaaagaaaaaacaaggaaagagaactgtttgcaattgtcagacacaaatttctacagtttttttccagttaaattcagacatcgactttgtttctggcataaaaattttatgcccttttgtttgctatactcttttattcatataagatgtaatccattaggtttgaaaatagacaattgtgtgtgtggtaactttaattccatgacacaaacaaaagtgcttttccataactgtccaagtccatatttaagcaatcagtctaggccatcatatcaaccttatataattctgcacaacagatttttttttaaagagtaaaatacaattttagaagcagaaagaaaatgtcctaggagaaaaacctagggctagttaggaaaatctggaatcccagtctttgtccatgtacaggggctgagaaacataaaacccacctggacttgattgcttcctttagtgagatgttaacagagtggaaatgattcctgatttggcttttattttccctctctaaatggcagtccaaaaaagtggtgcaagaatcacctggcacctcaattaccatgctcagtttctcccctgacactgtgtggtgggttgtgtcacaataactttgcacccacagatatggcttcagggtgggctctgactgagatggagtgagctccgtgtcacagcttgcctcggttagccacagctgcagggaagagctggctctactcttcctcctctttccccaactcaccccaagcaaatgcttcaagcagctgccatacttgagggctggcagtgccgaaggctctgaaggtctggaaaggggagaaatgaggggcctctgggactaaagcataaccaaattaagggataaacaagtgagttaactttaagtctattgctagttttcctagtaaaataaagacagtggaaggatttggtctggacctatctgtccccttccctgagggctgttcagcagagcttgggacctggtcatttgtggggcaaacagggccagaatgcaggaagacaatgcaagcacaagtggacttggattgtggctgtttggcccctatatgccagcttgcctgggacagtcccttactactaatttaaaccctttcactttcacaagctatggcccagtgtttcttaggagggtatatttacactataggagggacaattcgttctttcatgagtctgctcaactcaccatagaaaatttgcctactaagtgccagaagctacctccatcctatcatttttcgcccaccctgtcattttgacaaccaaaaatgccttccttttttttttcaaatgccttctggggagagcagtgaggcccagacgcacagccactgaatgccctgtcagttaaaagaggaagcagaggctaagagaggtgaaatgatttgattgaggctatagctagacagtggcaggggcattgtttcttgacttcacatacagtgaggcttccagaaggacaaaactctactgtctcttgacagacacctgcagttgaatcactgtttgcggaggcataaactgcagggaaagaatttacatgtggtaataccagtgttttatttgtggccacttaatcattcgcagtcagtagctttatgaccctcgctggtttcagaggttatgaataataatggtattctttaaggaggacatgatactttagtttttttaaacacatagaatttggagttaagtcataaaagctttccagaaaggaagaggagagttgtcattaatttttaaatgcatgaagcttaaagagggatttacaataatagcatcaataaatatgctttggaagcaccttttcttcaaggaattcaaaacctttttttcttctaaaaatgtttaaagatatattgttctcaaaagaagaaaataacaacacttccctccgatagtttttactagtttcacttccttaaaagcatttaatcctgaaaataaccctagaaaggtaggcagagaaagtattatacccattttaccaacaaggaaatttaggttagaaaacttcaatggctaaacatttagcagttttggaccttcaaaacctgaggacaataccctttacattttatcttgaaaactcaagtcgggagcactgttgatagtcaattattatatttacttaaataacagcctctttctccatgatttaggaggaaatattttttccctctacctaattactcatggtcatttgttctgcctaccaacagtagtcctgaaccatggaaaataggaaaactgggttacttggccactcaccactcactgagcacttactatctattaggccctggctgaggtattgaagatacaaaggctaatcagacctggccttatcaggtttgaagggttcaaaaccatcttgagagcattttgagtatttttctcacttctgtcagcgctgacttatttctattacctggagctgagatggccaagtggttggttgtgattttgcccaggccaggtcattccctgtaatgacaacaggacccctcttttgctaacctctctcctcacaaaaacatcaacaacaaccaattgtaacaacaatcccaaatcctggggggagttggggaattctagatttataatctctgtatatacaacaagctctagagataaaactatgatctaccagttaggctactactagtaaacttaaaaaaaaaaaaaggttgtttactttcagtgacaactttgagaaataggtgaacaacctgatacttttaactacattgccaaatataaaaataattctgcaaattctgaatttccctttttaagacatgtctgaggcataaggaggagtggactatctagaattaggaattttcacaactctaaagaagttactggatccaaacgctggaatatcctggccctgatcagtttcaagtattcaggattagattcatagagttatcagtgccctgggaaatttgatgagcctgttattgagaatacagctatttagctgtgaagccttgggggaaaaccaagcagtcatcatgttacaattcctcactattctcttgcctctccataccctttccttaaaaaataaacaaacaaagcaagcatgtggcaaacatgtttccatttttccaccaagaatgcagatgtgacagcttcttccccttcccttctctcatccaccccagctccgcctcctcccccttccccagtgacctcatccctgcgcagaaaggacaccagctgcagggagggtcagactccaccaagtgggatcattatcatcattaggaatgccaagaagcccagaaggccttgctgacatgtgcaatgtgttacagctttctgtggtttccccacattcacagcaaagctgccgtctggaaatgtaaaggctttgccttcctaaaaataatgttaccagaagaatatttagacagatatttctcaacaaatcaatcagtcactgcagcagcaataatgagaacccaccaagatgaagaacctgggggcagcctcagaaatcatttgggtccaaatgtcccatttaagataaatgaagtcccctgatttttcagggggagaattataggaggtgtttgcgagaggagggatgcctgggaattaaaaattacaaaaaaaaaattctaacacagcagcacaatgaaagctaatggttttatctcgattttatacacatattttcacagatttatgttcattcctttattcactcttttccactctcctctttgtcaattagtgctaactcagagaataaggctgtgagattttcctagacatagtaataatggcaattaccatatattgagtgcttactatgagctagatactgtgctatgtgctgtacgcatccctttcaacctctttgcacagctagatcattacttccaagttatagatgcaacaactaaggcttcgagaggtcatattcgcagctttaaatataatctataaactgttatccaatttatatttctagcctacatctcttgtgagcgccagatctgtttttacaattacctgcataccatctccccttggatatatcacaagcatctcagatcaaacatgttccaaactgagcttaggatctagtcctctctacgcccaggctagactctcctctaaatgttcttaacttcaggaaacagcacctcatatcagaaaaatggaagtcatcagagacactactattctgcaatgtcaccaaagcagagagccactagtcctgtcagctctacctcctaaatctgttttggagccattaaccactccattgactgccaccatcatctctcacctgaaaaatggcaccagcctttttcacattggtttccttctctcatctactgtgtgatgaggtacaataatcagagtgatttaaatacaaatcaagtttttacctcattaaaaaaatctttcaatggttactcattgctcttagaaaagaccaagattcttgccagtgcctataaggccctgtataatctggcttcactacctctgtatctttctacttccctctctttcactgggctctagtctagcttgacttttttcagttcctcttttgtctcaagttccttcctgacttgggttcttggagcaagctgtcctttagcctgtgatgctcttgtatactctgtttggctaactcctactcattctttgagcctcagcttacctattgtttcaaaaatagttttcactgccccccttgacagattacccctgtgttacttctttatactatgatgtaaatacttatttaaatatttatttttcactggtttccctaactagaatataaacttcattagggcaaagaccatgtcaatcttgtaaacaactgcatcgcttgtgcccatcacaatgcctggcacatagaagacgctcaatcaaaatttgttaaatgaataaacgaggcaagtaactggctcaaggtcacaggatttgaacccaaatctcaatgtgtcttgttctaaagcacattcccttttaaaatcttgcaaagcaggacagagtttgtcatagaaatatggtatatacacccaatgaactactagctagccttcaaacagaaggaaattctgtccttccaacaacgtggatggaactggaggacatcatgctaagtgaaataagctaggcacagaaagacaagtatgtatgatctcatttctatgtagaatctaaaaagctgatctctattgcactgcataatgactacagttattcaaaataacatactgcatatttcaaaattgctaaaaggatagatttttaatgttcttgtcacaataaaataagttggtgaggtgatggatatgttaactagcttgattgattctttctataatgtatacagagattaaaatatcacattgtatcccctaaatatacacaattttttgtcattttgtaaaaaaagttttaaaaaataaattcaacatatcataatcaccttccagggatgtaaatttctcaagtctccatgtcctaactgactcaaatggatggctagttagatggttaaaaggaataaagtctgggagtatggtaggatggggtggagcctgtctcccacagcaaatgagacataataaatacctactggcctgcaaaagtagtcaaaaatagagaagtgagagtatggatgagggaaaagagaccttagagactgctgagctgctataagcctcaagaaaatgagattcaagaacgaaggaaacaaatatttaatatagctgaaaagaacagagacagagagactttcaaaagacaaaatataatctttcaaaggggaataaaacttactggacatgattttctgcatatattttctcttttccttacttgtatgtacagagagcagataaggcacaacacagtaaagaatgaaatactggatatgcctgaagaaagcctctctgagctttgaggactggggagtacttcttgtcaatttgagacacaggatacttgtctccatcattataattcaaaaaacattccctgctcagggggtctgtcactgatcttcacattgaggtaaagagagatgagcaaagaaggctgtgaccagcacaggctatgttagccctttatccctcttgttctgcgaatgcagtcattttcttccacaaacatgtaggactttacatttttccatgatgaatgtggacttgttacatttgccctagttgtcaaggtctgggaactttggctctattcctctccttcaatccatttttttcttgaactgtcccagcttcccgtaagaagtactcgattgttaggaactttaaaacgtgtatttctcatgttgttgtccctttgtgtggaagaaatggttatagcaactgggttatcagctatgtggcaaaagaaaagaaaaaaaacctgttctctattcctccctcatgttctccataaaaggcaataaaattcttcagtaaatacagtatcatctggcatggttggaattgttctaattatgtactctggttaacaatgtctgaaccatacatggattaccaatttccaaagaattaaaataaaatacacttggtaataaaataatacaagagcctgatatgatttgtctctgattagtcaaaaggtgcacaaagatcttgtagcaccgtgaatcacagtttagagaattttattacatgatggtgctcacaggctagctgacgaaacatcagataacagatttcactgtatctggtattggctggtcacagagccaatgtttttttgttactggctggtcttcttattagaatacaaaaaaaaatcaagtttatattgacatttacagcactaagctctgtgactggatcattctgtttgtttaagaggaatcttacaagcttgtgggctttaaaaaatttcagtggctattgttttcatctactgccacaatttttgccctttgtagatcctttaatatgtaataatgactacatttaaaggtcaaattccagaatttctattaatatgacaatgttttagggatggattacgatccagagcttatggcaaaataaagagaaaggggagcagaagggggcatatatgaaataaaaagggactcagatcatatagctgaagaaagaggaaggaatggcaatggtccctgttctcactgttcctgaggtgcagcctgtgcctttctatcctagttttcagctgtcattatttttttaaatcaaattgtagttggggtcagcatgtgatatactttcatgttgaaagaagaaaaaggtgagataaatcaaggcacaacatgagttatcctttctcctgaattttactgtttaaaagatctctggtaggtctaaaaccatgctacatagacataaaatacctccatttcactcatagccaggatatctgcacttatcccccttccccaaaccaaatacatacaagtaattctattttcttggtaaggcaattgttgattaatgaatcatctttcctgtaatttttatttttattttttttgtagccttagtttggctaagttccctggcattcctgttgaagtgtgtaatggaaaatttgacctcacattctttgcttttttgtaacatcacaaaacactgatataacagggctactaaaaagtagcttggagatgaagggatgcacataaagaaaaagctcagtgtggaaaggaacaaagacgcagtaaatcatgtggaaggtaaatatttagcttcacagacctgaagttacattcatcttcaagtgcttacagcttaggatgtcatagagtttccatcataattttgcttttctaaagagattacaaaccagccataaaaagccattctcaaaattaacttggaacacaggtaggccattttgtagattccatagcttgtttgaaaaatggtgatttagggtggggcaggcagaagaaaggtgtcaggaagtgatttcttgcatttagctatatctgagctgaaataaaactttggcagtcacccttctgtgatcacatccaactgtctaaggaaaatgtaacaggtcatacagagtcaactttggttaactgtaaagcgtgggatttggcagcaaagacatacttcaggacagatttttcagcaaaattcatagtggaatacatgaactcgttataaaaacctttttctttttaaaatgagactctcttccctaaggcaaagaaaccattttttcaaatgcataatccaggctcaagggacatctacccagccactgacaaagtttctccctttgcagccctaatgatcctacaacctgagaaaatgtcaacttggctgtgatgggaaaagagtcccacatggctcccagcaccaccctctcaaaatgtcacaacctcttggcataggacatcctgttcagcctgtaatagtcattcaaatgaagtgtttcatgataacaacactggcttatgtgtgtattgtcaaccaagaccgtcctaaaggctgtcagaatgcatatataagggcctgttcagtctattaatcatctagatgtgctgaaaaaaggaaggggggaaaaagcagatgcagagaagtctgtacaaatcactactagttactcaggctgctgggaaaatgtgcagatgtttcttgatgctacctaaactgtttctaaaaccacggtcacatctgtgtactcatctatattaaaatggaatgctattatctggaactatacaaatgattctcggggagagaactttaatatactgtttatggcctggataaatagtatttatttgaataattaatactttttttaaaagagggagttagatgagaattatgcaaatgaaatatgcaaataagccacaagagagaactctttgtttaatcttatgttgtaagtggtaagagatggttacctgttccagagattgtcttaggttcctacttctcactggcttttgtgggtgcaggaagaaaaaaaaatattcagacagcttggattgattcatgtatccaattataaaatgcaggtagatagatcaagaaagttgttaactatgaggccaggcacggtggctcatgcctgtaatcccagcattttggaaggccaaggtgggcggatgatgaggtcaagagatcgagaccatcctggctaacacagtgaaaccccatctctactaaaaatacaaaaaattagccgggcatggtggcgggcgtctgtagtcccagctactcgggaggctgaggcaggagaatggtgtgaacctgggaggtggaggttgcagtgagccgagatcatgccactgcactccagcctgggcaacagaacaagactccatctcaaaaaaaaaaaaaaagaagaaagtcgttaactgtgaagaaaaccactggggggaattaccacatgccatttaatatctaatttaagggaagcactgagatcttggatgaaaaattacttggtgatatactgaaatatcaactctagggacaatgcttttctagattcttctggattcctaaaaatttcctagatcttatttggtatctggcttttccaaggtactcctggtatcccgcatattataagactgaatcttacactatctaatttgaaataaattttactgttttcctttccattaagtattaaaccaagttggtatttttgtagaactccactgaaatctttatactgtgaaatctttatactacatactgtgaaatataatcatagattatatttcatctgctctttgatattcctgtagcaggtgagtcttggctgtacttcttatgtacttcataggctgtactactgtgatcaagaacacttagaaaaggttgctcagttttttgaggtcaagttaataagtaaagcagactaactgaattagataaaatgcataatggttttcaccactacagtgaaaggtctgggaatgtctctgtgtttgatgaactattattagatgatgataatttcaataccaatacaacactggtgaaagcataatttcctattctttttataagcattaaatttaggagtttttccaacatctgttattgctgaattaatgcaaaattattgtctcccaacacaaaattcttatttccttaggcaagcaatattgtgtgtgcatttttcaaagacgttttatacatatgcagacaaacatgtacgttcattctttcttctttttattacatgcaaaaggtagcatacgatatagacaatatgttctgtactgtgccttttggacttaacaatacatctgggagatcctgctgtatcagtacataaggagcagctgggcaccgtggcttggcacctgtaatctcagctacttgggaggctgaggtgggaggatcgcttgagcccaggagtttgaggctactatgtaggacatggactgagatcgtgtcctttaaaaagaaagaaacaaacaaaacccataaatagctttccagtttttgttatggaagcatagtattggataaatgaataatcctatttacttccagtccctacaaaagtacatttaggttatttccaatcttttgcaattacaatgtttgttaattttgaaattaaaccgaacagtcaataagaaactacaactgactgagtagtattgcctgtttccgctccctactcgaattctctataagcaaaaaaatggtgaaaaaagaaataatttggctaatcagcttttggataattcaatatcttatttttctatctgttgccagttaagcaattttttttggatgggctcaaaataatagactcattacttcattacttttcttattatttctgtaagagttatattttaatgagaagaaaagagaggccgggcgtggtggctcacgcctgtaatcacagcactttgggaggccagggcagctggatcacctgaagtcaggagttcaagaccagcctggccagtatggtgaaactctgtctctactaaaaatacaaaaattagctggacatggtggcaggtgcctgtaatcccagctactcgggaggctgaggcaaggagaattgcttgaacccaggaggcagaggttgcagtgagccgagattgtgccactgcactccacctgggcgacagagcgagatttgagactctgttccctccccccccaaaaaaaaaaaaaaaaagaaaagcgattaaaaaggaaaacctaagcgattcagagccagttagtgtggctgtaaagctactcaggtaattgtgaggaagaaattagtagagctttagttttttaaaggtcttaatctgtactggaggtcaagttatcatcactgtcattttcctcaaaaacatttaaacattcacttatacacagctttatgcaatgagcttcccaaagcaagcaagatgcatagagaaacttatcaggacagagctaaaacaaatgtaggtgtgcctcaatttacagaaggggatatgggacactatttctatgttatttatacattttatgatttgaacataaagattgctaaaaggatttctgtagcaactttgttgggagacaaaaattttgtattcctcagtttatcttagggtatgattttcagatttctatatgttgcgctggctttatttaaagtgaagataacaatgtgcgtgtgtgtgtgtgtgtctgtttgctttgttttaatcttttgttaaattttaaaataacttcaaacttaaaatttgcaagaatactacaaaaaatcttttacccttcacccatattcaccagttattaaaatttttaccacttttgcattttattctctttctacatatacacacatttgtttttctaaaccatctgagtaagttgcagacatcatgtccctttgcctctaaatattacaatgtattttcctaagaataaagaaattcacttactccacaatgatcaaaatcaggaaatgtatataagcacaacattatgtttcatccccacattttattcaaattttaccaattgtcccaatactgttctgtttgcatttcctcccccgatccaggatccaaatgaaagaacccacacatttagtttttatgtctctttggtttcttttaatctgaaatggctcagctttatttatgtgtttcaggatactaacatttttgaagagtatcttttagtttaggtttgtctgatatttccttaatattaaattaattatgcatatttggggcaggaataccacagaaataacgtatctttctcactgcgtaatatcaagaagcacaagatgtcaatttgttctactattgatgatggtaactttgatcacttggttaaagtgtcactaccaggcttctctactccaaaactactatttcccatgattattaataagtaatttgtggaaaattctttgagatatgtaaatatcctgttcctcactgaacttttaaaaaattgtttcagcagccattgatacttcttaactatttgcaactatgatggctgcaaaatggtggttttctaatctatatttcttctacatttattagtaggcattctactgtaaagaataacttttctttcttacacatgtagtatctacctattatcaccatgaacaaactcatgaattcttattttattcaatgggtcaccttccattttataattatttcgctcttcaggttgtttcagattaggccagtggcagtcctttcaagccaactctggtgtccttttgacatgtcctcatcattttttgagacttcctaacatcgtggcatgaaaagatgttccaggctcatcttttttttcctccaacagccctgcagtcagctacttctccaagaaggctttgttcctcttagtgggaaatgagatgtagaagctttatgtgttgcatgtgttcattgctacaaggtgtcattgattctagacctttttagttgacagagctaggaaatttttcatgccttagaagaccttcctaaaagtggatttaggaactactataccataattccttttatattaagtttatgcaatgtatagagatggtacaggggtttttagttttgggttctatgttacaatggacttataattacactgactactagtaaacattattatcccagaagaatctgatgagatccctgagaataaggactatgtctcattcatctttttatcctcagagcccaacaaagttcaaatcacataatagaccatccatagaaattacatgtatgtgatttgctttcaaagaatccaatgtgggggaaaggaataaagatgtaacaaagttggccatgagttgatgactgctatagctcgtgatgagcacatggggattctttcttttccatttctctctacatttgaatttttctattacaataaaataaatttaaaggtaatcaagaaatacccctatatcagaatgataaaagtttctgcctcttctatggttcaatttctttaacagtttggtggggtgaaaaaggtcaaagtgtttgattactgggaaccagagggcattaaaaaattcaagtaaataattcagctgtgtgcagtgtctcacgcctgtaattgcagcactttgggaggctgaggcgggtggatcaggagttcgagaccagcctggccaacatggtgaaaccctgtctctactaaaaataccaaattagctgggcgtggtggcatgcgcctgtagtcccagctactccggaggctgaggcaggagaattgcttgaacccaggaggcgggggttgcagtgagccaagattgtgccattgaactccagcctgggtgacagagtgagactgtgtctcaaataataataataatactaataatttaaggaggaatatgcgcacagcatggacattcatttatgaatttaattgtttaaaatacatttggttcaagggacttgaaaatgtagatggctttcatcatcaaattgctaataatcctagaaagcacaaacttgaaacacatacaatttggataacaatttcgaatatacatttatgataacagatcaaccctaaaaaataacataagataaacaggtcttcaagctatctggagagaaccccctagcattttgctgactacatggagatagcaaaatggcttttttcttgacatcccaagttgttttttgatacttaaacaactgatagtcaaaacattaaaataggaaagtggactactgcagtgattgagatattctactgagaaaaaacaccacaaacaaatatattcgtatgtatataccgtttactgatcagagtggatattctcctaaggctgcatatttcatagaaagtctaggtttaaagcatgcccctccttcccattaggaaaactgacactaatattctttatcaacattatttcaagcaggtgtactttgaactctgagggttccccatcataaatctaaactcactgtcttacctaaatactagacatttgctatcagattaaaagtgtctgcttagttttactgataaggaagcatgtttaaatgaccaaaagcagccaattcagatgggatttgaggccccaaataatttcctctattatttaggcaacacaaagaaccttttggattactggaacgaagtggctaccttttaaccaatgttgattcaaaaagtgcattccttactaaagccagtgtgaaaatgctagtgaattctttccattacatctggccataatcagaatgctaacattctgcagcctgcacattgtaaataaatacagaccaaataacttcttactgctgccatgagtgtacattttctccagacaataagtggtacattagcacatatttgtcccctggctgcagctttttccccccattctgagttcctggatatacttttgagacagtctagaaaaaccagtcttgtgctacacagagatcaggaactttccccacaatggaatttagtgtccataatcaccaacatccagtcttgtcaatttcaatggatgatgatgcaaattacttcttttcttaagtgtattaacgggtcactaatgtaagcaaaataacgcatggcgggttgaataatagcaccatgtttcttcaatcaaataaccatactgtgtgtctggttgtggtttcaaagaaatctggattaaataatatgattcatatataaaaaggctggctaagaactggattttggtactgctcagttatacataaaacagtcacttttgtactagatgttcacttaggaaaataatattgtttcctctgagacaggtatactggatacttgacctctaaatcctaaaaacaattcatggaaagaataaaatttagaggagcaagaacagggctgagtcaccacatattttcaatatatcaggtttttttttaaaatcaattctgaattgtcaaagaggcactttctgaacttattaagctttttaatttcctactgaccatttaaaaagctcccgtcctaatatctgcttttcaggctactttccagggtaagaatttaagagtgcagttgaggggcagtacatgatttggtgcaggcaagttaacacagagtccaactttaagaatcctggtcttgaagacagtgtttgcttaagttttacaatgttacaaacattagtcaagaccttcaagaagataacacaaagctctaggagctgtgattttcaaaggggatttgggaatgagggtttgatggaagccttccagagctgcagctgctgagcttgtgggttttccattggctgccactcgatagaggtgaggcaggaggaagaattctttgagggcaagttcagacagtgaatagttcaaggatgcagcctgcctggaaattgcaagcagtcaatggacacataaaccacaaatgttacaaggcacaattagtttgattttttctaaggttttaaggggccaaaataattccattaccatacagtaaccacagagtaaaattaatatttataaagtaatgctatccagcaatatagttgaagatagttttcctgaattcttttttttttttggttaccatgtctcatcaatggtaacagtagagtggaaaccacactaactttcatgtgagggggatatggattgcagtttggccctggtacttggtgtttgtgtgactgaacttcagcatcattttcaacaggagaataatacctaccttgcaggcttgttgcagggaataaatgtaataatgtatgttaggtggcagcaaatagtagcagctcaaaaaatagttaattatgttatcattgtcataagtgtcataattaatggtcctttgttacacacaactgcattaccatttatgcaattgttataagtgagttacctacaaagcaacaaaagctgtattcaactgcccataaattattcatactattttaaaaaatgtttctttatggttttacatttacaggttctttttattttaaagttcgtcaatatagcctttatgtcaaaaaatagagatttttatgtgttcttgtgatacaaaatgcattttctgtgagctttacaatgttatgaatcagtttttgcgaaaggggaattcggctagctgtctcctctctgcctcagacagacttcacaatgattcacagataacagaaaccaccagctgccattccgaataaaatgttctgttggctctgcataccttatggcaagctctaagtcacatgtcctcttcttatttccacttttcttctctaaagccagctataacctgcatttcataaatcttaagagagtaaatcaaaataaccaatctggaatttgacctagtaccaactaagattacctaaaacagaatcaagggccaacgcatccatctgctctctctgaaagaggcatacatatcaataatttcctctaccacatttaaataattgtctttcaagtatcatattttactccatgttttaacacctacaatcttcctcatgtttcattatttattcccatagggcagggtttagcaaactatggctaatgggctagatctggtctgtagcctgtctttatataatctgaaagcataatttttacatttttaaacagctgaaaaaattaaaaattaggatttttcatgatgcatgaaaaatacataaaattcaaatttaactgtccaaaatatagttttatggaaacacagccatgctcattaatttatgtattgtctttggctgattttgacctagtttagtagttactacacagaccatatggccagcaaggcctaaaatatttcctatttttgcttttacaaaaaagtctgttgacactgccctagtggggtgtttccctttggagaaagtgaggcaaataaacgtaaaatacaaggtcctccctccctgtctttgccttcttgtcgtagatcctcagccttagaaggaaaattggcttagcttgacttttccttgaggggagagaatgcgttagttaaaaaaaaagaacacaggaggagccaagggatgcgggtctcaggtcttgtttgggtgttgggtttttatgctcagtttggacaattacttttctagttctgtaacgtggcttcttccttgttgcgctctgaatttcctttatatttgaaaaaaggaatccttcactcacttactagatcaccatgatgataatgtgaaccctaccaccaactccttcctcactccacttcccaaatcaatccaggatgagtggaaacgagggtaacaggaactttggaaacatttctattggactgctagatgaaagtttaaaacctactgttttaaacctatggagataggcctccattgtgaccacataactaatacaatgaatagctcatcctgatttccactagagaatggggtactttgggcatatgagactgaatcacttgttttctggaaattccctattataaatatgacatttaagtacatagtctaaaaatgctgatgtctaggaaaatatgttctaaattatagcagaaaaaaatagaatctgacagctggacaaaggaataaaggcagaatgggcaaagatcattttatgttaggaagagagtaacagagatgtttatattcacacagatattatcaggtggtaaatatatttctcatcagacttcatatctcatagattttatattataatgcaaatctatatatttttcattcttaagccaagaatatctatatagttgcacagtaaagaaaattttaccacagtgcactttaaaaaccacttataccttattaggttataaattgaccaaagcttttgccataccacatccttgctacagggagggaaaacggattgatttcactgcaccaatctcccttttgctaactatatagctgatttgtgtttatatggtagaggaaaagcagcagttattggatactggtttaatgtagaaggttaaattagttgtggggacaatgattactcatgattccaaatggtgaactgaacttggagtcttagcctgcttttttagtcacactgcattactaagcaactttggaacaggtgctctcaacgggaaaacaggttctgagaaaagactagagtagatgagacatgcatgaatgagaatgagcaataatgccttaagtagggaggacgaatcattaccctattacaaatatgatgaaaattatcaatactcattacaattagagttggaaaagctcttagaggacaatgagtccaagtttctttcatggaaaaccaacacgcatgccagggagccactgtctagttttggcctgatcactgacttctggtggcatagatccctttctcatccaagccagctcttttccttttggtacaactccaatactatacagtcaaaatgcccaaaaagagtagagaaaataatattaaactagaaaataggagttccaaattccaatttcagtcctatggttaactctagttgtgtgactttaggcaagtgtttggtgctcgttgggtctccgtttccttatctgtaaaacaagggttttaaggtcctttccagttctgattttcttcatttctatactttccattccatgctagagaaatgtgaagcagttgtgagaaagttacaaacagctgtgaagtttttcttcttagagtcctcactcatgtcacacctgggctgcttctaaacgttccaagatctcttggtctttatctcagctttccagatgacatatagtttgattttattttgactgttgacatctcctagaatgttatcatgactcagaatctgcccttttggtcactatatagcgtagtgacaggctcagctacaaaagccctcttagtagcagtttgtctagcagaattttgaagttgctggtttttattttaaaaaagaaaccatcagaaatgttgtactgttctcacacacttaagtcttattctatcttctatggaatgtcagtaaactgctcagtatttgcttttttattttagtgattagactatttaggctggaataaaccttaagctcaaagaaaagctatgtctttaataaactccaattaatgcacactggtatggtctatgtatatataggctatatttttagaaacaaaaccactatttaatgtgatagtaacttggcaaaggttgcaaatgcaacagtaaaatgaatgactatttagctttttatttatgtaactaaagtggatacaattaagaagactgtgcctaggggacttgactttattgaacaattatcataatcaaaatcaatagtgttatgtgactaaaacaaagcttttctgtacaaataagtaaatttatttttgtaatatattttaaaattaattttaatattttatttatacatgtgaaaataaaaaataattctttttagacaaataaatctgaaaaatttttaaagtttttatttacttattttttaaagacgaggtcttgctatgttgcccaggctggcttggaactcctgagctcaagcaatccttctgcctcagctcccagggtagcttgggacaataggcatgcaccaccattccaggctcaaaaaaattttttttaaagaaaaataattgaattgagtttaggtgctcaagtaactgctcaagtaacggactgacgagcttgtaaaacatcaacaggatatatatgtatatgtttatgtttatatgtgtgtgtgtgtctttgtgtgtgttacacacctcagtaaaaaggtgtattgaaacacatcaccattgaatagttcacagtaatgagtttggagtctagtacagttggtgtgatagcttatcagagtcaactcttcttaagaaaacaagaactgactcttggaaatgtgctattatcattgacaaggaactagagattattttctaactggataaattatcataaatacttccatcaatggaaaaaaatgctattccattattgtctcttttagccttatatttataatttacatgtatttattaagtgcctactaggtaaatacatattatttttaaaaaataatgaaaaattttgtaattagtaataaaatatattacctcagtctttgctaaggcctattctccaacgtgaattaaatcatactccatctgtaagaatgaatattaaacttacaaggaacaacagaaaaaccaccttagcagaaaggccaaacaaccaccagctgttgcctggaatatagcaataacctcctaaatgcttatcttgaatccagtactggaagaagagtcaaaagtagtaaaggttaagggctaagtaagaacaaaggctgaaaaatgacagcctgggtttgataggttagctgtgtgacttcaggcaaattacttagcttcagtgtgtctgagtttcctcatctgcaaaactgggataatgatatcatttaactcaatggaatgatgtaagaattaactaaaataatctgtataaagcaattagcatgctgcctggcattagtgtttaataaatgttagttgcatttgctttgtcattattattattcgtctcctaaattcccagaatagccagagtaaaatttaatcaatataaatccaaccccatcatttcagtacttagaaattctttaacagcttcccattggacctaacaacagcattcaaactccttaccatggtctgcaagatttggccctgtctactctccaacatcttttctgaccactttccctctcactcccaactctagtttcacttgttctcttcctaagcatcatgggtatttttacacctgtctttacacatgcttttccctctgagataatcttcctctgacttattgcttgcccagttctaaactctgtgttgcagaaagcaagtcaaactgttcaaatgtgtgctaccttcagagatttgaaagttcactcaggaggctgaaataattcacacaacattttccatattctaaacagcaataccttgggaaaaacaatgttgaggcacaaaacaataagcatgtatcgaagttgagcagggtggaagtaggagggtacatgtgggaatggaagggaagaactcatctgtggtttcctgagcagggcaggcatcatgatgcattcataaagtctgttcccaagctacaaggagctgctggagaagcactcattcttctttttgactctaggccaaaagaagtacagcccaggtttggcctattgaagagttttatttggcccaaagttaaaaaaattgtttttaagattcattcattcatcaaacatttattgaacacctaccatgtgtgaggctcatttccagatgtaaacagcagtgaacaaatacacaaaatcatataaagtccctatccacgtggaatctacattctagtgcagaaaacaggtaataaaaaattgatggagtgtactagaccatatgtgataaggagaaacaaaaagcagagaaggtggagaggaaggatgtgtgtattcatgtgtgtaagtttagatagcgtgtccaaggcaggtttcactgagaagatgacatttaagcaaagggatgcaggggatgaatgggccgtagagatacctggaaaaatagggaacagcaaggacaaaggtcacaaggaggaaatgagctggcatatgtgaggaacagacaggaggccaatgtagctgcagagatgaggtcggagagtcttatgggttattgggaggatcttggctttcatgctgagtaagatgcggagactttggaggattgtgggcagtggggcgatgtgatctgacttacagttctggctgcaggagagaaagaatggaagcagtgagaccagttaggaggctactgcaacaatcttggagagagacggtggtggtttggaccacagtagtgcaacagaaatccgtaagaagtgatcagattctgaatatattttgaggatagagccaacaggatttcctgatgaattagatgtgggttttgaaaggaagacaggagtgaaggacaactccaagttttctgctttgaacaagtagaagaaaagagttgccaacatttaaaatcaggagatttaatttaataatccagacttccagctcctctcaaaatactggaagatctggtcaactacataactgcatttttcacatgataaaaaatgaacaggagctgagaagcagttgccccatcgagacaagacactggccctttggttcactatcgaccttgctccttgttttatgtctggccttctgaataataaatagctgtccgtgcctgtctgtttcctgcagacagcttgagtttaggatccctgcccaaagttctaccatatactcatggcagcaaaaatataacataaatttgcccacaattttgactaaacgaagggcatttttgacaaagtattttaaaacaggccataaaaaggatacctgctacagcctactcttccagatttctcctctatggcaatttgacagcatcctgatacagaggtccagcctcgtccagcctcgtggtaaaaagaaaagcttcttgaaaaaaactcctctttcacatattctgatttcattaagtctaaatcccaagactcaggtcatagtctgtgtccatattgcctgggagcgaggtaaggtacttgaccataccagctctaataccacatctcactacacctgtgctttccaaacaagggagctccgaggcccaggctggtaccaaggcaaactggctctaagcctgtgttatcaccaccaagcctggtaaccggcaaattatttatcttccctgggcttaccaacaaaaaatggaggtcgactacagcagagcttctcaaactctaatgtatatgtgaatcccctattctagatgattatttagcttcacttacatgaaaatcactggcttagaataaagtgcctggtaacaatgtctctgtggacgacctggtatgtttctcctcagcaaacagaaataacatgaacccaaagacttgtttcactttgtctaccaggaagctcagagctaaatgcactgctcaatataacagcaaagccatcttacctcagggattcgagtataacatctttccccgttccttcgtattcatcctaatggttttgattttatttatctattttaaccctaggcaacatcaaatcctttctgaaagtgggtggggaaggaagacaacactggaaggaaggaagagaagaaggaaagtgatttaaaaaaaatcttcccaagttggtattaggaaagttagcaaatacggtttgtgaatgtgatcaaataaatacaaacctaatcatctggctcaaacccaaaagcagttttgtttcagaggcctgtgccctttagaccaacaaaaatagccacaaacagtatggggctgtgtagtggcaagaaggacgagccctactataggcataggaaaattcttccactcagcctttctctcttttagctaagtatggtcattgacagaattgggaaatcttacggcctcgattaactccctacaataacaaagagtctgttttattatcaggaagaattcaaagaaaaatgcgtgttaattagtaacacaaaaactatgggtaaagtaagcatcaagacagatattttgtggtaataaatcaagctcgataaacttgcattttttacctttggcagcagtcagacaagcacattaaaagcccaggatatcagtcctgctctggtgccctgatagcttgaaagtcaggatagcctgcttggctacgaatgtttctgaccttgggcaagccttgtaaccaccctggaccccctccataaaatgaagacagtgtggagagcacagattcagaagcctccgtaactgagctccacttaaccaattctatccctgtgtttcaaccaggactgagcccacacatgctgaataagagaggctagaaggtcactcactagtatatcccatgcatttcttccaactgtttagaggtgtatttgttctcaaacctgcctatgcctgttggatttgttactataattacataatttaatatgatgtaaactggtgaaatataaccatgaaagaaaacagttgcttcctatgaaaggtacattgaatagtctaaggagacctgataaaggcaggtgacttaaactgactctcagggcagatgtaaatcagacaattgtggaagacaggaaaacaatttgtaaaaatctagaaggattccttctacagtctgctctataggggccaaaatttaacaaaattgaaatgagaaatcatagaaaatgcaatcactaaggtataattaacatgagaaaaatgttaggaaattgtaatcggcaaacctataatcaaagaaaaggccttggctctacaccaaggcttctactgcaatgggaaagggagtaagaaccatggtgaaatattacagaggccccatggctgttatttacaaccagatgaaataggcgaccatgacactgaaagacctttccaggaaggagctgaagacggagtgtggaagatgtagttagagttgtgggaggaagggacacacagacactactcttgatagtctggcatatccttgccagtctgtcagctgaagggggagtgaacccacttctactgagaatcataggttggtatttactaagttcccaggaagtaaagatttctttaactgctagcatttttcttctactcctctctccccagttttaaaaatgtttgctaaaattatttgatgagtaatactatatgttgagtttacctgggcaatgagcactgtgaaggagaacatagtatgctttgctttcctgagagtaagacatgcagagcaggagtagttctaggtagaaatactagtttgcaatggcgagaccaggcctgtaattttctgcagcataccatgacatacatcatggtttatatgaggccaactccataaatcaagccttacctaattagagattcttctggagatctacattattagagcaaataattaaaacagcccaagcaaaaataaaagccagatctgtttacaaaaatgttctctccccccaagaaactgttttagtctcataccacttacagttctttcacatttagtaaattatagactcggagcatttctttttagtctgacttcactttcaaggaattcttcaattaactttacgttgctttaagctgttcatccaacgagaaaacaatctgtggtttctgactcctttgtgtgccaatggctgccatccatgtttgactttcagacacactgtctcttgagagccaggctctgtttgcataaaaccagtcagttgtcatagcattttgacaagcactatggaaaaacaaagaacaatacttcgtggtggctaaactgggagaattatctctgtaagggttactgcattggggatacacacaacgtccatctacacccagccacctggtctgggccagaaggtagcacatactccactttcagctgtgatctttccattctcaggcaccatctctttactactgattcatttctttctccctcccctctttttcctaaatggttaaaacacctgaaactcatggagaggtgtggctactctaacagcaggcaaaaatgtcagtagaaatctaaaaagcaagagattgcatggcctttgcaatggttatggtgcatctagtgtcagatcttcagccaaatgtagtgtaataaaaaagcatggctcagaggtgaaacctcagtccaaaactttgaatattctgactctagtgtaggacctcaactctctttgcctcttgaggcccatgcactgatgtttttaaataagtacaaataacaactgggcagcagaaaataaccatgggaacaaatgatggaaacatatgatgactgctgaagaaaaagaaccttaggttttctacctatcccagctgagtcaggcagaatggaatctccctctttcttttcccctgtgcttggccagtttctgggtatccctcatctatgtccattccatgaatgtacttgtgaagccaaaagaataataaaccaagggtgtctgaaactgtctttgaatactcaggtccaatataagatatatgtgtgatttttccaaaatcatgctcaatgctgtttctgtaatgggatgtgcaattgttgaactgcaggcctttccaaagaaatggaatgaatactgtagcagagttgtgccgtaacaagcatgaaggcagagacagtggaactagaatgaatgcacaggccaggtgaagcccaagggctgatattggacatggcactggctcaacttagggtggtggtggagtggaggaccaatggaaggtctgctccttttcttcaggacagaactgtgtttgacgtttgacatctctctcaatgctactgcaattgcatctgaagcaaaaaacttgcaggattcccaagagactcaacattattctaatatcatttcttttccaagggcttccctctatttttatttaaaattttaaaaatccctatgtaaattttataatgtgtgttggttacaagctactgcaaatgctttatggaaaaaggaaatgggtataactatgtctgtcttggtgcccccctcatatctctctctctctctctctctctctctctctctcacacacacacacacacacacacacacacacacacacacacacacaatgggatctagcatccaagctattctaagaacagtttcataaagtatcagctattcttcctttaaccagcaaatcactgttctattgaattataatctattctttaatcatttaggggatatctaaagcacctagaagttcctagaatgcaagttaagggtaggctgaggaaggggaggttccctttacaaagctttcactggcatctgaatttagatcttttgagattttaaaaatataagcaaccaagacacttgatttaaaattcactgatttgttcaaagtagtgctctatggagggccagtgatcttctaaaatggggtcacagtacagactttgcttcaaattcaagagctcacgatagctcctttcttgactctgttctttctggcactcagatttttgaagtaaaacaaaacattacaggaattttctctacaaggagacttctgaaattccgggaagggttcctcctctcccaaagtgtcttgcttaatgctgtgcatcataagcttatttcttgaaataaaaatgctgagatgctgaacttggaaggcagcaataaaccaagggggataaagttgagggcacaaaaacctgagcctcactttttaacaactccaaagaagaatgaacttattatatataaggagagctctatagggtgtcactagaaattcagctacttccaatggttttgcttgcatgcctggaaaagcagtgacactggcacaagtgtgttctatgtgagagcagtaagctggggaattttgcgtcaggatttgaggtcttaggcaattgaccggccttgaaaagtacagcacactggcactaagaaaatgcaaaattaggctaggcgtggtggctcacgcctgtaatcctagcactttgcgaggccaaggcgggcagatcacaaggtcaagagatcaggaccatctggccaacatggtgaaaccctgtccctactaaaaatacaaaaattagctgggcatgatggcgcatgcctgtagtcccagctacttgggagactaaggcaggagaatcacttgaacctgggaggcagaggttgcagtgagctgagatcgtgccactgtactccaaacctggcaacagagcaagactctgtctcaaaaaaaaaaaaaaaaaaaaaaaaagctaattattcattactttctaaaaaatagttcttagtaagttaatagtaacatgtatactcgctttgcaatttttaaatgaaatcactaaaaataaacactttttaagaactttaagactattttaaaaatgttatcaattattattcattttcaatctgctgctattccttttagcttatggcaaaagatataacccaattgcagtcctcaaaacagaatggccaaagcaatgctaagtctcgcaagccctacctgaggccttcaaaacgattagagcctaaatgaatcaattctgtctaggctgacagcatgtattttcttttggaagttcagtgactacagagggaatattttggctttctagtgcaaacatgtacagattttgaacttggggaacttgcaacttctggttgtaaagttgtcttctactaagaaaccatggcaccaagtcctaaatgcgagaatacagcttttagaaaatctgcaaatgatttatttgcagaatagtgaagtaaattgcaaagaattatgtgaaacagaaagagggtgtgggagcaataaaataaatgaagatacaaggcttttaaaaggttacatggggaaatgaagacattaaatgccacttaattttagaaaataaaattacaaggtatatgatatgctagcaaagttctggattatagtaaggctttccagggaacaagaaagcttgtatggctactacccagggtaattactgaatcagtgatattactcagaaaataaaattgcacataatacacacagagcttttaagccagtttccttgtgccacattcccccctgccctcaatctcattctagccacttcctttaagtgaaaaaaagagtcactgtagctttctggaattctcttccatacatgccaagtacattaaaaaaatgaaaataagtcatgaagttggatgacaatatgatgaaaaattatcttactccttaattttgctgtaatagtttgaaagatgatagttctgtagaatgtgaatcgcagtcttacacaaacatacatcagcatacattcatactgtttaaaaagagaagagttttacatagaaaaggaatggaaagacagtcaacagcaatagtcaagatatctagaaataattttagaggaaaaaagtatctactactgtctttaaatacattaaaatagaacaattttacgtatttacttttctcttttaaaaaattactttaaaaatctttttagaaattaaatcactaaaaataaatttttaaagaactttaagattattttttaaatgtcatcacttattattaattttcaatcacctgctattcctttcggtaagggtaaggtttgagaggttactctcctgtcaattcatatttttatgtcttttaccccttggctgtttcacccaggctggagtgcagtggcatgatcatagcttactgcagcctcagtctcctgggctgaagagatcctcctgcctcagcctcccgagtagctgaaactagacatgtgccaccataccaggctactttttgctttgacactgattttcttttggatatatgcccagaaatggaattgatggataataaggtagacctatttttattttctgaggaacctccatactgctgtatcaatttacattcccttgaacaatgtataagggttctctcttcctcacactttgccaacacttatctttgatctttttgataacagtcattctaacagctgtgagtgatgtttcactgtggttttgatttatatttccttgatgattagtgaagttcaacacctttttatatacctcttggctatttatcttcttctgagagatgtctattcagggcctttgacaattttttaatgagcttatttgttttttgttattgagttgtaggacagtcttatacattaaccccttacctgatacatggtttgcaaatacactcttccatttcataggctgccttttcactctgttgatttttttttttttttttgctatgcggaaacttttaagtttgatgtaatttcattcatctattcttgctttagttgcctgtgctttgatatcatatccaaaaaatccctacccagactcatgtcaagaagcatttttttttgttttctactagcaattttatgatttcagccttaagttttagtctttaattcatttcgagttgattttcgtagatggtgtgagataaaggtcaaatttcattcttctgcatgtggctatccatttccatttttgacaacacaaatgagcctcatctgactttgaagggccctctcaactccagtgcacctacaaaatatgctgaagttttgtggccacaacactgcagtttaatttctcacactttaatcctgcttgcttcacctttctttctttttttctgtttggagatggagttttgctcttgtcgcctaggctggagtgcaatggcacaatctcagctcactgtaacctctgcctcctgggttcaagcaattctcctgtctcagcctcctgagtagctgggattacagggacatgccaccacgcccggctaatttttgtatttttaatagagacgagatttcaccatgttggccagatggtctcgatctcttgacctggtgatctgcccgcctcggcctcccaaagtgctgagattacaggcgtgagcccctggacctagccttcaccttttatacatattggtcactgtgcacaacttaaaaatcctcctgaatacccttctcagagtttcaaagtctttgcctgggaagctccaggcaattatggaggctgagaagttccacaatctgcaatttgcaagctacagatccaggaaaactggcgatgtagttatgggcctgagaaatagaaagctgatggtagagattccagtctggatctgaagacctgaaaaccaggagcactgaaggtcggagaagaccagtgtttcttttttttgtattatttttagagacagtgtctcactttgttgcctcggctggttttgaactcctgggctcaagggatcctccccgctgggcctcccaaagtgctgggactacaggtgcatgccaccacatctggctcacaactttacatgtcagataatccaaggactctcaaatttcattaactgactcttcaacaaagatctcaggatacatgttgctgacagcacaaagtacatatacaataatttcactctttggttactatggtgcttactctcatttggtaggtgccaggtatatctgagtatataaataggacagatggttaaagaggataaagtggtgctgaagaaatgtgatgagctaacaagttactaataatgggagaggtaactgtggtagaggagtgattagcatggtcatcaggaggtgctacaaatctcatctaacttcactgctccaatctacactggagccccaaaaacctttgctgatgtaacatgttagtgctttccgctctgtataatggaccaactggatgggacttttctccagcactcgattcattttcagcttaattgataatcagatacagacatatacttgatcagatattttataaattctgatttttgatgacaaacattttcaggaaatatcattttgacaaggaaaaatatcaaaatgaggtgctatagaagtctttatgaagaattatacacacatgtgagaaactggtgaatttgaaaaactaacaaaaacccatttaaagatctccattactgttcaacaaaattaaagcaaatcttatgtaaatataaaatgattcataaggaagctgtgaactataattagatggaaatattctgattgatattttggacacaactaattctcactttgccattagataacatagactaagatgtcatgaaatctgcatctgttcctagaagcactattaagaaaagagataaaggaaatgtctgctttataagtttatagcaactttgcacatatctaaaatgttacaattcagattcaagaaataagtgaaaggataaaaaggattcaagagcagccagtttatgaattgcatggactttacatgtgaaagagcttcctagtgtactcctattttatatgcatattcatatggcaaagtattttagtttcaaggtcacagaagattaggagcattcacatcagggaggaagtttcagcaaggcaccctcacagaagtctgccagtcttcacagccaagaaatcagaaaagttataaacagctgacccagctgggtgtagtagctcacacctgtaatcccagcactttccgaggtgggtggatcacctgaggtcaggaatttgagaccagcctgaccaacatggagataccctgcctctactaaagatacaaaattagctgtgtgtggtgcgcatgcctgtaatcccacctactcgggaggctgaggcaggagaatcacttgaacccaggaggcggaggttgcagtgagccgagatcgcaccattgcactccagcctgggcaacaagagtgaaactgcgtctcaaaaacaaacaaacaaacaaaagctgacccaatagccccaatgctcagcactcagaaactgtctaggagagtgataaagagacctctaaatccacaaaacggcctgcaaggatcatcacacttgctgaaatgaagtgttgtgaataataatcttgggtcatctaaaaaaggttaaattatggtcagcacatgttcttttaaggtaaagcaatgaaaatattttagaaaataaaaaaattaaaaaggcaatctgtctttttgtgaatttgattagcatggatcaggtttttaaaaaaacaatttttgagcaacaatttttgggttctccacatatatacatcgcctcattattccctacaatgatcatatgtgatagagattattttacattcagtagtccctcctctcatttatcagatattcagtgagtgccttctgtgtaccaggctgtgtgacaagtccctgacttcaaggaacttacagcttgatgaaagcaaaaacgatgaagacactgaagcacagaaaatttaagagcaagtttctcttctgtaatttcagtcacagctgtagctaacttttactcaataatcttagcattcggtttcaaggaccatcagaattctagaagcaatgaacttgaaaccaagaatgtgtaaaaaatattgtcccacaaataaatggaaagatatcctgtgttcatgaattagaaaaatgaatactgttaaaatttccatagcacccacagcaatttgtagattcaatgcaatacctatcaaaattctaatgagatttttcacagaaatagaaaaagcaatcctaaaattcgtatgaaaccacctcaaatactccaatctcgagcaaaaagaacaaagcttgaagcatcatactacctgatttaaaaatacactataaagctatagtaatcaaaacagcatggtactgtcatgaaaacaaacatataatccaagggaacataacagagagcccagaaattaatccacatctttagggtcaaatgatctacaacgaaggtaccaaaaatgcaaaataggaaaaggacagcatctttaacaaatggtgcagggaaaactggatatctacatgaggaagaatgaaattagacccttatctcgtacaatacacaaaattcaactcaagatagattaaagccttaaatgtaaaacctgaaattataaaactactagatgaaaaaacatggggaaaaagcttcttgatattggtaggggaaataatttttggatatgatccccaaaacacaagcaacaggggcaaaaaaaaaaaaaaaaaaaaaaagaaagaaagaaaaaaaaaaaagaaaagaaaaagacaaatggtgttgcatcagataaaaagttttgacacagcaaaaaaaaaaaaaaaatcaatagaatgaagatgcaacctatggaatgagagaaaacatttgtgaaccaatcatctgataaagggttaatatccaatatccaaaacatatagggaactcaaagaactcaatagcaagaaaataaacaacccaattaaaaatgaacctgaaaagacatttctcaaaagaagacatccaaatggccaacaggtatatgaaaaaatgtttaacatcactagacatcagggaaacaaaatttaaaaccacaataagatatcacctcacatctgttagaatggttattatcaaacagacaaaagaaaagtgttggtgaggatgtggagaaagggaactcttatacactgttggtgggaatgtaaattataatagctattacagaaaataagtctgcaggtttctaaaaaaataaaaaatagaactaccatataatgcaacaatcccatttttgggtatatagccaaaagaaatgaaataagtatcttgaaaagatatctacattctcatattcattgcagcattattcataacagtcaagatgtggaatcaacttaggtgtccattgacagatgaatggataaagaaaatgtgatatatatataatatatatatacatatacaatgtaatactactattcagggtttacaaagaaagaaattctgtcattttcaacaatgtggatgaacctggaggacattatgttaaatgaaataagccagggacagagagacaaacattgtatgatctcacttacatgcggaatcttaaaaaatcaaattcatagcagcagagagtagagtggcagttgccaggagcaaggggcagtgggaagggggcggcacagaggaacatggggagatgttgttcaaagggtacacagtttcagttagacaggaattctgttgatctattgtgaagcacggtgactatagttaacaacatattgtacacttgaaaattgctaaaatagcagattttaaattttctcaccacaaaatatgtgagatgatgaatatgttgattagctggatttaatcatttcacaaggtatacatacatcaaacattgcattgtacacagtcaatgtacacaatttttatttgccaactaaaccttaataaaactaggaaaaaatatcatttcactgtttagaagaagcttattttataaagaaaacaaaatgaatatggtcattcattttctgttataaatataatttcaaacattctctacatactttttatctaataaaactcactggccagccgagtgtggtggctcatgcctgtaatcccagcactttgggaggccgaggtggatggaccacctgaggtcaggagtttgagaccagtctggccaacatggggaaacccggtctctactaaaaatataaaaattagctgggcatggtggtatgtgactgtaatcccagctactcaggaggctgaggcaggagaatcgcttgaacctgggaagtggaggattcagtgagctgagatcgcaccactgcactccagcctgggtgacagagcaagactccatctcaaacaacaacaacaacaacaacaacaacaacaacaacaacaacaacacctcactggccttgaaatgggctgctgtcagaatatgcagttgggcatggtagctcatgccaacaatcccagcactttgggaggccaaggtgggtggactgcttgagcccaggagttcaagatcagcccggacaacaagacaaaaccctgtctctccaaacaaaacaaacaaacaaaaaaattggctgggtgtggtgaagatcagcccggacaacatgacaaaaccctgtctctccaaataaataaataaatacatacatacataaaataaaaaattggttgggtgtggtggcacagtctgtaatcctagctacttaggaggctgagatgggaggactgcttgagcctgggaggtggaagctgcagtgagctggggatcatgctactgcactccagccttggcaacagagagaaaacctgtccctcccccaacccaaaaaaaaaaaaaaaaaagaatatgcttcctggatccagaaatcaatccatcactagtgatttaatctggaaaacttgatgtcaactgattttataattggggcaaccatgtatgtctgccttttatgatggtagtttagctgaactgagtctatgaaataattaggcccacggtgggggaatctgaaatcctcctgaagcactagaacctctcccagccttcccaatgttagagaaaattcttattcccataagtttctaccctttactaagtgatatgtagtccttaaggctcttgatttcctccaaagttagaaaatactacactagaaagctggagtttcctctggataatcaattttttgaaaaatacaaataatattttgtttcgttttgggcttttaatgatatgatgagaaaactagagattctcaggaaagaaaatggggaaacagcactgaaattatttttatacatctcatatttggcaggccttctaattggttgacaaagtaataattctaccaatcttctttctagtataaagatataaaacaaataattttagatattttatccttttggaatataaaagacagatatagacattataaatcccactcaagtttagaattaacaaatatttcattttgcattttttaggttgctttttgaatacttttgagttcaatgatgatattcatcccttgcttaccacataccacccccctcacaaaggttttcaaaagaaatccaattcaggtaaatgataattgatatgggaattatcataatcgaaatatcagaaagcagccacacaatatcttatattgccaaacaagataactgtgactaaaagtggaagttctctatttttaaaagtttttaatattataatactaaaacttgaattttaacagtctgatatgagtatctatttattaaaccattcagccactcatccttctattcattcattcaaccaaaacacagtgttttacagagcagaggtcatccctacctgatgggctcttggacctgtgaagtggagcctatgggtagagatgggacagtcttctattcaagaaggaactttggtttaatacatgaacttttttggcagaacatcaatgacatcctatccactgcttcatccaatattcaagaattgtgagtcttctctcaatcagcaacaataagtgctaatattccatgatctcaacaggctttatagatataaattgtcaggtatttagtttataaaattaaaactggagggaaggaagagaaaatggagtccaactccattttggaggaagatggcatctaactagtcctctgggtgttttaaattatatctttttattaagttagtctctaaaagaaaacatacaatgcaagtactactcaagaaacacgctgggcatggcatgatgctgggaggaggtttttaggttttggttgcttgatactcaatagatcaacacgtgtcgagttctacagaaagagaaacatttccctgaggaaaaaagaattcctaagttcataacctacctcacttttacagaaagtgtatcaaatatagacatccttcttactaatgaaagatccagaaccattagggaaaagtaatttgctgtcatgaaacgactcctttgtctctgtcgtgcttaatatcagaagcttcaatcttctattatcacagaccacaagccctggtaccatccttgcaccacagaatcctgggtttgtacttcctaaattgtgtatttttctatttcttctgttaaataactgttttaaaaggggcaattatttgtagacttaaactatgatgcaaaagaaaaactctcagctgggcgcggtggctcacatctgtaatcccagcactttgggaggctgaagcaggcggatcatgaggtcaggagttcgagaccagcctgaccaacatgctgaaacccccacctctactaaaaatacaaaaaaaaaaaaaaaaaaaaatccgggcgtggaggcgcgcacctgtaatcccagctactcaggaggctgaggcaggagaactgcttgaacccgggaggtagaagttgcagtgggcagagatcgagccactgcactccagcctgggtgacagagggacactccatctccaaaaacaaaaaaaaaaaaagaaagaaaaactctcagatgatatagaatgctttagccaacatgtatagaaacatgttgaggaatgccagattgtcaccaaatacaactggaagtcactgctcttagttggattctctgaagtaagcatggtcctttctaaataccattaaatataataacttctctacttcttggagctctaaaaggcaaaattgaggacaatagctataaagaggcaggtttctttcaataagtgttttttgacatgtaaatatactcagttacatgccttttttcttgtttccaaacctccccgctccccaactcatttttttttccttccatgcagaacacagtatactactaaggacaatgttgtggggggaaaaacatactgagaaatcacaaaaatgacagtttacatcatttgataaaaatagcaatactttaccaaatggaaaattccatcaaatgaaatgtggctccaatcagatgacttacctaaaaataagagagacagaaagaaaaaagtgagaacttggtatggtactcaaccctcaatatactagtctgtaaaacatatggtagatatcttaacaactgatggacaatccaaaacaaacagaaactataccagatcaggaaacaccaattcctttagaaacagtaactaatgttagaaaggaaatggtaaacatggagcaaaagcaatggtgaaagaaagtggtatttactttcaaaccacttggctctcatacatattttaaggggtcagttttgaaaacgtggacacgtatacatataagggctacagctaaaccatacattgcactctctttctcaagacctctggttactaagagagagacaatcaaagctgcagactttcaaatatctttgcctcctatgactcaagaaaaaggtgccagtgtatcatgtgctactgtaatttcctctgttgactttctttccccttaacacttagatgttttggctgtttgcttttttattttccaaagtgaatactgatgttcatgaaaggtgccagattaacaacctggggaaattaagagcttggtctatcaagtgaaaaggctcagtgtagtggaggtgacgaaagtttcccctataccgtgcttgcctatgtgcattagctctgacccacagtcaccccagccctctagtcttcatggtccattaatgtctttgactgctcaggttgctaacaggagcagacagtcttgtttctgcttttaatgctatcattattattaccactactgcgaactctaactccctcagtgaaattatggggaaatttatattggctgccattttgtttcaggacaacaggaaaataaattgaactgaagatagatcttatattcttgataataccgtaggttaaaatccaagaatttcttcaaacaggaggcaaagctttgagtgatcaaattgaaacaggcctcagtaagttcagtcacttgcactcaatttgaattctcattcgggaatattctaatatttaaaggccaaagaagctttatttttccttttaagtctactgcaaaccagtcatttttattatttcttagcaactatggtaaaggtttgggtggatgttgaggctaaaactatcgttgcatatgaaatctgaaaatcaatgtcaaacagaaaaaagtttctttcctatatttataggtgttccaagtttctgaactatgtaggcactttgtaattattaattaatcccacccatgcccaggaataaaatcactttgctgcatctagtcagatgaccaacaactgtttattgatgacattatgctatttctgcacgcaaaatacaagggccagagcaagacaatactcctcctagtctagagtttataacagtaagagaagcaaggctagcaaacatatgcaaacattaatggtacaatgaagtacaatgctgaatgttgctgtgcaatagacttataattacttaataattatttggaaagatcatagtattaaccccaccattgttccctgtctttgctattgtccttctttttgtcaaagactatattctttgcagctagagtagatttccatcttgacatcaccagcacttcctctaaattctaatctctagaagtcctggagaatgagaattgcaggataccaatgactacagcaaacacatggtaacacttatatgaagggtaccctggctgcaactcatatgaaaatcttggaaaattttagtttggggaactttggctgctttttttctttgccttgcatagcctttatcaagcaagtccttatggtattaaaacatttggcactggttcaagtctatgctattgctggcagggaatctaattgggaagcaggggtggagtagttacctttatcaggaatgaccttaaagttatggaaaggctccttccttcccactgcttagtagccttactgaaagctttaaacccagatgtgagaaaagagaatgtctccaacagcagcagcaatttattgtaattatgttagtaaaaacattaggaaggtggaaaatgttatgtcaacttggaggagggaaacactttgtgtacaggtcccaggcaaggttgtgctggggaaaacaaccataacctataattcccagggagccctcagtttccaaatttgcaagaaaattaggagttaactattttaaaaactagtaactatatgcaatgcattacccagtgggtgagagactataagaatctgttcactaacagacaccaatagacacctgtctgtactccctcagtggctggcagtggccaattccctgttaccactagataactaatatattttttctatcagtactatatcacaattggtaacagtggcagtcaaagcaacaaggcccattttgcctacacgatactgtagcttccatcagtgacacacttttttggtttaaggcaatttaaaggttgaccttgaaatgcaattagagcaaaatctgtacactttctgggccaattctgggcctctctgtgcctcagtcacataactgagagttggttttgtccctgactctcttcttcattacataacggatctcttactgtttctgctgactagacttttgcatctttcatgatttgatttctctcatttcatcttctcatttttttctgtggtgggagatatacaagcaaggtttccaaaatttgatatttcacacaaaatgcattagcgagccatggcaaaaatctgttttgtgggcagacacatcatcaaagctctcctctacatggactagttttctagtcaaataaaaatttcaggaaataagatattttcatctcaaaaaataaaagctaaaaagagtatgtctgagagactcaaaccatttactttcatggtcatgaagagaaaatagaaaaagcaataaaagccttaagagcagaaaatgacaggtgatttctccttttcttcccatttcaaacatttaccaataggctaatgaatgccaaggatgcaagaaaaagcgagtcagaaaactgtaggccacaagatggtgtaaacctcatgtggaaaataccagctaaggcactaagaaagccagtaagtaatgaaagatttataaagatgaatatgctcaagttttggacaaagaatatacagaacaaaaccaaacaaaaacactttttaaaacaagttattttttatccttctcaatgcatattagagatagttcaattttaaaagcttgcagtggtttagtaatcaaatagcttaagacaatgcacagttctacccatcaagaatgcttgtttactttggctgacatgccgcaattattaatttacttatctgattcaaaacagagtaagctcttacttttaatttcctaacttaactagcaaactctgggagtcactatgctaagggctgagtgcaacccaagctggaatttttttttttttttggaaagaaaagatgtaagataaatgagctgaattctcatcattccaaagctgagttttaacagtactaaacaaaaagggtaaaactacaacttctgggatttgaatgatagccttcatgactatatagaaaaaatactttttttaaaaggagactttggggcagaaaattatagatgataacctcatgaaaagcactgaaagataggaaccaaatttatccatttgtgggtaatagttatgataattatggggaaggaggaaaaaaggctgttggcaaaggtattcaaaggaagtacctaactattccactcatgaagaaatctggagattatttagggaaatgacttgtacaaaggaaacaattcaaagacaacaaaaacaaaatttaaataagagccaaagatcagttgagggctggggaaaacagtttgggttagtttctgaggttatcttaatggggtcagcctgtcttactgccccagcccccagaaaccaccagtatacctacctgcatcccacagagttttataactgcaacaaattttacccagaggtctacggctaagggctttctggtctaatgctttagggctttccagaaacctcttttctataaaacttctatcccacttcctatcaaactacctttcccttctctaccattctccattctggttctggcatgtgtggattgaaaaagcaatagcggaggtgggaatgaatggggacacagctggtctgtggcaaagagatggtgggtagcaagcagctgcattttggaggattaggatcttggaagccaaagaaagcttcttccaagttctctcctttcagttctttcctctcttgggcaataatagaaattccacaaaacacacaaactttctgaattcacaacactcttcctcataaccaagtgtgtttattatgactgctaacattttctgtgtgccttgtatttagatttctctaagagtttcaaagaggcttataaatttccattaaaacaaatatttctggctatattttataaatacaatttaactttagaatcattggaattcaatttgttaaaaggttattcttgtaaaatttggtttattacactacactcacatttcctaaaccagggttcttaaaatctagacttcataagaattctcagggatgctataaatatagattcatatttagtaggtcttgggtggaaccctggaatctacatttttaataagcacccaaggagattcctatacagtgggggtagagggaccccactctgagatcccatcctaatctgaaccccctaacctcccagcttcacctttttcaagacagcctgtttgagtgacagtagtcaagcagtcacactgaatattgagccaaaaacacaaagtgagcaatctgagaaaaagaaaattatcaccaacaacctttcatttttaacaatacaaggtgctatacaaatacaggaaagaaagggaggtttcctggttgtaactccacttccttgagtaagataaggtttggtattatgaatgaattagctggctttcctattcataagagttgaacctttactggctttctggttacgtcctgctgcattctggcaccccttttcccagcatgatgacagccttgtagagccagccttgatttctcaaattgcaagcaaattagaacctaactacttagaaaagtaatgaaagtgaaatccaatatctaatgggtatgaggctatgagaatctgcttgccaacagacaccaataattctcctgcctctaatctctcagtggccagattttccccacctgccccatagggggaaactcaaacattaagaatctcagactagctcagaagccagaattcattttgatgacattacgtgcttccacttttaaacccaccaatcctaccttttaggtattatcactacctagtcccagttctcattcctcaacccccacctatggtgctctctcttcatgaagccgtcctcttttggtttcatgacatcctgttggctactctgtcctgatgatgatgatgtttcttaattccttgtatcttggttttgaccttataattgactacaactattctttcaaacgtcacctgcaactaaatttaatgggattttcttaatcctttttctccaccactctgatgggtgacctcattggatttttccttctgttggttctcctcccttggtttcagtggtaacacagttctcttatgaacacaaagaatatttgatcttctcagtattaatccttccaacctgtcacaatacacagagaatagaagatatgttcagctaccattatacacaatgttcttgagcccaagacagtttcagttcactctaaagaaaaatcccctccttgattatatgcaacccactatcatcctacggaagctgcattttacttggagtttaggtttcttggagaatatgtaagggggaaaaaaccctcaatttatgtcaaaattaccttgcaaatcccctaggaaggcatcatgcaggaagccaatactgtctctcagtaggccgaatcaaggtggattttgcctccagttttggtaaccatctgagtaaggcaagatgcttaccctgagagaggcaggtgggaacagacatgtacagaaaaatcaatatacaccgtccatttcaggttcattcccaggcatagactcattgaatacaacctgagaagacttgtttgcacaatgtaaatttttatgccttctctctttatattcatttgctgagcaggtgtagttgaactcatgcaaagttagtgtttgtatgatacaacttcaacatagaacttaatggttattgctcaataaatatacatatgtctatgctcttgacttttagcatctcaagggtaaacaaacaacagaggcagacactagatcaagtatgaagatcatagatcaagtatgaagatgaccttaagaaaactggagagttttcttgcaaaaacttctcgagtacacaaatcaaatatacttgtgatgcactggaaaaaacactgtacttagtgtcaagggactgagattctaattccaattctgacacacattagctaagtcacctgggccatctacaaaatggatacttcacagggttgttttgagattcaaaagaaaaaatgcatgtgaacgcatctatcatagtcacttgcacatggtaggcacttgctacaggtttattctaggtgcattggttaaactgaagctaagaagacaaaacaaccacgtaagggaagaaaaccctgacagtgctgggcatatggcaggtgctatgtaagtatttactgcactacactgagacagaaatcaagctggtttgactgagtcaatgtgtaacttgccagttctaacattcttttattttctccacatggtcattggtatgaagtccacttatggcttcataaacatgggcttacaacaaaagtgcttctaatcagatttggcaggaaaaggagagaaacacagggtgaggtaagtgtgaggctacagtgctgaataatagggatggcagtacctcagtatgtgagtcacacagacatcaagcagtacacagctagagataattcgcaggtaaatgctgcacaatccattacgtcatccctcctctgccctttcttcatcaatcttgtcgcctggactctgatgcaacccagcaagaatgtctgatttgcagacagcagagagagcttcagaacatacacatactcatcagagaaggcaatatgaacccaaactgaagtttctggtacttccttttgtttaaatcatgctttagaggggaagtcataggggtgggatgtataactagagatcaagccacctggtctaaggcctaagggactaggcttcatcattttggacaagtcactccaggtccacaggccccgtttccacatgtacaattagatgagcttcaaggtcttttttagctatgtaatttcatcattaaaaattgaggtcaatcacacccatatgatggacagatatgcatttggttttaaaagctaggcataaaatcagctttactttttatcagctatctaggtcactcaaattttaggctacttccatcctactcggaattactagaagagtgtgtacctgtgtgcaaatcttgtaaaagcaagtaagcagtggcaggcagaaactggtggttctagaaaatgtgaatattcactcctgagattatagagatactccagtctaagccacagaagcttgaaagcaaatgtgtatcaggggatataatgtattaagacctatcttctgtatggagaatgttttgaacaacaagaagttttgaaggtacaaaaaattcataataattcataacttaaaagagatgctctaacctaactctaaaccaaaatcatgatcagtctgtgcgtgatttacccagcagcttttaagtacaacaccatcagctccaaataaagaagaattcattagagacacaggtctgtacaggaggtggtcagtcccagtgagctttgggcatgttttccacttgcagtggcaccgcgcttttccagagctgcaaacagtcacacacgcatcaccagcagatttgtgatggaatctccagagaggggcatttccaacaaagcttcagaattgggggggatatggacaagcccactggagatgaaaaccagatgtctcattgtgcttccctcataggcgacaccgtgttgggtccccgaccttctatgctgagcagcttaggggagggtaagttgccccaccacacctggtgcagcattcaacaagacacccatccctttaattattcagccaaatgatttatgaggcttggcagcaaagacttggcagactggtttaaattcaaaggatccaacctacaggtattttgaaaaccttggccacatctgcaatgtgtactgtttcttttgggagaggaaagaagagaaagggagaagatgtgacctgcctgacaggaagacaagacccaactagatggaacatgtctcccactccctccccaccctgtcatttaacaatgttctggctgactttcttcctacgaaaagcaatcagatagagttttaaagatgtaaaatcccagaaccaccaatacattctcataaactgggctcagttgggttgttctgattgattactgatggtataatctttttgatcaactagggaagtggtcagccaactttttccctaaaaagccagatagtaatatttcagattttgtgggctatgtgatctctgtcgcagctactcacctctgacactgcgtcacagaaacagcgatagataatatgtaaatgaaggagtatagccatgttccaataaaactttatttacaaaaacagattaagggtctgatttgatctgctggtcatagtatactattaaataggtgaactgagacaaagtgagagggtatggctactactactaaatttatcaccacttaaccctatttaaatctaagccaattttgggaggacagctaacctctaaaataactgcattaataagtaggcacaataatatttttgggaagagtgtgtgtgtgtgtgaaatatagaacaattcaaagggaattgaacagttttaaaaaatctatcacccagtaactaggttatcttatagaaaacatagttggcattaaatcaaggagctactcttacaagtgtcttgccgtaggtcaactacaggctttgactacacatttatatacaacatagttactgagtaatatatttgttaaagtgttccattatttgtaaaccaatctgtatgttatttgtgtacacatttcaatacacttcaaacaataaacaccaaactgtaaacagtggctactcctggggaataggggttagaatttttattaatttttttaagagacagagtcttgcgctatcgcccaggttggagtgcaatagcacaatcatagctcactctggccttgaactcctgggcccaagcaatcctcctgccttggcctcccaaagtgctggaattacagccataagctactgcgcctggtcagaattttcacttttaggagtattgtctgaattttcacttcccatcaaattttcacccgtttttaccctttcttccagctccttctccccttccttgatttggcctagcagcagtcacacatattactagatctacagctgacgacattcacacaacagcagctgccaataaatatatgatattcctcatttagtaggagggatggataacaaacaagaaaacaaataaatacacaagttattttcaggttgtagtaaatactttgagggacaaggtgatagaggaggcccctttggatgacttttttcctacaaaaagcaaggtcaccggacaatattactgaggaggtgataattagatagagacctgaaggatcagaagaaggcaggaagaaatttttgtggaacaaattccaggctaattgtaaagtgttctggtcttgactctaggccagtgtttccagtcctgattatatattagaatcaacttgggcgctttcaaaaaatagagatgcctgggccccattacaggcaaataagactctggaggtggagtctggtatttcttttctttttgtttttaagccagggctgagaatcactgttctagagtctagagatacctttatgtcaacacaaacagaggcccatagtccaatatggagggaattggactatgtgtgaaactgaactattaaattttagcatggcatgttttgttttgttttgtttttttaaatctagcagattaactggatgcactgtttggtgatgtgatgaagccttgaggaatctccccttgccattgagcaagagaccatgagaaacaacccagggcttttaattgggaccttttgcctgaacttctggcaaatcataaagcaatgaaccatcaagtgacagacttctttgatgtgtttagcaaagcgctgactgaaaagcctatatcccgagatcctctctaacagattcaagactcactgaaccacaaggagaagttcccaaggcaaggatttagcttatacagtgtaaggatatatatgttcccatattcatgcacctcccttatccaactctaaataaagtctgtcgataatctactaaacaattttaggcagttgttgcaatttcctcccaaccactcacccacccatccatccatccaaaatacaactactattgcacaccaactctatacttatgactctgatgcagggaatatacacgccttccattccagtgggagagaaacacagtaatgatcacaaaagaatgtgatatgtgctatgagacagtgcccctctttttcctccttgctacagtgagagcttatcacactttctaaaatttgcttaaatatgcttcctcacctagagatcattaaaaaataaaggctgctttactcagtatcttcaacactaaatacaattcatggcataaaactggcattcaacaactgtaaattgaatcagtaactgagatatatatgacggatataggtacatagtacaagtgcctatgggaggcacggaaggcttcacagagtagcaacgtcaaagctaagtattaaagaataaaccaaaaatcttgtggtggaggttttctctgggtgtgtgcttgaattttatgccaaagatagtggagaactactgaaagtttctagttgggggaaaagattaggttagagtttaagaaccatggccgggcgcggtggctcacgcctgtaatcccattactttgggaggctaaggcgggcggatcacgaggtcaggagatcgagaccatcctggctaatacggtgaaacccggtctctactaaaaatacaaaaacaaaaaattggctggggcatggtggcatgtgcttgtagtcccagctactggggaggctgaggcgggagaatcgcgtgaacccgggaggcggagcttgcagtgagccgagatcgcaccactgcactccagcatgggtgctggaaagactaagttttgagttttgtctttctttaattagctccaaaatacctgcatttttctcctgcaaaagtggtacaacccacaagtcctacttccctacttccctttaccaaattgtgcttggtaaaaatctaatctcaaaaatgtacattctttgagtacgtatatatagtttaccccactcaaagaatgtgttggtatacaaacatttaaacacatgcaagatgggttgctacaccaaacatttaaactcactctacttaaagatgtttctaaccctgtagttagaaaacattccaagaaagacattttcagatctaaattagggatatctaggatagatttatcctttacaaatagctactaatttatagaactaagtattaggttggtgcaaaagtaattgcagtttttgccattaataacttttcagatggtaacagatcttgctgagattagaaactctttcagtagtacactatgattctgaatttccgcaccagttaactggttttaactcacaagttaaactaaacactagttaacttgtgtttccacaagttttccacaccagttaactggttttagctctatgctctagcaggaacctgaaatgactcttctgaataattttattcaacttgatcttgattcttgatgtagaaatcctaagcctacatttgtaaagcagattatcttcaaaatgcattatactttagtttacattttattaaggtttgtgtaataagagcatgacttatgtgttaaattgccagatatttggtatttgagggaaatcaaaactctattacctcatgctattcttattttatcttttcataaatattctttattttcatagctctgtgtacaaagttttaaactactaataaatctgctctattattcacttcagaggaagtgacagtaaggatcactgaaatattctttttactttttctggaagcacttttgttggtttctctgctatccttcccaccctgcccctaccatctattgtgaatattactggtgagtcaggctctggcaaaattgaaaaagcttcctacgtattctaatgcgtagccaagattgagaaccactggggtatcagaaagaacaatggacttggaagacttagcctcaaaatctggatttgtcacttaatggtgacatgtgactcattttcccaataatacacttgtgaggattaaaaagatagcatacagccatttcctctaggttttctagtttgtgagcacatagttgttcctaatagtctctggtgatcttttatatttcttggtatcagttgtaaaaaatgcctccttttatcatttctgatttttatttggaccttcttcttggttagtctagcaagcagtttatccattttgtttatcctttcaaagaaccaacttttcattttgtccatcctttgtatggtttttcttgtttctactccatttagttctgctctgatctttgttatttcttttcttctgctaactttgggtttagtttgtgatgttaggttgttaatttcagatattttattgatgtacgcatttaatgctataaactttccatttagcactgcttgtgctgtataccataggttaaggcatgttgtgttttcattttcatttgtttcgaaaaaattttaaatttccattataatttcttcattgacccagtgatatggtttggctgtgtccccacccaaatctcatcttgaattgtactcccataattcccatgtgttgtgggagggactcggtgggagataatttgaatcatggggccggttttccccatactgttctcatggtagtgagtaagtctcacgagatctgatggttttatcaggagtttccgcttttgcatcttcctcattttctcttgccacccccatgtaagaagcgccttttgcctcccactatgattctgaggactccccagacatgtggaactgtaagtccaattaaacctctttttcttcccagtcttgggtatgtctttatcagcagcatgaaaactgactaatacagtcaattggtactggtggagtggggcattgctgaaaagatacccgaaaatgtggaagtggctttggaactgggtaaaaggcagaggttggaacagtttggagggctcagaagaagacaggaaaatgtgggaaagttggaacttcctagagacttgctgaatggctttgaccaaggcctggcagtgatatggacaataaggtccaggctgaggtggtctcagatggaaatgaggaacttgttgggaactggagcaaaggtgactcttgttatgttttagcaaagagattggcagcattttgcccctgccctagagatttgtgaaactttgaacttgagagagatgatttagggtatctggtggaagaaatttctaagcagcaaagcattcaagaggtgacctgggtgctgttataggcattcagttttgtaagggaagcagagcataaaattttggaaaatttgcagcctaacaatgtgatagaaaagaaaaacccattttctgaggcggaattcaagccagctgcagaaatttacataagtaacaaggagccgaatgttaatcaccaagacaatggggaaaatgtctccagggcatgtcagaggtcttcacacaagcccctccagtcatcagcccagaggcctacgagaaaatggtttcctgggctgggcccaggatccccatgctgtgtgcagcccagggacttggtgccctgtgtcccagctgctctggccattgctgaaaggggccaacgcagaccttgagctgtggcttcagagggtacaagacccaagccttggcagcttccacgtggtgttgaacctgtgagtgcacagaagtcaaggattggggtttgggaacctctgcctagatgtcagaagatgtatggaaacgcctggatgcccaggcagaagtttgctgcaggggaagggcgctcatagagaacctctgctagggcagtgtggaaggcaaatgtgctctgaagccctcagagtccctacttgggcactgcctagtggagctgtgagaagagggccaccatcctccagaccccagaatggaagatccaccaacagcttgcaccatgctcctggaaaagcagcagatactcaaggccagccaatgaaagcagctgggagggaggctgtaccctgcaaagccacaggggctgagctgcctaagaccatgggaacccacctcttacatcagtgtgacctggatgtgagacctggggataaaggagatcattttggagctttaaaatttgactgccccactgaatttcagacttgcatgggccccgtagcccctttgttttggccaatttcttccatttggaacagctgtatttacccaatacctgtacccacattgtatctaggaagtaactagcttgcttttgattttactggctcataggtggaagggacttgccttgtctcagatgagactttggactgcgcgttttgggttaatgctgaaatgagttaagactttgggtgctgttgggaaggcatgattggttttgaaatgtgaggacatgagatttggaggggccaggggtggaatgatagggtttggctgtgtccccacccaaatctcaacttgaattgtactcccataattcccatgtgttgtgggagggacccggtgggagataatttgaatcatgaaggcagtttctcccatactgttctcgtggtagtgaataagtctcatgagatctgatggttttatcaggagtttctgcttttgcatcttcctcattttctcttgccacccccatgtaagaagtgccttttgcctcccaccatgattctgaggcctccccagccacgtgggagtgcactctttttctttccagtctcaggtatgtctttatcagcagtgtgaaaatggactaatacacccagtgattgttcaggaacatgctgtttaatttccatgtatttgtataggttccaaagttcctcttgtattgatttctagcctttttccattgtgttctgagaagatatttgatatgattttgatttttaaaaatttgctaagacttgttttgtggcctaacatgtgatcgacctcagagaattttctatttgctgatgaaaatatatgttctgtagttactggtaagaatgttgttgtaaatgtctgttaagtccatttggtttaaagtccaatttaagtccaatatttctttgttacttttctgacttgatgatctgtctagtgctgtgagtgggacaataaagtcccctactattattgtattgccatctatctctttctttaggtctagtaatctttgttttctgatctgaatgctggaaacacaaaacctactgagactgagccaggaagaaatagtactcctgaacagaccaataatgagtagcaagattgaatcagtaataaaaaatctcccagaaacaacaacaacaaaaagcacaagatcaaatggattcacagctgaattctaccaaatacacaaagaacaaaatccaatactcctgaaactgtccaaaaaatcaagatggaaggaattctccctaacttattctatgaggccagtatcaccctgatgccaaaatcagacaaggacacacactgaaaactataaaccaatatccctgattaacatagacacaaaaatcatcaacaaaatactagtaaataaaatcaaccagtacatcagaaagataatatatcatgatcaagtacgatttatcccagggatgcaaggatggttcaacacatgtaaatcaataaacatgatatgtcacatcaacagaattaaggacaaaaactgtattatctcaatatacacagaaaaagcatttgataaaattcagcatccttttatgataaaaatcctcaacaaactaggcatagaaggaacacacattaacataataaagaccatatatgacaaacccacacccaatatcatacttaatggggaaaagttaaaagcattccctctaagaactggaacaagacaaggatgcccacttttaccacccctattcaacacagtatcaaagtcttcatcagagcagtcaggtaagagaaagaaataagaggcattcaaattggaaaagaggaagacaaatttttcctgttagctgctgatatgatcttatatctagaaaaccctgaagactccaccaaaaaactcttagatttgacaaatgaactagtgaagttccaagctccaaaactgaaagaagttgtagatgacataaacaaatgaaaaaacatccatgctcatagattgaagaatcaatattattaaaatgtaattttaataatattcaatgtaatctctatcagatcaccaatgtcatttttcaccaaagtagaaaaaacaatcctaaaactcatatgaaacccaaaaaaagctcaaatagccaaagaaatcctaagcaaaaagaacaaagctggaggtatcacattaccttactcaaattatacaagactatagcaaccaaaataacatggcactggtataacaacagttacacagatcaatggaacagaagagagaacccagaaatacggccgcatacctacaaccaagtgatctttgacaaggtcaacaaaaatatacattaggaaatgacaacctgttcaataaatggtgctgggaaaattggatagtcacatgcaaaagaatgaaactgggttcatacttcttaccacatacaaaaattaacccaagatggattaaagatctaaatgtaagatctgaaaccataaaaaccttagaacaaaacctaagaaaaactactgtagacattggcctaggcaaagaatttatgaccaagtcctcaaaagcaaatgcaaccaaaaaaaaactagacaaattggacttaattaaactaaaaagcttgtgtataccaaaagaaataatcaacagggcaaaaagaccatctatagaatgggaaaaaatatttgcaactatgcatctgacaaagggctaataaccagaatctacaaggaactcaaacaactcaacaagaaaaaaaccaaataaccccatttaaaagtaggcaaaaaaatggacatttttcaaaagaagacatacaagcagccaacaaacatgaaaaaattctcaacattactaattaccagagaactgcaaattaaaaccataataagatactcccttatatcagtcagaatggctattattaaagagtcaaaaaacaacagatgttggcaaggatgtagagaaaaggaaacacttatatactgttgatgggaatgtaaattagtacaacctttatgcaaaacagtgtggaggtttctcaaatagctaaaaatagaactaccatttgattcagcaatttcactactgggatatatatccaaagggaaagaaatcattatatcaaaaagatagctgcacttgtatttttatcacagcacaatgcacaatagcaaagatacagaattaacctaagtgtccattaatggaggactatataaagaaagagtggtatatatatatacacgtatatatatatatacacacacacatatatatacgtatatatacacatatatgtgtgtatatatacacacatatatacacatatatacacatacatatgtgtgtatatatacctatatatgtatatatatacacacatatatacatatatgtgtgtatatatatacacatacacacacacacacacacacatatatatatatacacacaccatggaatactatttactggctttagaaaaagaataaaatcatgtctttttgcagcaacatagatggaactggaggccattatcctcactgaaataacgcagcaacagtcaaatacagcatgttctcacctataagtgggagctacacaatggatatacatggacatacagagtagaataacagacactggagaatacaaaaggtgggaaggtggcaggggggtgagggttgaaaaattacctattgggtacaatgtctgtgatttgggtgatgggtacactaaaagcccagacttgaccatgatgcaatatatgcatgtaagaaatgtgcatttgtacctcctaaatatataaacataaaaaagatagatttaaaatcaattaaattaaaaaattataaaatcacttcatatattttcaacaataggaatataccttggaacaattactattattactcctaaaacctcaccagcgacattcactgagtgttttaaaacttttggaagggtgtgtgcccctgcaggtaggcctcacacttcacaaacaggtagatcagccatttgaaatggtcatacatttctaatgagaacattctctccttaaagaagaataggctgcttatttgtaaattagtgggaattttctactgcaaatcgaatgagaatgggcatatttcctgttatattccattatggggggagatgggaagaatttttttggtcttatgtcaggactgacccccagtgacatttgtccttacgggaactcatggaccagattatgggcatctttgtcatttgtggatatttctggagcacctgtatttttatttaattcccaaaaggcagagacttttatttccaaccaaagtttaagctacttgagggaaggggcagactttatgcttttttcatttgctctctgcatagatgggagtcaacaaatatttatctgttggagaaaatatgaagggaaattaaatgtttgcttcttccaccttctttatggaattccagaaaggtatttttttttattacaaatataggtaaattttttttcttatatttctttttttcctcccgtgggcacttgataggaaatgggttttcaactctggctgcatatcagaattataccaggaggctttggaatgatactgatgccaggacatcatctctaagattctgatttaattggttttaagtgaagcacaagaattggtattatttagaggctctccagtaattctaattgtggccatgactgaaaaccaccactggaacacataatagatattcatttaatacacatttgttagtttgactttaagttgagagaaggtgtaattagggctgggggctgaacatttagtgttcactttgttatgtcctcagcactcagcaagtgcctaagggcatagggctctcaatgtaagctgtgaatagagagattgaacggatcaatattaagttctctgatgactgggtgccatggttcagttggcaatctgtggcttctggttcaagccctgatatagaaacagaatgtctatctctttctgtctatctttgcctctctctcctctcttgactaccctctctaccacccagtgagaattctgttaggactagcctttctgttttgttcattattttatttctagagcataggcagtatctggcatacaatagctgctgggtaaatataagttcaatatatttctctttctcaaacaaacacaaagcggcaaacagagaattgcaaaaatagtcattttatgggatttaaagactcatacttcttaatattatagtcagaaataaaccactggcattattgctttgggtgggtataactctctcttgcactcttaagcacgtaccaggtgtcttggaactaaggaaataactactccagttttaaaatccacttgaaatcttaacattgactacatacagtaatgagattttatgaaactgatctgagtaagtaaaaatttatttccattttcctttctatcaaatcaatatctaacttttaatattaacatgttgataacatattagcatactaaataggattaccttactttgttccttaggtatttttctgcaaaaaaaagaaaaaaaatatatatatatatatatatagaggaagatactaaattgagtattttgaaaaaattgctttgaatgtaatacttccactctctgaaaatatttcaaaataaagtcagagtagcttgcaagagcagtgaaactgcaggaacaggaggactaagataacaatgtcacagctccaataaggaaatggagtcaagggttggagtcaactgaggaaaacatccagagtgctgtagttttgggtctccagaaaatgtgggggacacagtaattgggttattagatactagaatgggaagtgatagtcttcttgtctgggggattttcctgtttcctcactcttgcctcacccccacctctacatttagtacctagaatcctagacatgcagtcaagagcccctgagaaagcagagcagaactcagaccagagcatataaagcaggaatcagaacagaggttggctttgtgagctttggagtcataagcctcactaaacttacatttaatttatctccaagaaaattataatacccatgtcatacagttgttgctaggtccaaacaagataatgtatatgaaagcaccctatgaactgtgagtgaatcacaaaacaaatgctaagtaagtttatgagatggaagaatttgttgagaaaaataattcctaatttttcctttgaagtccataaaaaatgtacctgctctaaaggtatagacacagtcacactacacttctgataattccgtacagaaatttgaaaacagaaagttcccaattactccgagtgctgaaagaagctttaatagaaaccaaggcagaagccaggagaatgaaggcacctgccagatttggaataaaaattaccaatgaaagaacagcccaagaacaatgggtcaatggtggaagtttaagtgttattatactatgtttctgtaaaagttatagaggcaatccagacaatgctttttttatgtttaaaggaaacaaatagaaagggttaatttcttttttgtttgcatcatctaactaccagtcagaatcaaaccaagaaaatacaactggactttggaaatggtctttaaaacaaagtttttcttataagagaaacctacagaattgaagatatatttcagactttctttttttttccttttctttctttttttttttttttttttgagatggagtctcgctctgtcgcccaggctggagtgcagtggcatgatctcggctcactgcaacctccgcctcccacattcaagcgattctcctgtctcagcctctgagtagctgggactacaggcacatgccaccatgcctggctaattttttttttttttttttttttggatttttagtagaggtggggttttgtcatgctaaccaggatggtctccatctcccaacctcgtgatttgcctgcctaggcctcccaaagtgctgggattacaggcgtgaggcactgcgcccggccaaatttcagactttctaaaaagaatatatggttggattaaaataaagataaaagatcccacaattcttttagcttttgttcacttatagaaaaaaaagttattgaaactgaagaatataaaaagaagattcttaagaagtatgtattgacaagcaatgaaattacagcttaaccttacattttggtgtaccagcttcttttttactttcatttgattagagaaaaaagagctattcttaagaaacagaatgatggcctggaagaacagtatcctcaacatctttcaagaatccaacaggatgagagactggcagctctgttctagaactatgtgcattattgtttgccagatcaagttaatgaaatgtttactgctagaatgttattttttaagttaataaaaacatttctttttgctgacttgctcattggacatatgcatgcaatttaaaatggaatttcaaaaaagtttcattacatgcacctgtgaagaaaataactgaggtcttgggactgtgctaaactaattctgactttgggtcatgttaataacagaattgttagtcttgtcagacatgtggctttctattttaataagattaaggccagagggttcaaactcccttagtttaaataatctcttgcacttaaatattttttctttctttcttttttttttttttttttgagacagaatctcgctctgtcacccaggctggagtgcagtggcacaatcttggctcactgcaacctctgcctcccgggttcaagagagtctcctgtctcagcctcccgagtagctgagataacaggtgtatgccaccacaccccgttaatttttgtatttttagtagaggcaaggtttcaccatcttgcccaagctggtcttgaactcctgacctcaaatgatccacccacttcagcctcccaaaatgctgggattacaggagtgagccactgtgcctggccttttttttttccccttaagagacagggtcttactctgtcccccaggctggagtgcatggcatggccttggctcactgaagcctcaacctcctgggcttaagtgatcctcctgcctcagcctcctgagtaggtggaactacaggtgcatgccaccacggttggctaatttttgtatttttttgtagtgatggggtgtcactatgttgcccaggctggtctcgaactcctgggctcaagcagtcctcctacctcagcctcccaaagggctaggattataggcatgagccactgtgcctggcctaaatatttctttgtatactctcctaatatgttcttgtcctcctaactagatcagggtttctccaccttggcactatagacattttggtctgaataactctttgctgtggagggttgtcctctgtactgcagacatttagcagaaaccctggcttctactcactagatgccataatacttcctaccatcccctgggggtggggcaaaagaatcccccgcttagggccactagactagaggaagaaccattctcctccttctacttgagttcttaggcccacacccatcaccacttcatttaatcttcatcaatttcttcaatttcttctctccatgtgcagttggtaattctctttgacaaacaagtatcttaattctccccattaaaaaaataaaaatatacctaccaacctcatataagccctgtaactcctgttctcgtctatttctttcactatcaactttcagaaaaactaaccgtcactagtatgtctaaaactgtgttgttaaaaataatgtatgccagtgatatactttttctttatttaaaaaatatgcaaaaccccctgaagcacacatactattctctttattttacaatgatatgtctttatggcaatggagtggagggcatatctaatgccacaagcttcatgaaaaaacacctgttcctgggacatatcccattcaatttacagattgatgcatgagcaacatctaccaaccattctattgatgtaagctatctttacatcttataatttgaacatatttgagatatctggttcttattaaaataaaaacaatttagattttctatcttttttcctcttataacaatgaaaacacaagtgaaataaattttaatatcttatagacattaatttatctgtgaataaacttcttgctgttgacttgggtccacgtgcaaactgtatctcattaagtcctattagtatcaaagtattgtggtacaaatgtgttctgtggtcatactgactttaacccccaatgtgttttatgaatatatccaacagaactttaaaaagcttttctcaggcccggtgcggtggctcacgcctgtaatcccagtactttgggaggccgaggtgggtggatcacctgaggtcaggagttcgagaccagcctgaccaacatggggaaaccccatctctagtaaaaatacaaaaaccagctgggcatggtagcaggtgcctgtaatcccatttactcaggaggctgaggcaggagaattgcttgaacccaggagacggaggttgcagtgagccgagatcatgccattgcactccagcctgggcaacagagcgagactctatctcaaaaaaaaaaaagcttttctcatgattataaaagaaattcacaagattgaagagaaatatcagactttaattttaaaagtatgaattggcaagctcaccttgtttttttgagacagggtcttgctgtcacccaggctgaagtatagtggtatgatcttggctcaagctatcctcccacctcaacctccccagtaccacaggcgtgcaccaccatgcccagctaatttttctatttgttgtagagatgaggtttcgccatgttgttcgggctggtcttgaactcctgggctcatgcaatctgcccacctcagcctaccaaagtgttggaattacaggcgtgagccaccatgatgggccctagatcactttcttgagactaattttagagaaccaattgcagttttctcaaccttttaaaacaacctttgaccccctaggatgattttttgttcaatcttctctttactccaattaacttttgaactttatttctagtagtctgtgttttaaattaaaaaaggataagcagaatatgcaacttctaaccatatatacctggtaccctgccccttataccttcctcacggcaacccctttaagtatttatttttaacacgagttatctcatttccactaaatcttttcttctaagagcaatatcctcagtttatttaacctgggaattccagttgtccaagttccttattaacctaatcctgtgtttgttaatatctatatactgtgctttggggctgatgtttggcaacaaagaatgtactcaataaacattagctgaatatgatccttgattttatcatatacttatcttaccttctcaaccaggcagaattctgagtaaaacatagatctttctattcttactacacatcttcctacatgctaggattccctcccccacagtagccaaagtaattggccagagaggaggcttggtagatttggcaaaggtgctcattctttctaaaaagcacttgaagggggaaattttgggcaaagatcttctaagggtagatacctcttggcagtgtgcagaatgagtttcagtgaccaggggctagaggaccactgaccacatcagaaatttatcagaaagttaatgcaaatgatagaatttcacaaatctttagagttcacaaaaaagttatccaggctcatgagctaatgcagactaactggtgcctcctgtttctgctctgtcattatctatcagtaataaatggtttaatcctaaaaatatattatgtggttttcattcttggctctagattacatgtggagaagacaaaatatagcctttcattttgtttgacaggacactctacataataaatacatgaatggctactagtaaaattatactcaaagaatgcagttttggctctcaaacaatcacattccaatttcactttttaaaaattctgcttaagccaatttgtgatggacttccagaactatggatcaattatttcatacctgagcacctgatattcttttacctttgtagctgaacacacacacacacacaaacacacatacatatacatcctttttcatgctaattaacatatcacagaagttaggagattaaccaataaaacaaaacaacaaaaatctgttaggtaactgatttatatcttgtggtataggacattttcctctcttggccttcctctaggctgttttgtgaccaaatctgtgctgttacttcttctggcaagttattctacattataagtttatttcatcagatggtccattctcctttgctttcatcctctgattttacttttcttgctagctacaggtagagttacatggaatattggggtctgaacagttggaaacagagattctaggtaaataatgtggtacttctcatttcttttttttttttttgagactgagtcttgctcagtcacccaggctggagtgcagtggcaccatctcagctcatggcaacctccgcctccccggttcaagcaattatcttgcctcaacctcccaagtagctgggattacaggtacctgccaccacacctggctaatttttttctttttgtgtgtgtatatatatacatatatatatatatatatatatatatatatatatatatatatatacacacatatatatatatacatacatatatatacatacatacatacatatatatatatatatatatatatatatatttatttatttattttttaagtagagacagggtttcaccatgttggccaggctggtcttgaactcctgacctcaggtgatccgcctgccttggcctcccaaagtgttaggattacaggcatgagtcactgtgcccggctggtacttccatttctttatatcagtgctagagagatttcttggctacttcagtaattcaaagaagttagataacaatatccctgagaaattttttttcaaatggcacttaaggcaagtgagataatagctgtaaaaagactgcaccatctgaaagaaaggcatttttaatattttcatcattgcatgtgttattcctgatgggtacagaacaatgacttccctcatattcacacagtgggtacaaaagcacagcttatatgtgggcacctcaaagacattcgccctacacattttcgtacagcactgtatgtattactttgatgtaacagactaaaaaacatgtttaacacagctgtcttcagctgcaagcctacattatatgaatttatttattttttattgctgcataaattaccatttcatagggttgggctgttcaattgtcatcacaaattttataagcacatttttgaaaaatgaggaaggatcattctatgaaatactatatatggcattaacagaatcatgcaaatgaatggtggtctggttacttccatgattaagcacttcagtgattcaaaaatactttaaaaaagttagctgaatgggccaggcatagtggctcatgcctgtaatcccagcactttgggacgctgaggtaggcagaatgcttgagcccaggggtgaaagaccagcctgggcaacagagtgagagactcttattctataaaaaaataaaaaaattagctgggcgtggtggcatgtgcctgtagtcccagccattcaggaggctgaggtgggaggatcacttgagcccaggaggctgacgatgggtttgagccatgaatgcgccactacatgctagcctggttgaaagagtgagaccctgtctcaaaaaaaaaaaagtaaaaaattacctaatggtgaatgaaagtttgctcttcattcataaatacacagccccagattaaattggtggatgcaaaatgtataagcatgacaggcataaaaaaagatgtgtacaaagagataagaaatgcatgcatatagacaatactattaaaaaaacatatactaaaatacatataccgaaatatatagcacttatattgttttagttttttaaactaattataacattatacaaaaccaagactaacaaccgtcacaaaagtataaacttctatttatgcatatttataaacaactaaaagagcatattatgtttatcagaaaaataaaatagaaaagtgattatgcttggcttttatttgttgtttaattttttgtagaggcaggatctcactatgttatccaggctggtcgtgaattcctggcctcaagcgatcctcccgccttgctgggattacaggtgtgagccaccatgcctggccgtggcttgactctgcaatgttgtctcacgaaccttccctaatatttatgcatgtgcatgtgtgaataaacacctatacatatttcttcctcttttgggtaaagatgagaaaatagcacgcaatttggaatcaggcagacctggtttaaacactaattccaaccaatttttttcaaatggtgctgaaggcacaatgttggacaagttattgaaactgtcaattttccacttgcaaaacggggattcatacatacattaaatctgcattaaataccatatttagtatataggtatatagatatacactgtgtgatgatcaaatcagggtaatcacctcaaacatttatcatgtatcattgtatcatttatcatgtatcattgtgagtgctaggaatactaataagagtggccagagaaacaggacatgcaaataaggaactatagcaaagtgttggatgctgtgacacacatggatcccacagaagccagatgggtggagggcctgactcttcctaagtcatttcaggaaggcttcgcttaagatgtgacatcagagcttagtcctgaggattaagtaggagtttgccaggaggccagggacaagtttagcattggggtagtggaagcaccacagttaaaagttggaaggtataaaataacaaaagtcaggtgtcaaagaactattggcaccacatcccagcacagggtgtttgtgaggctcagtggcacaatgctcggacagagtgtgagtatgtaatcccacacaaatgtgagaggtcctttgtttctaaaacctttgcctcttccctcacccctgtatttcactagcaagaccaattgtctcttcattctcattctaccaaagctcacatcttcattatgcctcatttggttaaatgggtcccaattgtccagcaaacatgggtacatagccagtattgaagggtttcaagtacccgattcaaacctagcataatgttaaaggaagcagcactggcctagaaggctccttgtcctgttctgcctctgaatagctagaacatgtcactcactctctctctggctcattttaaacaagtcacacctgtaactaataataatgcagaacggataacagtgagaacttaccaagtgctaggcagggtgcaagctctgccaatacgctgtcccatttgattctcaaaacaatcttataaaaatgatactaccataagccctcaattccttattcacaattctgaaatctaaaaactgctgaaagccagtaatttttaaatttttcttaagtttgtaataaactcatttggataaaacctgaactgaatgtataaaaaagtgtgtatcatttttattccacttattgtaaactaccagatggtttctgtggaaataaaaatgtgctggttatgaggaactgcctcagaccttgatggggcagttacctaacatatctgatgtactataccatattcctttccccaaactgaaaaattctgaatttcaaaacatccaatgcaagacttcagagattacgggtgagcaaactgagatacagagaggttaagtaacttgtccaaagtcacagaggtaagattagtagatccaggtctcaaacccaggccaatttggcaccagctcctagactcttaaccatttagctaaacttgctccgagtgtccaataaactactccaaatagagctctaaggtactactgcatgtctcactatatagtccgtactgtactgcctgaattaggcttctcatcatttctaaggcacaccctctaatttccagcttctaagtaatctttgcttagaattctttccccccagtgctgctttaataatttctgtccatcttttaaagctcaacttacataccacctccttcaaaataatgttcttaatgtccttaaccacaaattagttctcctacctcacccttcacagcactttgtcccgctctctctcttttaagacaatacacaaaattcaacttcatattatacctatatgtgaactcatcttgtctcccaactaaattgtgccctctttaaggactaggagggaccctgtcccattcctctttatatccttacaatactagagcaatgccatgaatattatcattattccataaatgttggtgtaaaaataaaaagctaatggtattttaattaatgatttttgtattgacatatagaggtaatacttaacactcatgtaataacaggtctcattttattctttaaaaaaccattttctagtggaattttcattaaggagttttatcctgtttctcattagaacaagtctttaaaaaaatctgggaaagaaaaataaaccatttctacctatgaacaacctgactccaatgctggttcatcatcttcaaaatttagttcccacatagaaattactccattagaaaagtggacatgatataacatctttagaatcattctactgtgatatgcttggttaacatctcttaactctgagccgtatatacagacaagctttttatctttttagtgtttcccaaaagaaggccataaagagagaacataataaaattttaggtagagtctcattcaaaaaaatattgtggtttttgaaaatttatttatttaaaactgataggtaattgtatatatttatggggtacagtgtgatattctgatataggtatacagtgtgtaatgatcaaatcagggtaatcacctcaaacatttatcatttctttgtgttggggaagttagaaatcctgtcttctagctatttgaaaatatacagtaaattgttaactacaccctctagtcgccctacagtgccacagacactagaacttattccttttatctagccgtaattttgtatctgttaaccaacctctccatatccacctccctttcctcccagcctccagtaatcactgttctactccctacttctgcttcttttttttttgtaaacaagagtctcgctctgttgcccaggctggagtgcagtggtgtaatctcagctcactgcagcctccgcctcctgggttcaagtgactctcgtgcctcagccacccaagtagctaggattacagtcctgcctggttaatttttctatttttagaagaggcggggttttgccatgttagccaggctggtattgatctcctggcctcatgtgattcacccaccttggacacccaaagtcctgggattacaggggagagccctggtgcccagcctctactccctacttctatgagatcgacttttttagcttccacatatgaatgagaatatgtggtgtgttcatccttctgtgcctggcttatttcacttaacaatatgccctccaggctcatccatgtggcctcaaatgacaagatttcattctttttttatggctgactagtattccattgtgtagatataccacattttctttatccattcatctattgatgaacacttaggttgattccatattttggctattgtgaatagtgctgcaataagcctggcagtgtagatgtctctttggcatattgatttcttttcccttggatacatatccagtagtgggattgctggattcatttttttaaaacttaaatggttttttggagatggttggatttgaatttttttgcttccatgagggaattcctgaagatgacattttatttttatatactactcttagtctataaattctaaatgctttactattaaaattttatttataatactttccagaggtagagctttaaaaatgttttcttttgaaacgttcattgcttgttttatgtaaagaatgactttaggtggaattatgaggaacttcaaaacagaatattaatcttaaagaggaccatctggcataataatttgctcatggaaattttggcctgtttctatttttcctgcaattttttcttttaggttaatggtgtatatatgcatattatgtgctttgaactggcttcctagtaatggtaacagatttctcttattggatccatacttgtaaatgactgcctaggtttaggccatcagacaaagtaagttaactagtttatgaaggaactgacccagtagtcctgatctcagcagtgtcatgctccatccaaatgattccattctcttatttttctgataaaatttagaatttaaataatcttggttaagatattatactgtttgtactatacactttagggcctgtatactaaaaaaatcaactaatttttttgttgttgaaatttatttcatggagacactaaaataattttattctttttggaggtaattacttgcttacattcccaggaaaacaagtaatttaggtatattggctatcttccttgacatctctcatagctactctatccaactctgactccacttctattgcccataggcccccagcatacctttctgaaccacagaaatactcttactttgtttccctgcttcagatctctctattctcctaatttgtccttcattcagctactagatcaacctttctaagatggaaagctgttaatgttatttcctggtctaagtctcttttctggcttccccactgctcctgggatgaggcatcagctccactgtgatatagcctttctttgcaggctgtgctgcctgtctgttcctccagccttatgcctcttacaagggaactgtgtacagtacatgccaggttgcttcatccctccatgacaatgttcgtgctgttctatccaaaagacaagaaaaagcagcaaatcctaacatagagacactaggtgctattagtagttaagaaggattcccctatatatctaagaacttgctaaacggtgatcataggctagaataagaggatagaattcctgcaaggtgcagtcacacagggagttcaaactcactcacagactcttctccttggacctacatcaggcactcattagaaagactgggggcaaggtaggaagccagagaaaataactgaacaggaggaaagaacagaagaaatatttgaagagataatggtcaaacatcttctaaaaaataatcaaagacatcaaaccacaggtccaagaaacctgaagaactctgagtagggtaagtaacaacaataaaataagataataaaatcctatcatattgaaactactgaaaactaaaaataaagaataaatcttgaaggtaaacagtttaaaaaaaagatgcatatgcagaggaacaaagataaaaattatggcaaacttcttgctgcaaatcatgcaagccacgagaaaataaagtggtatcttcaatgtggtgaaagaaaaaccactggactagactgccagttactgaagtaacatgcaggtccaccatgggtcctactagtagtagtttggctgcaattctcttggggggttactgtttctaagttcatgatatctatgaatttcttttggacacagtttaataacttacttacaacatccaataaaaatagacatccctatccaattttattctttatgtatgaattctatataattatttggttataagcaggaacgcgtagcatatgggccacagtatctttttactctcctcaagtagactaatagcagcatacactatatggacttactatgttccaccttctaagtgctttatatctattaaaagagacactgggccaggtgcggtggcttatgagtactttgggaggctgaggcgggcgaaccacctgaggtcaaaagttcgagaccagcctggaaaacatggcgaaacctcgtctctactaaaaatacaaaaattagctgggcatagtggcacatgcctgtagtcccagctacttgggaggctgaggcaggagaatcgcttgaacccaggaggcggaggttgcagtgagccaagatggtgccactgcactccagcctggacaacagagcgtgactctaacaacaacaacaaaaagagacattttattactgtttgcttgctagcccaaagaaaatatgcaataatggatgctgttgattgttctaaactttccttctacaactcaacatatacacgacttttcaatttgagtaagaatgtcactattagaatgaccttgatatgagtatatactcaggactttgctgagatgtccctttcctagaccagtctaaaacagaacgctctcttcctctgtgtttctcagttctgttgtttaccctagtttctctttttcatagcacttatttccacatgaagtatcaattttttttttttttgagacggagtctcatttgcaggctggagtgcaatggtgtgacctcggctcactgcaacgtctgcctcccgggttcaagcaattctcctgcctcagcctcccgagtagctgggattacaggcgcccgccaccatactcagctaatttttgtatttttagcagagacagagtttcaccatgttggtcaagctggtcttgaactccttgaattcactgcctgtctgttgtcagtctcctgcactagaacatttgaccattggaactgtgtctctcctggtcattgctatatccacagcacttacaacagttcctcgaactagaaggagtttagtatgtatttgttgaatggatgcatgaatgaaggatgaagtaatatgtgaacaaatagaaattcctttcacctgaggaatctggtagattggagcggggaggaacagaagcaggtggaagttgaatgcctgctaggtgaaaggtacttcactgggcttaatctagataatctaagatgctcagtatagttcctggaacattagcagtcactcagagttattaactgtaattaatgactgttgatcttttgtcataaatgtgtcttaatgaacttgtgaaaatggtattattttctagctttgcacattcaaaaagatcaaataacacgcccaggtttacagagtttggactgaatccacctggtatggcaaacacaagagcccatgccaaggggtaggaaagagaatatggaaatgttcatctcctaaggactaaattattatctttatttgaatataagtaaatgaattttaactacatgtcatcaaacaacaggttttttccactccaaacatgagtttttgttgttgttgttgttgttgttgttttgagatggagtttcgctcttgttactcaggctggagtgcaatggcatgaccttggctcatcacaacctccgcctcctgggttcaagtgattctcctgcctcagcctcccgagtagctgggattacaggcacacaccaccacccggctaattttgtatttttagtagagacggggtttctccatgttggtcaggctggtcttgaactcctgacctcaggtgatccacctgcctcggcctcccaaagtgctgtgattacaggcgtgagccactgcgcccagcccaaataatgagtttttattcctgctttctaagttttttgacctgatagtgacagtcaacaaggtaagaaatgggctttactaaacttacaaagaaaaatcctgttgtgatcccttctaaaaactgcaggtccaaaccataataaatcaacccgtgcttgaaagcacgaactgtatatactggcaccctattcagctaagataaaaacgacaagtccttcaatgataaattgtcctctccatgttatccaatggaaatactcatattgtccaatacctacaagcaattagaaggatttagtttaactttcaaattaaaagaccattaaaaagaaacatagttccccagtctgcctctgaaaaatattcagaaaaccttcttgttcttaaacttggaaggaattggtacttagtctcagatttccttttatcacacagcaattcagccagctatttggaactgtgggttacaggaaacagtgggataaaacagaaaacaatgcaagatctttgaaaagttatttatcaattatatattgtctatcaagaacacctaaaacttagagcaaccatccctccacccaccaccaacaacaaacaccaggcctaggaatagaggtatttaacatctaacatgatacctgcatcccaatctctgccttcattataaagctacccaaactgggggaaaaaagtgagcttaaataggtttttgagtgcagatccatttatttttcatcaagtttgaagtgtgtttattattcttcttacagaagtggttttcctcctcaatctatttacttacctataggatgtgagtataaattctataagatctgaagggaggatgttgataactttcatgaaataaagcaacattagttttctaccaataaaacctggcaataaagcttaaactttcaaaataaggaaaaaaaagacagaggaattttcatatgtatttataactgcatattttagatttctattttatatgaatatgtggtttgatgtttagaagaggattgaattaatgatcatgagacaagagtcacataattaaggcattaaaacataccagtttttgcaattttgcatacacacacagaaaatcagtgttcttataacatgtattctcaaatgaatatttaaaatttgttaacatccactaatgagatcacaagaagagaaaaaaaatttttattcattttgtttatgatgtttctatataatgctcctagtttttcagagaattcactgagttttaaagcagatcataaaatctaaaccttggcttttattattcaggtggcctcattttgcccttcatcttttttaataattgtcattccatccattgttcctatagttctgcacctaattttgtgaacagataaaaggggagcttttagtggtttctgtcccaaattctctggcctatttctgctctcagcttttattgccaaaggtgtgaagatcaaaagatgctctttgctgatgtgtttacttccttgtaacaaaccctctcacaacaaaggagttcattatttacatctaacatgaaagaaaaagttccaaagccaaaggcctgcatcagacagatgccaagtgatggaattttcttgcctcacacttatggaagttaacatcattaacacccagttaatctaaatgtcttcaagagcaaaaaacatatcttagggtaggggtaaagctctggctttcccatgcagttccttggctttgcccatgccttcaatctttcccaacagggtggtgacatgggctcatttcataagcacagaaagctctcgcgacagcccatggaaacatgaaccgttatttactctggaaagaatgactgggagcagctgtgcccagcagcagacagcactagaggcagaaaatgaggccgtgtcaccaatctgttattattataataactaatggagagaaataaaatggattaccagcacttactcaaatggggacggggacgtttccgatgctgctgcaagacagaggcttctcacggtttatgatatcatcagacttcttaatgaatttacagtctagtaatcctgccatggcattagttttccacatgcaaatccctggcatctaagtcaattcggcaaatgaacaaaactagggtactctattgggtcaagtttatttcaacctaagggaaagagatgactagctttcttcctattcccttatcaaatttattaagcccataaaaagactggtttgaatgacatctttccccacactttgcatatcagtctatatttttatatgtctgcaatatcactaccttatatctgtcagaaccaggttcctctcaataatattcgtactgattcacttaactgcttagtcaaactatattatagatacttaaccatcttatccatttgctgactatactccatgtcagtgtgctaattttatgactaatccatgtttcccaacaagactacatatatctaggtcagcaaccaggtttacataatcctacctgtaccaaatcctaccaaaagagtatataggtgctttttagaatgatctatatccagaggccccaacgtcattattcattcattcattcaagctaggaaccgactctgttctcttttatgggaatggtgttgcagggagaggactcctttcagaagtttgaggttccgtgtgtatcctagaccctaccatacagactcctgtgagtccacagtgtgaggtcctgatgaaagcaggtctaaagccacagttcactcaggtctctgtccctatactctggtaccaacttagatcagggagtggctacaagacaaaagctgatggaggaagtgggaattttggaagtgaggcttagagaggttaagcaatactaacatattttcatctgcatctcctgtgagacctcattcctgagtcccataccagtatttctacccagattctacagacatctcatattcaacatgtagaaaagaggactcctcatctctcctttcaaatggacttctttccttgtgtggtgatctcacttatgggttccagcatcccatattctcttttttttttttttttgagatgggctctgtcacccaggctggtgggcagtggcacgatcttggctcactgcaagctccgcgccccgggttcacgccattctcctgcctcagcctcccgagtagctgggactacaggcatctgccaccaggcccggctaattattttttgtatttttagtagagacggggtttcaccatgttagccaggatggtctcgatctcctgacctagtgatccgcccgccttggcctcccaaagtgctgggattacaggcgtgagccaccacgcccagcccccatattctcttaagagacaccaaaacctgccaatccttgctgttaaatatcttgtgaatacagcccctcctcttcaatcacacaggtaggagcactgccaagccctattccttcacatgaatgactgcaacagcttcctaacccatcttcccacctctagtctttttccctttaattgcatccacaccaacatttatctataatatcctcacaacattttgcttcttaaaatctttctgtggctggctgtagcagatagtataatgtttaaggtctttagaatggtaaaaagtcctttgaggtctatcgtagcacgctctcttaagtactctacctctctcccagcccagttcatatcccatatacagaatgtcttgtcatttactgaatggttttccttgctctttttaaactcttgtgaccctgtacatgcaaggtctagaactattttcctacttatctactagtaaactacaaggaaagcagggatatgctaggtttcagttaggcaaaatgtagagaaagtgttctgcaattaggtagaagtagtttgggagtgaaagcgaacacaaatagggtggggaagcacagagtatgtgagaatgagacttcaaaactgactagtgaaccacattcatttcctttacagcatttatctcagttattacatgcttaagaggagtttggtctcatccacctcacacaccagaaggcctgaagggcagtgagggtaaggtgggcattccctattcagagtgattgcagcctctaaagccagactgcctgggtctgaaactgagctccaaaacttatcagatgactttgggcaaattacttattatttctatgccttcactttctcagctgcaaaatgataacccatttcagaaggtagttgtgagaatgaatgatttaatgcacgcaaagtatgaggttgaaccatatgaaattactatttttatatgtcaaaatactcaaatatcaacaagtttatatggcttatccaaattttaagccaatgcctaactgattattcctttttataatgcttctaaaccattactccctaatgcctctgatgtaacagcctcatttgttgaatttcatattatccaattatcttttctcattgatgtccccctgctaatatcctggtccctccataacacttattcatgactagggcacttggcaacaatctttaacataccctttgtgacaatgagtgacttcagtatccatctagacaagccatccaataaactataaattcctcaccttcttcatctccatggtcacagatttccaaggtcaaaccctgcaactaattatctagtggggctgcttcctatccattatgtgaagatgaccacaatctctgatccttccaggctccccgtgcctttgcccttactacctctgctctccaatctctggaaaaccatagttccttgacctctttcctggcctcactgctttacccagttgggatagcacggctcattacttcaaccattctttcactaatatctttagaatcaattcaaacgtagacttctgtatttctgtgaccaatctgttgagctcagctggaaaaaaaagtcagctttcagattgacgcaactatataaatctgcagtcctcaatctcaaataggccatcaacgtggctcaacctcctactcattcttgcttagcttgctcttattttactaagcaatgttaccaaactgtcatattgctcaagagcccaaacaaggctacatccttctctgcagatgacatcattttctacttcaataagagaattatacatacattatcccaatattgttcccctccccttcttagatatgcctggacctgtccttgtgcactttctttcaatgacaggatgaggtattcttactccaggtcaagatcctgccctgccctccacacatggccccccttttcagcactcccaggaccgagctccattaattatcccctttacttcctaaatctttaaattctcagtgcctatttactctttcctctaagcccagaaacccatttaaatcttttatcaaatgaatttttttttctttttgcttcttgaacctgggttgcaccccagaaaccatacccttccttctcttctaaggcaagtgacttgaaagagaggtttgtgctaacccttctcaactttcttaccctacccatttactttaaaacaagacacaatgtcattctgccctggccactggactgaaacttctctgatgagacaccagtgaactccataatgccacacctgaggaaaatgtatcaattctctcctctcattttttcttatttctctgttttttcctttccagtctccctcatgggttccttgtcttttgtttgcttcttaaatgtctgtattactcaaggcttcacccatggtaatttgttcattctatatattctccttgtgcaatttcatttgctcttgattttaaacaccactgatatggggtgacttccaaatctgtatttccagcccagattacctcccatcaccttccatgtttatttacctggatagcctgcctgcaaggacttaaacccaacatatcattcagtcttttttttttttttcccccaaaaacatagtttttcaggacctacttcatactactattcaacagtaaacaagacagcaaaacaggtcctttatcttaatccctgtttctcactcgtacccctaagtacaatttaggctacaataagaccaaactttctgtagtttgccatttttttgttcaaagaaggttaaacactgagggcgtatgaacatactactctcccagcctggaattcccttcccatgttcttttcaattcttaagactttaggagaagtctcatcctccaaggtaccttccctaaattgccacgtaaggctaggtgcccttgatcactgcctttactagaatgtgctaaaactatctctttgtacatgttttccccaaggatccctaaggcagagattgtatctctctgtgaacagcatactgcttggtacatgagtaatacatgtttgagattgcccaagtagatgtgctgaagtactgtgatgcttttctgacactcccacataccgttgcacttatctatttgtaaatcctactccttctccttgctaataccaggttaactttcctgagcatgttgtgtctctttcattctccacatcactcaaaatcatgtatataaaaggcactcaaggagtattggttgaattgaggtgaaataaacagataaaacactccacatctacatttctatttctgggatccattagtgtcattctgtagctctgagctaagatttctcaggtgtctttcagctactaccaaggcccaaagaacgttatcaaaaaatgtccagactgttcttcaatctctgcatgtgtcgtgagagaccattccaattgcatatgtgggatttcccatccaggtgtagggactcaccatattcctcaattcacaaaacaaggagccaggaggggactcttagtggaacaaaaaattcagttgacccactggatcactatgtaccatatttcttcctgcaatgcattaaattcaggctcttatggcctaagttcatttccaaaaagtgaacacttctatttactcttcacgagaagcttctctctcaatgcatgtaaagtgctttgagctctctgtgaaaggaatgatgtaaacacaaggcattattaccaacactatcctctaaataacctcatgaggtaagtattaatatcagagggactattattttacaggcagagaaatcagctgatttgctcaaagtcagaggtggggctaagagccaagaacacattccaagagtcctttgcttattatatccattgccagacctaatccaagcttttcagaaagttcttcttagagtgtgaagagagtctgagaactttatcctttctttttcagactgttcttgccccatatcctttccctctcttatcatttcttctcaatagggatccaaaagagaatgcaatgatcacctaacagccatccaatcccccacctgtatagcatgtggggcagtacagaggttcagtcaggcatactccatctattttcacccagactttacaatccaggctgctcggagttctgccagcttgagttagttcagttcgagtaaatctctaagtcgttcaagtacggcatgctctgttgaattaattttcttcagttacgtcttgtatacgtggcccatataactttacagagatcctgctcaccaaatgatttttcaaatctgacacactacatttattagaatgattctattttcatccacctagttttaaaatctgctagagtttgaaggttgaaaatgccatgtaaatgtggcatcttaaatcaaactgtatatacagagcgaagggttctgagtaacagtaataatagttgtcctacttgttgaatgtttataaagttaattgttagtgatgagtgaactcagtctaagtctccgtactattttgacggggctctgcacaaaaacaatcatttctggggaaggagaaatcttctagactgaattatatctagttctaacctctaaaactatatatagccgaaaaaaaaaatctatccatcaattttctggaagggttcaggcttcagatggagcagtggggctatgaaagaaacagaaaggaagggctactggtggtggaggctgctttgccccaggagatctgcctggagttgaccatttcaacttccagccatgacaagctcccatgcccagcctctgcagcctgcttaggttccttcccaaactcctcccaagttaagaaacaacttatctaaggaattactcacctacaagttgtgaacattttatttacctttcctaagagatattgtgagagagatatccctgtaaatatcactttctgtgttacaacactgttgtgctgtacccctattaacctcagcagggaaggcactaggttcaagaggctgaagaaaagacccagaggcagcaaatgagacatggggtttactaggggcttacatatggggagagagtggagaactggtggcaggcgggacaggagaactgccttatgtacagaaatggtccagtggcggcaggctggacaacatgactgcatggccagtggctgcgggctgggcaggaaaactgcaactgcttgcaaacagcatgcagtttataaagcattttcatttaacaccctccccctaatgacctccatctggtaaccttcatttaacctaaaactcagggccttaatccccaataagcccatgttccacaggatgagcagggggctcagatatttatcatagtaaggaatgaatctccgagttggccattcctggattccctaccttggaacacacattcaggtgcactggccatacatggtcattctaagggtatgcttaaattgctgctatcaggtatgtttaccctacaaacaaacaaatgaagaaaagtatctggaagaaattcagagatagctacaaatttaacatttatctcaattccaaaggtctggaaaatcagtcatgaccttgaagaacatgctggtacatccacagagtacactacgccagaagcagcacatgccatagcacctgactgggcaacagagagaaatgtgacagcctgcaccagtaagaacacaggccaacctttcattcttgataaaaaattataaaactcccacatatacaaagaacacaggaaagaaagtcataaaccacttggactcaaaggaaaaatacctgactcatatatttgtttcacaatttaagcacatatccctcatctcacagtggggactaagtgatatgcttggctagtaggattaacattgcttcagaaaacattttcctggaccaatgtaatctttcaaggtaattactagaaaataacacttgtaaatttcctttaaaactttataaggtatcataatttatttacagatacagcagtatctaagtatatcaggtacttcaagaaatacaatgaaaaggatcatgtttctttttggtttgaagaacaatttttatacagagtcttaaagcctgggaaactattgtatctgtgcactatgggactgatgttcaagtgatctaatattaacttaggaaagagtttttccacagttacagggagcatagtagatgagaggtgtgtgaaggtatgatcccccttgggtagcctggaggtttctgggcattagtctcctaggggacctctttcttcggctgccctccaaagcctcctttgtttaccatactgttctagacaaatattcccagcttctctgtgagccatattgagaaacaggttgggaagctctagcttaggaaacacatttccttttggccctagacacacagagaagatcactacaagaacctgattcaatgtcagagtgatatggtgcaaagaacagagtgaggaatgagatttgggttttggcacaggctttctcactacctagctctgagccctgagcagatcacttacctgtcaggaccttgactgcctcactataatgtaagtggtttggccttgatcctgtttaaggacccatcctaaacatcacctagcccagtacaaggcatatggtactcaagagacttagaaatccctaagtctctgagtaccatatgccttgtactgggctagggagaaactagacacagacactgtccctattctcatggaacctgtaacctagctagaggtaagatcattaatcaagataaatattgataaataaaaattaaatctaactgaagcgtaatggatttggaagatagaattatcactgcttataaaaactcaatgtacttcctactgagcatataagtctatagggtaaatctgcaccacagaacgagtctatgccctctgtttttatttaatcacataacaattattatgttcaaatattcaaacatgggcttgaagattataaagtcatgtgaaatcagcttcaccttggttgtacctgggagctcctgcctggcctactgatcattttcgttatgacacattttaattaagtcattaacaaatggatgtggctgggcgcggtggctcacacctgtaatcccaggactttgggaggctgaggcaggcagatcacaagatgaggagttcaagaccagcttggccaacatggtgaaaccctgtctctgctaaaaatacaaaaattagctgagcatggtggcgtgtgcctgtaatccccagctactcaggaagctgagacaggagaattgctcgaaccaggaccctggaggcgaggctgcagtgaaccgagatcacgccactgcactccagcctgggctacagagcgacactccgtctaaaaaaaaagaaaaaaaaaatggatgcatattcaggtaacaccatcaaggcaaagaggagtgctaaaagtcttctctgacacaaaatgtaaatatcccgctcaatcaacattctttcttatccttctaatactttcaagcagttgctcccacttcacttctttttggacccacagagaccgtcagccccttacttctgtgctatatccttatataacagcccactcttatttttacttcttttcctatatagcacaggctccacggatcatgacttcaaactttctcttatttatcttcatcccttctgttcccaagaagcacttacctgcatatatccaccacatgggatcagtcaacactagggtaaaatcactgctagtggaaaaccacacactattctggggcaactataccttcatggttgctagcattaagtggcttgatttggaaaggtttccctaagagtaagagcatttcgaactttctctggtgcactgttatcctaattattttaccctctgtaggcaggctaaaccctctttgacagtggcagaaggcagggagagaaactaaggctgcaagcaacctcaacggctggtaaaacccaggctagctcctaaaatccatcaagagagcaatctcttccatgcagcaatgcctgtgagtaacatgtgaaatatggatgaatacttgctttatttatctcggccatgaacattccagtgagtatgtagttgtgaccataaacagcaggctacagccattgtcttaaggcaccctcagagtacttcatctatgacttaaatctttcccaatttgttcttaggggctgcagccaaatcctagctctcccacttagctttctaacttttgggaagttatttaaactaactgtatctgaggataatacctacctcatagagttaatgtggacattctatttcttactgtaacaggaccaggcctacagtgctatatgtgtttgttgctgttgttgttgttattattaattataatcctgtgtataaaagccaccaaagtttctcacagtcataagaatgttaaaacaatattatctcttcctcttctttctccaaacatattgttgctggagaaatggtcatgctactgaaagagctatatctgtctaaccctaatgactgaatatatcctttctctaacaacaaaagataatatacaaaatattccaaaacctaaatgacctcatgcagaaccttttatgttgcccatagtaattatgttcccaagagaacaataaatatccttcctgatgaggactgcccatcatcttccactctcccatcacatgcgacctcatcttcccactgttagccctggtttctgccctagcatttctgcatctgttttccccactcctcacctcccacttagtgcctcaaccacaatgaaccaccctcacttccctgaactcaccacgcatcccctcaccttcagcctttccagcaagccagtccttcctggaataccttcctctcctcattcatctcgcttccttgggtaactcatagtactcttcaggactttgcttgtgtggtgtgtcctgcagaaaaatttccccgacatccctaacccccaatcagcaaggctaaatttggggcccctataatagcccttgccactctgctattaatagatcagaagttcctgaagggcaggaatcacagactacttggtccctcagtgcttccctagtttctagctgtgtctaatgcatacccggtttgtgctctacaaatgtacaaacgaactatgacataagaaaataggttggcagacctaaagatgtttgacatctagaaagggggaaaggcaagatcggtgtcattatctttaaatatctacaaatgtcttggaaggagaagaatattcttaaaaaattttttttagactaaatcacttataaaagaatattctaagtagcttcaaaaagaggcaccagggccaaaggtatcggttcccaggagcctttccagctccccaaaataatatggcaaagaatgtcctaaaatgtaaaacatgggatactttgaccagtattcagctgcacgtcactggatgggttcacacatgggctggcaaaatgaactacataatgcctgtctccttgcaaagttaagattctgatgaattaaattatacttctgggctcctgggtatgcatatatagcataagagtcattgtagatacataaagggatgatcaaaggttacattttaaggtatatatataagcttgccaccccatggagtattggggttaaaaaaatactcagaggatttcaaacaaaacaaaacaaaataatccaacccacaaacccagcattccaacacaggggataacacctgcaagaggcaagtccggatcccctcgggcattctccgcaccacctccctcatcctggaagaggcaatttaactttacaactttcaagaaacttcctattagaagtggtttccaactttagatttattgcattttccaaggttacgtcatttgggctgtgcataatccagagggactcaaggggcacactgtaaactgtgacaataaatattaacgaatatgttcctgataaaacctgcgatctgcacacacgcatgcacacacccacacaaaaagggacttttcaccttatatggttacttttaaaaatagactctttttacatttcactttgttggtctgccaaacacacagagtacatttactttagaaacaccaattaaaaatattaacaacgcaaaaatatataaccagagctttagagccaagggcacataaattaacagtattcaattcagacagtaagtaaacataaaatcaataacagaaaatactacttcatacaaaggaaagcaagaacaatagccctgaaagtgaaagtgttcctcccctcaatcccagtaccaggactctggactcccctacttctcccctaccttgagatgtcaatctaatgattaggaagcaggtaaaaagactgtaggagggagggatagaagaagatgctaaagaatgatttgggcaagacctacaggaggtgaggagggagattatttcacttcacgctgtaatcttttatattcctaatcagaatgttgcttctactagtgttcaaaatctttgatttttcccctgtgggtagggacaaacacttgggctgcctaattgaggagcagctgtggtaaagagggctgggctgggagttacagtgtttgatctgacatccaggttctgccacttaactttttggagccctcgttttcctcatctgtaaaatggggatcctaaaacctacctcatagtgttgttgagaggaataacaaaaactaggtgtgtaaaggtggctactctaactagaaaaacacacagaaactgccgtttccaagatgtcaaacatcttggagagaaaagaactacttctctccggtacttggcaggttgtgagctaccactaatttttcaatgttaaacttaacccaggtcgggatggagccaatcgttataacattgagaggcataatgctatacacactttagacaatttataaatgaaggagggaggcaggaaaggaggaaaggtgaaaggaacagctaggcctaactcccatctttttttctgcaagtgacagatgttagccatctgaatgcattgaatgcatctcctttgtacaatgggagtggtctgagttttagtcctactacactgagtgggctggggggctcagtcaagaaccatgctcataatcttactgttgggtaattctaaaaaaattacattagtacaatcccttcctttaattgttttctatacaattatcccatgtcctctgggagctaatgtgataatccagtggagactcattattgctctatttattggagtctgttagaaaataagcatctttattacaactaattttgttccatctctaaaaggctatagcattttggtctacagattactaaattcaatttatcagactgctaaagaaattatacacgtggaaaactaaggctcagaaaattgatacaacccatgtaatgaattagagctacacacaaattaaatgacttaattcctcttctttttaatatttatatagaaaataaaatatttaaagtttgaggaaaatggccaggcccggtggctcacgcctgtaatcccagcactttgggagtctgagtcaggcagatcacaagaggacaggagttcgagaccagcctggccagcatggcgaaaccccgcctctgctaaaaatacaaaaattagctgggcacagtgctgcacatctgtaatcccaactactcaggaggctgaggcatgagaatcacttgtaacctgggagttggaggttgcagtgagctgaagttgtgccactatactctaacctgggcaagagagtgagactctgcctcaaaaaataaaataaaaataaagtttgggaaaaatggaaactacttgaacatttacacaatgaattttttttaaattaccatcatatcctgatgtgttttcaaattctgttacatttataacctatttcaataatttatcggattaaaaaaatgaaggaacaaatagttaccaaggcatgataatttgctgtttttacacacaagaatccagtggtatagagctcattatttccattttagagacaagaaaacttgcttagagacaactaatagcttcccactgcctaagtgtaaagccaaaattctttaagatgccaaactagtacagctatctccagttcattttgacatctcctctggtcccttctctgcctgttccactacatcaccagcctctccaaaacctcaagctctagccccatgatccacactgctgttccctgaaggagccctgctggctcatgcctctatgcctcacactgcctgctctgcccccagctctcttcttctcctgcaagagtaccaagattcaaaccaagcttcactggaagtgtattctgaaatgttgtctaattctactaaccgtagacccatgtgaccatttccccgtggaattcctcctacccttctgtggcacatacatgttataattcttgttggctctcaaatgtctcctttctttgcatggtccttgaaaggtgggcctgagtgctatgtaagcactttcctgctgggctcagtcacacactgcccactgtagcagctttttcatggctggcattaacaggccctagttctctctcttcatggctctgctcaagccgtggcagttaaaaatagaccctgggtggctggttattttccctttctgttactgttctcttaaattcaaactaaacctccatgttaccttcaaataataataataataataataataataataataataataataataatgcatgcagggcttaatacctaggtgatgggttgatagctgcagcaaaccaccacggcacagattcacctatgtaacaaacctgcacatcctgcacatgtatcctggaaattaaaattaaattaatttaaattgaaaaaaaaaaagaagtgacatttctgagcccattgagcctttatataaacatatgaatatccagccctaataactaaaaagaggctatcttggaaaatgctttgtgatgtgctgtttcatatcactgaaagaaacctgtgttttcattaaacaggttccaaacacaggttttgttgaatctaaaaaatgacatttcagctgttattaggcctatattaagaacatacaaatatccaggcctaagaactaaaaacaagctatgtgtgaaaaagctttgtgatgtgctgctttatatcactgaatggaacctgtgttttcattaaacaagttccaaacaaacacacacaccaaaaaaaaaaaaaaaaaaaaaaaaaaaagaaagaaagaaaagagaaaaggagaagtgccaagtaactactgattagcttaatttccagtctgacggctgaactactctgcagaggttcataggaggccccagagggtgaaaattccaactgtttacggtattaaagaagtgattaagagcactgttttgttccttaaaagatgtctgatgatattaccacacagaaacctaatgaggatctttcatgtctctctctctatatatatatacacacatatgtgtagatacataattttgtgttagcatttcaaaaatatcacaactatttgtgaaaaaaacaacattctggcttcaagtcttggttgggttggctttcttcaactaaatactttctgttaatgcttagaatatgtggaaatcagaattcttaagaatagctgctatgcatacaatgcatgtggttcattcgctgctgttactactttccatgctttatcaccggcttggccctttcactgccaaatcagatcaccctgatgaatgttttgtcactcctctacttcatacagtattttttttgctgtatatcaaataaaaaataaatgtacaaacataaacacaagtatttttattcttacagtatgttaagcagggttaagaggaggtacaaaatagcatcaagatttctagcttgggcagctgggaaaaagacagcattattaaatccagctagagccctggacagaaataggtaggaagacctctttaagaagaggttcctggatttggaaattaggaagccattggtgagggcagaagctggactgtaagtcgggggtgggaaattaggagatgagtacaatgaattcaggcaatgtgaagatggaagagaaactggcagagtggggagcagggaaagggagattttattagaaagtgggaccactgggcgtgttataaagttgtggaaaaagaaccaatagtgagaaagaaactacagctacagaagggaagggggtatttgatgggcaagatttaagaggcgatgcttatgatccaaagcttacatggaggtggctgggcgcgggggctcacgcctttaatcccagcactttggaaggccgaggcaggtggatcatctgaggtcaggaattcgagactagcctggccaacgtggtgaaaccccatctataatctcatcattagccgagtgtggtagtgggtgcctgtaatcccagctactagggaggctgagacacaagaatcacttgaacctaggaggcgtagtttgcagtgagccaagatcatgccagggcactccagcctaggtgacagagcaaaagtccatctcacaaaaacaaacaaagcttagatggaggggacagaatcggaaaccaagagcaatacttccaaagacaggaaaaggagaacatgtgtaaagatgtgaagaggtgttgggggcagaggaaggaaagcaacaaagaagaaaggtgaggaaggtgaaggtgtttgtgaagggtgagagtggttaaggaataagtggaagaaagggcatgaaaagagtgttaaagctttggaatcatggcttagcaatgagacagaggcaataaggaatgaataaatctattattgacaggacccatttgaagctggaaacttaaaaacgtgtcagtcaatgaacacttactgaataactctgaagtggcaggcaccttacaacctagccaaggactccaaggtcaagtccgggagttaggcaagtaaatacgtcataacaatgtggtaagcgctatgtaagaagtctacataggttatatgggagaacagagaagatgcgtttaattcaagggtgggatgggatgtagtttcctggagggggaatatctgtaatctgtgaaaatggagaacaggccattcgaaattccatcttatttccttccaggatacactaatgtggaaggaaggtacatgaccatactctatgtaaaatcaagcaattaaatacattggcactgaaggatcttcatcatcaatgctccaggaagttatttcattatcatcaaagagtttgataggcaagactaacggagctccaggaaaatatgattaatttttttcacagtctttcacaagtaaaaaagtgtctggctttggctgtatatcttgttagagttctcaagcattgctgggaactgttctgaggaactggcttcctgattcaacttgggccactaaattccggtttaataattacttctattatcccccagagccaagcacaaagcaaatattttcttaaatgccttcgctaaaaaaatcaattatctagcctttgttttcatcttttaaaaatgttgtaggtatctttccatgagaaacaaatattccgtaggtctctgtttatactccttgtcatttacaactctgaaaatcaaagtctttactaagttttgctaatagctctgttccatcctctgtgtgagcatgccactttattactacagagaagacttgagttctgacctgcaggttcttaatagaaaaaacagcaccccattgctagaatgatacagccatagaattgaaaggggccttgaaaccacttgtgtaatcacttaggtgatgaaagacaaattacccagcacttgatctaattttctgttttaagtgagagaagataccctttcatttaccattatataatggaatctttgtaagaggcaaaacagatgagaggagaatggcaggatttttctattcaaagtgattttgcctttgctaacatttattgtgggcttattttatgccagacgtggtgcttagcacttcaattatttcattttaccctaacaataatcctaacagtctgttgtgacttttttttttctttttttttgagacagagtcttgctctgtggctcaggctggagtgcagtggtgtgatctcagctcactgcaatctccacctcccgggttcaagcgattctcctgcctcagcctcctgagtagctgggattacaggtgggcaccaccatgcttggctaatttttgtatttttagtagagacggggtttcaccatgttggtcaggctggtctcgaactcctgaccttaagtaatccacctgcctccacctcccaaagtgctgggattacaggtgtgagccactgtgcccagcccagttattcttattttataatgaggaaattgaggcttagagaaactgagagtcaaacagaggttgagttctttttctggttttgccattaactgatgagtgactgtcatcaagtttcctaatgtcccttgtttgtgttaaactgggagccattatgatacctatctcacagtgtggctggattattatgtgagatactggcccaaagtgtgtctagcatgaatattatactccctcttggcagcaggatggggtatcagagagaacctgggctgtggaattagatgacctgggctcaaagcccagctctactatttcttagctatgtgatgttgggcatggacttcagcttcctgatcttcaagtttgtcacctgtgaaatatgaagaccaatatttgtacctcacagttactgaagtgttaagtgagatgagccctcatacagcttgcttagcctaaggctgctacaaactgagatgccaccaccttctcctccttgagggtcacatgtacaacaaggtaactctcttaagggtgcaacaaaaataaggaatgcaacttctaagaagactgcaggggagctttaagagacttacaatgtgggaagagaggcactggtcaaccacagagcaggtcagtgtgggaggtatgccttggtgccttctgcctccagcatgggcagactatttgtggatcaaggaagacaggattcctcatgaaagggcacaactgaataagctagctaattgcctatgtggactgtttgggcagttctctgtcagtatagactgagtttctaggaaaggccatcactgtggtttcattatctatgaaaagcacattccagtagaaatgacaagtaatcagtgtttcaaatatatttatagcatcttcctattagcaagacaataggaacagccctcacaaagtcatcttagaaaagactggttggattttattgaattctttaaaaatgcaaggatttaggaccccattcaaaggtaaaatggtccaacgtggcatgaaatagagacagatcaactgccaccttcctaggacataataattatacaactccagtccagacaaagtgacataaaggcatctgtacctcaaactgcaccctcagaacctctgcactacttcacttccttagaatttcattggttatctgatttctcagtctaagaaattctacttccttagaatttcattggtttgccctatgtctagaagcaaaaactagacatagggtagaaggtagaagcaggtcagaggaacaaagaaacgattggttatagcttaaccaataacttaaccaatataaataaatgattgttgacaacacagaggaagtagaaaatgaaatacaaaaagataatattatttaatacttcatatgctgtttatatacatagcattgacctttaagtatgcagctaagtatgaattactttaaaatatatttttatcaagatgacaatttttaaaaaagttctggcacttgatagagaaaaggaacagtcatgagaaaatccaccttcagagaccactcagttcagtgacaaaaaccaaatcaatgagaggctatattctgggttatttccaaaactatctacaatccattgcccattttgggggtatacctctatagcattctttttttcattatgcagaaaaacaatccaacatataaagattgaaattatccttaactaattcaaataaaatctgtaagacacgttttcttgtgtttcttcttaggaatattcatgagcaatttaataataactgtttctgttttttcccttcttcactcaaagctagtaaactatagatattatttaaaaatatagggtagaaagaggaaattcatgcttcttgaacagtgctctctttctctctgtgtgtatgtgtttaaaagccgtgtatctatgcctataagaaccaaagcatagtgttttctagcaccagaagtttaataaactgagaatgtaaatgatccattccttgtggcttctattccacaatgactaagccaaccatgaatgaactccacacagatcctgaattctttacactggttctcagagttggaatttttggggctggggtaggatcagccagaaaattattctgtttcctcaacttgaacagacataatgactggcagaagaacagctgaggaaaatgtttgaattgtatagtgataatttgctcattatgaaaataccttagatgtctagcttaagccaaaataatccaattgaaactgccctaatttgatttaggagacaaattttgtgatcagagactatatcagatctcaaatagaaattgacccttattccccttattaagtcaacgaaaaaaaaaaacacatctataggagactgtggtctgtgcgactcttaacaacctctggtgatgcctgtgccaaatctatatattctctttaacagcttcagagttggccctaggtcacatgtgcagttacatatggtccactggaataaacagtaatttttaaaataaatttcaactaagggtgtgggggcaggtattcttgcagattgacttacttataggttctctcactattacttcagaacctcatctaaggcaagggtcagcaaaatatggctgttttgtaaataaagctttattggaacatagccacagccattcacatgtatatcattccatagctgctttctggaaagatagagtttgagtagttgtggcagaaactgcaaaacctaaaatatttactgtttggctccttactgaaagagtttgctgacccatgatctaagggtacctattgggtcaattagtcactggatgtcattagggaagagacataaggtggccaagcccaacatagtggggactgtgtatatgtggtgggggaggtggtcaggcagcaatgatggtacaaaaacacttgcttcatcactatttctcatctttcttagtctactatctcacagagttgcaaatacatgagctctactaggtcaagtccaagcgatttttaccagggagactggactaaaacaaaatctcatcatttgatgactttcaagacaacctcattcattcaatcattcattcattcgacagagtacatactatgcgcaaggtatccgtgagcaaacagaccacgtcctgtacccacaggactaagggttcagtgggggaggttgaaattctttagataataatatagatgtaagtaaaatagctactgtaattactggtagaagaaggaggtcttagtgctactagagtgtataatgtggttatgaagtcagggaggacttctccaggaagtatcagctgagggctgaaggctaagtgggagttagctgagtgaacagctgagggaagaggcccaagcagtgagcacagcacaggcaaaggcctatgagtgagagagaaaatagttaagtgtaagtgacttaactcaaggccagcacgttaggtgcagaaagagtgacaaagggaggggcatgaggtgaaactgtgggccaaaccaagcagggcttggatccctcttaacaagttttgagttattccaagggcagagtcaaacccaataatccctgggtgacagccttcccctccctccagctactactgtctccgtgatcagtttttctctctttctttctctctctctctctttatttttactctccttttaatcttgggccaaatacatagctctgttttgaatatttacctaagtctccagcaccatattcaatgagcacaaagcaaaaggaaaacataacaaagaatttaacacacagctttttctgaatatatgaaacgtgtaaagagaatcgtgggctgcctccattcctctttctgtctggggaggcgaatattggaaatggtgagtggggatagtcatacagccatgggccacttcctgctgggaacagcacattttaaaacttcaagtatactatccgatgaatgaaattttgtagctgaaaaggaaggaaagtcaccaggggagactagtgaaaacggaagataatataaagaagtgaaaaaatctcaggaataggacatgtgcatcatggccctgccacttattaactttgtggctttgggcaacttacttaacttttctaagttctgatttccctacccatagaaataagaataatcaggcatccatcacagaattgttaggattaaatgagatgctgtaaaaatttctaacatttagtaagagctctggtataactatcatccttttccagtaatatagtctatttccgatacatagcatggacacagagaaaccagggcaagtggcaagagaaaatatagataaggaagtaaataagaaaaaagtcctatctacagttacagtaggtggctccttgtgctttataaactttacctacttttgttctctaacctaatggttccaagtgactaagtgacaccttaaaatgaccttgtccccaatcctccttagcaggtagccaaaaatacatataaagtcgaaggtagaagcatacctttgattatgaaagtaaaggttattctgggaaataattaatgatatccaagaatatgtataaagcagcaacagaacaactcagcctgatacctccctaacacacacacagctgattaagaatgtccttggtaataattgtgatggattttaaggaaaatatgaacaaatcaaagaattatttctacatgtaagtctcattctgattctcagaacttagaagaccaaaaagtaaaaattctactttagatacataatggctaaaagaaccactacaaatatttcattgtgcaactctaatcaccttttaagtgttgttgtacctttctgattaggaaattataacataagcaccatgcacttctttgtctttcttaggaaaatattaagtactttgaaatacagccatgttagtgccctgagaaagattccaaggttgctatagaattgtttgtttttccttctttcaactgataaaacgtactgcgagtaaaattgcctgttgaaaggtgggactatacgtggaagcacagacagttatgcattcctgacttcctcaagtaaagaactactatacaactgactttttagacagagctgaagaacaaaaatcctaagtatatttaaatatttaaccaagaagccagttgccaactatggagggttttatttaaatttagcttattaaaaacaaacaaactgaatcatacaaatatgtcaaaataaaaattgaggaaaccagcctaaagtttttttgtaggcctagcctcagcatttttagaaccaggaggttacaaggcaagtttttctttagttataatcttaacaataaatcactctggctacttgctcacagatttttgggaactttatcctgctttcacatttatgaaatattcctcccaattttttttggaatttactcaccaaaatttatgtcaggtggcattcaactaacagctgtatgctaggaaataaaatggctaaaggattctggatatatcttgaaagaattggccacatttttaagaccacacagttatgcaaaaagacccctcatagtatggatgtgtgctggttacagtgtgcagtttacaatgagggtgtccagtctctaagtcctgctgagagggagtggggcaaatcaatctccagatccttccaaccctgatgatgtcttatgattctgaggctctcttctttcttctctttttctttcctttctctttttctttccttccttccttttcctcttttttcctttccttcccttccacttccctttcccttcctctccctttctctctcctttctcctcttcttcttcctctttcccttcccttcccctctttctttctccctcctcctcctccttcctctctctctcccttcccctcccctctctttctctctccctcctttcttctccttcgccttctccttcttctccccctccccctcccttcccctcccccttctcaggctgaagtgcagtgatgatataatcatggctcactgtaacctccaattcttggacttaggtgatcctgatccttctgcctcagcctcacgagtagatgggactacaggtgtgcatcaccctaccgagctaattttttttctttcttatttttacttaatttttaaaaaattttttaatttttttatttttttggagagacagtctcactatgttgctaaggctgatctcaaactccggggctcaagtgatcgggtgtgagacaccatgcctggcctgagactctcttttctaaacaaactttggttcttctctccatgtcctataccatgcaatgttttagtttttggtatactgtttggtaaccatgtttctaatgcactactgttaactacttattttttggacataagacagcattaaaatgatgacatactctataaatcagaaacagaatgttatagctttagaataaaaaatacttattatcttaccaccaccattgtctacacagctctgcttttaattttgtttgaaatatgctctacaggtctgattctcatattttttattcaagtctatatgatgaggtaatctgtaaatataataacagcttcctccatgaaaggaaaaaatgtgcaaataaatgtcctattgttaaagatgaattatttggacaaatattctaaattcttatttcattttcaaattctcaactttcagggcctagaaaggtagtatagtggtctaccccagcagtatacatgccttctatttttctttttaccttattaaaagtattcaaaacaattttatatttttatttggtaagggaaaaagaatttagaggggaggtagaataatgattatgagttgcgattaaatcctgcagccactgtcatcatgactttaaaacaacgaacagatatttttctcagccgaggacagttctcatggactcctgccagttttgtgaagtccagacaaagtcaaggttcctttttagctctgggtcccttctggatccatagggaaaaggccactaaggtgaagggggtggggcaggaaggactggagagtggttaactaaatatccaataataggagaatggttacataaataatggcacctccatacaatgaaatactatgtagctatcaaatatcatggtatggaagatttatgacaatagctaatgttccctaaacaatatgtatagtataacagatacaaagataagaaagtctatgggaaactatacaaaaggtcaagggtataaatctctgcgtggttgaattaaaggtaaattttaaaaattctttgtgcctgcttccccatttttcagtgctgaatatattattacttttttttttttttttttttgagacagagtcttgctctgtcgcccaggctggagtgcagtggcacaatctcagctcattgcaacctctacctcccagctgcaagtgattctccctgcctcagcctcccgagtatctgggattacaggtgcctgccaccacgccccgctaatttttgtatttttttagtagaggcggggttttgccatgttggccaggctggtcttgaactccagacctcaggagatccgcccacctctgttagcacctgtgcaacaaatgactgtatccttgatggagacagtgcctattggcaatttggtactttgtagtatagagccagcaaatcactactttaaatactgcagccaacatactggaagaagcagtccctactaaaggctaaaaataagaatactgtggattcaggcctccagatgtagccaccaccacgttaaactacaatcatccctcaaataccttcaagtaattatgatgtgcatggtaacttgtactgaagagagtgggttagatgcataaagtcttaacactaaaaaaaatggcatcatttgcttttttcagattaacagtctgtaagaccaaatgccttcagcccattctttagctgcagctacatcaacagggcagttctgatacagacatgaaatcatttgtgtcagaaaacactaccaaaaggttcaataataagaaagcagtcttttgtttagcagccacacagaaaagacctttggatactgcttacacaccctttctaggatgaaaactccttttccgtaacaaaaaatttccaaattctccattgatagttgtagctttttctattcattgactgagtgaagacatagttataaaagcctataacaaattcagaaaactttaaagcagcttataagctatcaatcacaatagtatccagggctattctgaagatgtaatagacatacccaattttttaaaatgcttttgctatatggattgcagggccccttttgtcaactctgaaagctcccaggagttctgggcttacaggttgagaatgactatcataaagcatatattatctgatgaaccaagaccataatttcaagaactttatctttttattggttattactagaaatacatctaccaactgtctgtatgcacacactcacaaaagagctgctaggcagaggatatgaaaacagctatgaatgagttgcacgctgtggacacaaaagcatgtgtggcacttctaagcccaagggcttctcccactggctctgtgacaagaggtttcgcataagaggtgggaacgtgagagccctgacagggtttctctttttaaaaaaattggggttaaagttgacttctctttccttatgaaggcttcctgtgtcaacaggctgccagcccccaacccctagcaaaaacagtggctgctcctaaatgccaaaataattgtctgggttttgcatgctgaaattgacttggcaggctctctaccttgcaaggaacacaaagagcttagtttagtctgtgtgtaaatgcttcataatcattgctaaaacatccaaagcaacatgcttaagggagagtaatgattctttgtttccctccttaattgtaagcttctgacatccatttatttacttacagttcctagcagcagccaccctccttagtcaacacgcactcttggctgccctgggtgctttctaacaaagggctatatggaaccacacacagtgggtggaacccccaagctcaatctatccccattaccacagacctcagagagtctgaggtccagatctacgcaacaaggctgggaagcagtctgggtaagccaacctcacctcatgagggagtatggggaaagcactccttcgtagcgatgagtgggactttggaaagggtggagatggcccttcttagaggaagacatgagaagaaaccttttatcagtctgaagaacccaggacttaacccgaactcatagggtctagtcacagccacatgaccaccaaaaagcatcagggagagcacagcagggtgactgcttgttctgtgtattttccttgatgctttttgatgattcttgatgatttttgacttaagcagagtctaaaagctgttataagctcctgctttataacaactccctccctactgcctagaatgagccgaataatgaacagtagtgaagaagcttgaatttaattcactctgtgccttcatcgcagatttgaccaaacctaggctttttccctttctccctggtgatctatgtttttttctcttctcaccactttgtgatgcaggtctttggtgaaagatactggctactttaattttattgatatagtcagtgctgcaccataattgctgagatgtctctcccaactttacacagataattcttcctaaagagaaggaattcaggcattagaaagtaggcttgcaaagactgggtgggctctgaagccagtttgaattcctgttctgccacttgccagttctgtggcttggggcagattaacttaacctctttaggtttcggttactttaacccataaagtgcagatgaatcagagtactaccttacagggttgttttcagtgcctaacgatttagtgtgcacaaagtgccttagcattgtgcctgcagacagtaaattttgtgttgctgttgtgttagaggattaaaaaagtcttgcttggtggagagacagacgtgacagcctgggtgagtatccccctctgaatcagcagcctttgtcatcttttttggaacagctgtagccagcttggaccaagaagtcatttcatgttacgtccctccaaactggcaggatcatagttccctatcacctctctactaaacaacaagcactggttcttggccaaatcccaatttcttcagcttgccaatctccatctcagttaggcacaaaataacacacactcttaaaatacttgtttagcactgactagaagaactccctccctttggtgaggtagggcctgagtaatgtactctcctcatgatgctaaaaatccactagttattttcttatctcatttgatgttctaagagggaaggcatgtctgctgaaccaagagataaagttgtatcattatgacatctccattaggataagctatgagttcctatcatgttctaggtaccaggcacagcatcttgtatgtgtcatctctaatcctcccaataaccctataaaacactgagccctgaagaaatgaagtagtttgacccaatttggacagcagaagttgcgagggaagtaagattataactcggccaggccgactccagagcctatgctctttcccctgctgtctaccatgctgtttattactgctttgcttatatttggattatagaaaatagactgaagctccaagacaccaaagatgtaatttttttttttttgagacggagtctcattctgttgcccaggctggagtgcagtggcgtgatctcggatcactgcaacctccacctcccgggttcaagcgattctcctgcctcagcctcccgagtagctgggactacaggcgcatgccaccacgcccggctaatttttgtaattttagtagagatggggtttcaccatattggtcaggctggtctcaaactcctgacctcagatgatccacctgccttggcctctcaaagttttgggattacagtcatgagccaccatacccggcaagatttaacatttaaccaaagtagatggaatatgaaaaataaaagcccggagttattaatccaaatgtgtaatgttattgaaggttttatcttatgaagcttattctgaaaaagtgtcagggctgacacattttggaaatgtcttcaaacctcctttgaaggccacacacaaaagccagtcccattattttaatgtcataattggttcttttgaccaaaataggcatgagctgaccactagattcactagatttgtttttaaggaacctgttcttgttatcagaaattaagttcgcctttaaagaaacaggctttgccccagctgagggatatttcaaagcagatgactccaaaagtggaggtccaaagttgttctaagcagtggtaatgttgttaaaatgaggtcacagcagctctttgccccttgaaataattctctcttggctcctgggacatagtttactctcctgtttctctgtctatgcctgatacccaagcttggtgccttccttcttcttttctcccctttcccccatggcactctctttttttcttttaagaaaatcacctcttgtttttcagtttttttttttgagacagagtcacactctgtcgccgaggctagagtgcagtggcactgtgtcggctcactgcaacctctgtctcctgggtccaagcaattctcctgcctcagcctccagagtagctgggattacaggcatccaccaccatgcccggctagttatatttttagtagagacggggtttcaccatgttggccaggctggtcttgaactcctgacctcaggtgatccgcccgcctcggtctcccaaagggctgggattacaggcgtgagccacggcgactggcaaggaaaccacttcttaaaatgtttatgtatccaatatgtgcctagtgctttctttcaaatcttttattatgaacatttccaaatatacaaaatgtagaaagaagaataaaacccatgttctctttacccatcttcagagatcctcaatattttgccatatttatttcacctctatcccctgccattatttttttctggagtatttaaaagtaaatcccaggagaacatgtcatttcacatttaaatacctcattatgcatctggaaaaataaaaagcacattcttcacataaacacaatgccattaacacatctaataagattaacagtaacttctttttttttttttgagatggagtcttggtctctcacccaggctggagtgcagtggcacgatctcggctcactacaaagctccacctcccaggttcacgccattctcctgcctcaggactacaggcgcccaccaccatgccccactaatttttttgtatttttagtagagatacagtttcaccgtgttagccaggatggtctagatctcctgaaaacagtaaattcttaatatcacctaatttatagttcacattcaaatttccttagtcttcttttcccacctcatggataatcaaaccagctgctatcaaggcaacatgctattgcattgttgatcaatttcaaggttttatctcattcatccccttttctcttctgaaaaacacctcacaaatatgaaaacaatataatagataaatcaatatattttttccaaattttttaacttattacaaattacaaatattttcctacattattaaatactccttgaaaacttgactttttctggctgcttcactggccacagaatatgtgcactgatattctatgatccatataattattccctattatttgttggatacatggttgtttcatctcccttattataaacagccctgtgatgcatacccacagttgacctttctgccctcacttttcaccattgaacacctcctgtgcttcagcataggcacaatttgatattccccacatactgtgtttttcatccaccttctacctatacatatggcctgggaaccctttttcattctccaagataaagcttatctctgagatggctttactaaggccctttggcagaattagtcattctttctcaaatccttccaaaacactttgtgcattgaacattatttacagtatttcctagtattttgtatttactcgtgaacctgtatttctactattaatataataagctgtgagctttataacacttcagttttttcatcagtagattgaagagaataatatcaactccgtgtgtctaaaaaaaaaagacgtaaggaataggaagaatgaatcgtattatttggcaaaaacagaagctttagaaaagttagtttccctctcttcccctaaaaagagaaagtgcaaatgtttcagactaaacttatatgcttcagaggcaagaagttattaaactttctgccagttataggaagataaatggagtatacctgagatgctgggaaaggggagccaaatggcttagaagttaggggtagcccaaggcgctttaagagttgcaacatcttctctacaacaacccatctctattctagtcacagttccttagatgaaagaaagggaagacctcacgttggaatgtaaagatggaaactcttgacctcctctgaatcacctgtttacctcaaggtccttattaggctgggttggcctaggcaagaggaggccaaaaggcactcagggtgatctattgttacctaaaaggtgaggaagatggttcacaaaaataaaaatttgtaggaaatttcgggttctctgaaaggtgcatttttatcttttaggattcacatcttcctagagctggaggaaacaggggttggcctatgaacaagaagtgatacaatggaaagaacaacagagatgtaggcaagagacctgccttctggtgttggctcagggcatgaccataggcacatcagttaaccttgctgggatttggttacagtgtaaggggattggacaaaactggctccaaggtccaaacggacaaaaattcaaagaaaatagaaaggttaagtgactggctcattatcactgtatttctaagaaaaaccagagcatgaagttggaagaaatatggaaagtgatgtagtttgaaaactgttaaaagaatcatatgattttcaagagctctgatctagggttggaagtgtggcatttaaaaatgcatttaaacctaacttggactacataaaaataatttcctttttctgctgtattccacaaagatctggaaaacattctcagccctgtttcaaccttaaatgagaaaagaatctttaaagagtcactgatttgtaatggaaaacttggataaatcactatttatacttgaagatttttatatttctttttgtcctttcttcacaacacacagctaagaaaagccatgatgtaagtctgccctactggacctcatcagtggttgtttattctgtatctacagcccagcagcttctctgactgcagcacgtagaaaacaagaaaccaaagaacacttccaaactaaaaagagagtaaatgtcaattaatttagcatgagcatagagaaaaaaaagtcagaatacctagctttttatctgtggtccactgtttgtaaactaaaattattgaagattcctgaatcttgcagacgaggaatctgcaaactggggaaataataccctgtctcctgatgtatcaagaaacatgcatgtgaaaggtatcattacaagcattcacctgataagctaaactggaagaagttttcattaaacacctactatcaaatttttggatccatacttaaaattccaactggaaccactatcagaaaagctgctaagatcttccctgagtatataccttcaccaattcactgctttagttgtgtttaatatctgggaaattatacccaattccatgcatatctttaagaaagaccctgggctgaaggggcacaatcaaaatgtgtttgtgagttgtgggtggaggagactgaaactaggtggtgtaagaaatgaataaagaaactgagtgtttcatttggaataaagaagaatagagtcctttcggttaaaggactacactgtggcaagaagagtagcttggcttgctttagttctggaggcagaaccaggatacacgaactaaagttcctgggagctggatttcagctcacaacaaggaagcacttttggacactcacaggcatataacaagtgagcaggtgatgatggaaaatactaagtgcctgatactatgggtgatggatgagagactactgcaccaccttctgaagctcttatttgattttctctctgtggctttgactttctcttaggacttagaatccttgggaatatgaacctgaatcatacatccccactttccaatcccttgtctaaagacttgtctatgccctacaaggaaaaatatcactaagaaaatgtttcaatgatttttactgaaaatgggagaaaaaagataacggaggccaattactaaattaggttatcttgttttcaattgtctttttttagccatcagatagctttactgcagctggctgagtttagtgtcttcaaatgtgggtgagtagggcaataaaaggaaactttttttttttgaaagaccacataaaatacccaacaggattttttcccctaatctggccatgtgagcacaacctggctgttctgcaactgagcgctattaacatctatttatagccactattttcatagatgaatcacatttaccataagtcagttaatattaaaggggccaaccagctctgctgagaaccccataatcttaatacatctctttccattctttcagggaactaaatcttagcttaaaggttctgtgtaaagatagggggaaatgcaagtgcaaatgtaaagatagcagacagtctgccctctaaactcagcaaagtatggggtgttaaatatattcaaatttaaagccttggatcactcccagctttgttccttggccatgagtgtcgtacagttagcacagactcactccgtgttatgcagtcttcttgccatcaaaacaaacaatttatgtctaaaatttcccactacactaagtttaaatgactgccttaataaaatgttacatgcttaaaaacagaactaatgatggttaatggtgctgtcaaattaaaaaatagtgtagtgcatactcagttcatttcatgcatgtgagggtgtctgtgagagggctgggggtgagggatagcagatcagggtatttatgatcgaaagtttacaaaattcagtgaaattaaatggagatttccagtaagttacgtggatctaacatttcttccccacccagcacgagtgtgcatgcacgcgcgcgcgcgcgcgcacacacacacacacacacacacacttcctgagccttttgcaggcaccagtgctgccctgaaattgatattaatttatttgtctttgctatctcttatgagagtctccaccttaattcacctttaccaactcccttcctacaggttttctgtttttttcatttacttcaggctaaaattctttaagataaataagataaatgaactgaagcacttaaaacagtgcctggcatgtggtaagaggtctatacacagctacttcagtagattctcagtaccctttttctaatttctagccagtggtttgcaaatgaatcatctttaccatgaggcagctcctattcagagccaaccagctctgctgaggactgcatgattcaatcactcaataaatccctgctgaggtccaactctgtaggacatggggatacacacattaacaacaggggccctgtgctaaccaaatatgaataataaacccattagcaagtaccattatctccattttacatttaaaggctcactgacgcccaaggccacagagctaacatgttggagctgtgatttaagaccagttctatttgattccacaatctcatactctttctattaagacatgtctcctgccacttcaatatgacagcagtggttgagaaaagcacatgaaaatttaaaaatacatagtttttgcacataaacaatatatgaaaacagaacatctttattgaatagactcaaaggctaggggtttgtgaatttatgttactcacatttttgtataattttggatactcagaattcaacaaattggagattggtccacatatgaaaataagctaggctgggcatggtggctcatacctgtaatcccagcactttgggaggctgaggcgggtggatcacctgtggtcaggagttcgagaccagcctggccaacatggtgaaactccatctctactaaaaatacaaaaaaattagccacatgatggcaggcgcctgtaatcccagctacttgggaggctgaggcaggaaaattgcttgaactctggaggcagaggttgcagtgacccgagatcacgccactgcactccagcctgagtaacaagagcaaaactccgtctcaaaaaaagaaaagaaagaaaagaaaataagctagttaaaacaaaattgcgtagcacaatacttgacatagtagggcttcatttcataaatgtttgttgaataaattaatgttaaaccaggatttttcctttactatgtatatctttttataaaagctaagtagatacagcatagtgatttagtaggctctggagccagactgcctaaattagggcctgactctgactctgccactttttagcagtgtgacctttggcaagtgatttaaaaaggcttcaagcgggctgggcgcaggtggctcatgcctgtaatccctgcattttgggaggccgaggcaggcagatcacaaggtcaagatcaagaccatcctggccaacactgtgaaattccacctctagtaaaaatacaaaaattagctgggtgtggtggtgcgcgcctgtagtcccagctacttgggaggctgaggcaggagaattgcttgaacccaggaggtggaggttgcagtgagccgagatcgtgccactgcactctagcctgggcgacagtgtgagatgctgtcacaaaaaaaaaaaaaaaaaaaaaaaaggcttcaagcttcagttccttcctctgcaaaataaatgagttaatcaaaggaaggcatttagaatgggcttgtatatgataagtaatgaatacatgttagctaccattattactattattttctttctctaaattggagtagttttgcttggctacctcgataccatattaaatgaccaagaccaaaaatgatttcttttttgaggcttttcacttacttgatacaagcaaaaatatcctctagtcacatccacaattctaaaacaaaaatgagtaagaaaatgaagactaaaaagtatgtctaagtagcacctaactatgtagagtaatttttaatatacaacattaataaagaatgatttttaaaatttaaattttataataagtaattggctgaggggctgctggaggaaggtaatgagtagaatagacttctatttacatttggccatttcctgcaaataaattaagtaaataattacaaactctcttctagtcctcttgcatggacacatccttaccaagatacaccatgatttcaactaacttaagcccaagtaaaactgactaaaggaactacataggaaaacaaagcaggatctacttctcactgccaactgcactgtatttgtatccatagatacaagacaacagagagtcccagaattctaaagcgggaaatcccgggacttcaaagatcatccagtctcaggtcctaaccctgctatcacgggatccatcagggggtgaggaacagggtagaggtcaaaggaaacaatccttggtccttgttccagcctgagtgatctcatgggacaacctatcccagtattctcattttataagcaacaacacagaccctggctaattaaaggcagagctgggatcagaggctgggtttcctgattcccagcctacactcctgaaggttatcgttctagggttatgacagtcacagataacaacacattaggctgtgttaaactgacaactaagcaggtttttttcccttgtaaactcactaggtactaggtcagcacttcatgaagagtaaagtatcattatttggcatacacaaaaagcaactttcctttttttttttttggtaccctgaaaatcccaaaccactgttgctattacaaaatttttctttaccctagtatgcacccctgggccaagcacagatgcattaaaaatttgccaagagaaacaatgaagtcactgataatacaaagcatgagagtatcatgaaattcatgtctttgttttcttcctctagatacttaattatttctcattactgatcattttgtggttattggcagaggggcaaggaaactccaccactgtaaacatgtagagacacatgctcctcagtagaccagaagtctgcatatgatgggtctgttcacaaatccaatgtgaacaccacttcattaatcagtgagaatgttgatgctactatccccagcctccaaagagaattggtggtctcagtaaaactctaatctctttagaagaataacaaacacagtataaaaatgtttcaggtcattcctttttttaccacttatgaatatcatcactggcaaatgatctatgttctcctaccagatttcatctaacccactttaagagtgaggtgaggaagctagaatgtatacagagctccattcagtcttctgttgcagctcagggctgccttaagctaaaagggcactacttatgaacaatgtttagcaaattaccctgctaaataaaagcttacattatcttggtattctggaagggatatcctagattaagttgatgagggcagagaaattctcattgattagcagcaggatacaagttgattcttatcagtagactattgttccacacaggactatgtgggcaagaggaaaacataggaattcatcatgtaaaatgaaaaaaacaaaaaccaaaccctatgtacttccaggaaatgaaaagaagtaaagaaccaaatatatttcgctcctcttttaaactagacttttattagattttcacagaaatctgaatctgtgggtgtggtgaactttttcaaagatggctgcagttaattccttccattcctttgcaatgtggccttgtatcttcttccatgtagaggtgtaatctatttcctcaatcttgaatctgggctgacattgtgacattctttcacaaatgagatgttgggagcttcaactctcacgttcttggaatgttatcctgagaccaccatgtggggaagcctggtctagcttcttgtaagttgagagtcacatacagctgagatgagatgacccggctgaggctctcctagtccaactaaccaacagccaaatacgtgagagcccgtcttagaccatccaggcccagaatagctgtaagaaagctgaagctgtggagtaacccacagaattctgagccattgttatttagcctccatccaagttttggggttgtttgttaaacactaacatgtacctgagacagttgggcacaaagtaaaaggagcaagccagtcaccctaatgcatgcccattatgtatggagcaccaggtcagatacgccatgtgagacatgaatgaagaataaaattgtcttaaaaatataagacaaaggacatagatggccctataattaatctgtgaacatacctataaataaagcagaatgtaatatttacctatattaaatatatttatgtaacaaccttccattatttctatagcccagagtaaggatattcctaggtgttcaagaaaatacaataggggtggggaaagataattagaaatcctgtttatgtataatttttcatttttgtcttttttgaatgttttttataaagcacataatatactgtggtagtacatgaatatttttataaataaatagatatacacacaatgaggtttttcccaatctcatctcttacacatccccaacctcccattcctacacaaaaatatcccttctatgcctttgcttttctcaaataaatgagcctttccctggctacctagggaagagccagtgacaactactgtcacacatcattgttcatctataccgtatttgtaaatagtctcttcagtaaggctataggcatttttcggacaaggtatttgtaccagtgtatatatgcatttgtcttaggcaatacagcataatgacattacggcatgatttttaagagtgtgggtccctgagccaggtttcctagactcaaatcccagttttgccacttattagctgtgcaaccttcaataagtttcccgtgcttccatttgttcactgtaaaatggagataataatattccctacctcatagtgttgttgtgagacttgaatgagctaatacatggaaaatgctgagaagaatgcttagcacacatagtaagtgctccctcacttccagatcaggtcattggacctgaagagggtgaatgtcctttttgttttgagacagagtcttactctgtcacccaggctggagtgccgggcgcgatcttggctcaatgcaacctcggcctcctgtgttgaagcaattcctgggcttcagcctcctgagtagctgggattacaggtgtgtgccaccacacctggctaattttttgtatttttagcagagatggggtttcgccatgttggccaggctggtcttgaactcctgacctcgggtaatccgcctgcctcggcctcccaaagtgttggcattacaggtgtgagccattgtgcctggcaatgggtcaatgtcttaatcaagttccacagctgatttgtgacagaattcttatcacctaacacaagggaaaaaaatgtgcaagaatgtttgaagtagcatttttttgaatactgaaaaaaaaatattcaaaaacagtaaaatgaacaagtaaatgatggactatataatgaaatattcttacagcaatcaaaatacataaactacagtaaaatagaacaaggaagaatctcaaaaatataatctaggatgaaaaagcaagttttagaaagatacattcaatatggtatttacataaggtttgaaaatgtaatactatacattgttcagcaatatatatgtacatgtttttaaaaagtatgaaacatacaggggaatgataaataccaaattcaagattacgtggttacttctggagtgggaagggaggagaaggggtttcagaagagatacatacattataatacatctataatacagtacttaaaaactgttttctaatatacagtaaattattaaaattttataaatttgtgtggtagcatatagcagtttgttatggtttctatacttttctggacacttgagtttttcagatttttaaagaaatactacaaactaaaagtaaggtactggcgatgatgaaagtttcatgatttgtagggacaaagagtaaaattaataatctgcttatatgccatagagtcaattataagttcaactgatattttctctcctagttataaacctcaacagtggaagaatttttcttcctattataaattcatttggatgattatataatcagatgtggagctaatgtgtcctttaaacattaatttattttatattgtttccagaatggccaactacgttaggtagtagtatctccgctttgaagatgagggtcctaaatataagcccttgacttacccaaggatagatctagaattttagaagaatgtcaggaatacaggaatacagccagggaccaagccttcattcctttaatactagacttggccttcaaaacaaaataatgcagtaattctgtagcagtaactctgccatttctgtcctaatgcacttttaaaggctaacaaattttaaaaacaaaacaaaaaaccccataaaagctcccaacaattttaaaggaaatactataaagtaaatctgaagaaagttagaagaattagcaaagtcaccattttacaatattataattatgttaagtacgtcttaagcaagcacttagggtcatggttggaggtctgacctgggttcctgaggtggaatgcttgggggatgaagttcaaacacagcctgtttacccatggacataagtggccttaatcaagacagaacacctttttttaaatgtttgctttaaaagcagaagtgcaaataagactgtgatttatgaatctgctaatatccttctctgctgtagacatcaaaaagattgactttggggctgtggtaaatataacaagaatgtagacttgttaaagcagtaataggtactcttattaaaactccatttccattaagctttacaaattttcttccctccttccaggctttaaagaatgcgttccagaggcagtgataccgagggctcagcccaaaagaaatttccaagacatactaaaggccacagtttccaagggcctaaaaacatgaagcatagacagcaagacaaagactcccccagtgagtcggatgtaatacttccgtgtcccaaggcagagaagccacacagtggtaatggccaccaagcagaagacctctcaagagatgacctgttatttctcctcagcattctggagggagaactgcaggtcagctgggttggagttatccccatcatgcttcaaacagaaggctgcttgtgaatttggtgttcctgctgccacagaaatagatatctgtggttcatacatgtgtgtacatgaaagcaaagcataagtatatatacaaagaattctcctctgccaactcaaagtgcaattaatcccatctaaaggggctgtcatgatgacatgtgattggcatacaggtcgtgaaaggtcacatcctctgcccatgctgctcaggagcttcagtgcacatgcatgcatcagtagcaataatgccagatgacttcgggattggtttaaacaacaataggtgcttttgtaccccaagtgaactggctcctagactagccctggcattattaacctacatgaaaatctaaaaacagctggtacacatataggagaattttatttcctaccccctgaaaatccaaatgctagtacattgatggatatcatgatatctgcttgtcaaacataataaaaaaagtagtcctccaatgttgtatagtaatcactttttaaaacattaattgtgtaattagactacaagaaggatgaagggatatagttttgttaccttttataaaagtgtgaaaatgaaatatgattcatttagatttgaaagagaagaaaaagcactgccaactatcacaaaaatcacttgctgagactgctggtagagacagcaggctttctgaaatactttttgttcctacaggctcgagatgaggtcataggcattttaaaggctgaaaaaatggacctggctttgctggaagctcagtatgggtttgtcactccaaaaaaggtgttagaggctctccagagagatgcttttcaagcgaaatctaccccttggcaggaggacatctatgagaaaccaatgaatgaggtatgtaccacaataggggtgtgtacctgggaggcagccaagcactagccctgcagatgagcatgatctgtaactcctctttgattccttacagttttactttctaacgcacttaaagcctacacaaaacagataaatacgacaagttcaataggaaagttaaaaagaatgaaccatagacaggatgcgtccactaggtttgttgcttgaatcaaccaaaatctaccaaatgccagagaatgctccccactctcacgtgcatgtgcaggcacatacacacacaaacacacacatgcacacacatacatgtgcttacacacacacacacacacacacacacactctgggaacttgcagggtacccaggctgtaataaaaaacataaagttcaaccatagaggttaatttttggaaaacactgaggtattatgtcatagaaattttgaacatgaatggaaataatctaaagaactgtccaagaaatagagtttttaaaaacatatattttagatgagtgcataccttctttttccttcaaagtttaatgacagcaaagacctttccctcaccaagcgtacctagcaattacaacggcaaaggtgggcagtcccaacagggccaccactagggagaaggcagtactgcttgctcttttacttgctgacatttctgaaaccctttggaattcttattttattctttaattttcctctgagaccttcatggaaaatttcataatttttcatttttatagaaaagaaacaactaggaacatgagttgaggctggagagtgaaagcaagtttcagacaaatttccctcaaataaactctggcaacctacctcaggactgacctctaatgtccttgctattctcgtctttagtatctcatgagagaagagactactgtcttgccaaatagtgaaggagtttggtcatatgtatctgcttctctacggggtgaggatgagaccacccaaagtctgttgatttgcactttaatccaaattttaaacaaaaggaaccagagctgcattcaagtgaatactgttaaaactgtatcctggctcccaacatattaactatgaaacagtgtcaggcacaaattccccaacccctgtgagctcaaatgcaaattaatgatctctgaacataaccctaacaaaactctacaaatggcataacctctcaacacttcagtgtgaaatggaacaggatgattccaaacttatgttgaaatcggtgggaaaaaatttaattacaaaataattctattgtgcacatgcaaaattggaaataccccccttctacaaatgcttgcagtcttaactctgtaaggtgcccctgaaagttacccataatctggccctactttacaagtccagccttttttgattactcctccaacagatacccctatatacatacacctctcacattcccacctccatgatctgccaattttcctctctttcctctacttcccccttatggatttctctgtcctcagatatcagtttatgcaattcctcgaagccaaaataactccacgtacacaacccagttgtctatccttttcctcggtctaggaagtactaggtgagaggggaatgccccgaaaataaacagtgaaggggaattctgcctaggattttcctacacagggctgaagaaaataaagggagggcagtgctcctgctgagaccagctgtgactgtatcctaattacatgagaataagcatcttgaatgctaaagttattcttcttttgcattcccccatcttgaagtgttaacagccccttctcccttttattttcttcataatgttctttttgaaaaacctaaaaaatctcaatcatgtctagggtaaactagaggtgatttatctaattcttaaggcaaaataacttagaagaacaaacagctctcggttacatgacacgacaggaacactgacttaagatgaaaaactggtggaagcctgtgagctggaacatgcttggggctggggctaggagcagaggtgtggtcaagagggcgggaagaggcaaggactcagtccacaagagttttgacctcctattcctttccagcctagggttctatatcagaacttaattttaaaaaaaaattaatagcctaaggtattcttagttcttccaaaaaatatattatagaaaatatgggccgggcgcagtggctcatgcctgtaatcccagcactttgggaggccgaggcaggcagatcacctgaggtcgggaattcgagaccagcctgaccaacatgaagaaagcccgtttctactaaaaatacaaaattagccgggcgtggtggcacatgcctgtaatcccagctacttgggaggctgaggcaggtgaatcgcttgaacccaggaggcggagatcgcgatgagctgagatcacgccattgcactccagcctgaacaacaaaagcgaaactccgtctcaaaaaaaaaaaaaacagaaagaaaatataacaacattttggatttaccaaggcactataataaaagagtctcagtattattagcataacctagggcaaatcttaaaatacttaccttaagcaatggtataattaagcttttaaatttaattttattcatttagttagttaatatgtattgaaaagctcatgtatagggaaagttttggtgaaagaggaaaaaagatttccaggtcttggcattgaaaaaagcagtcttgaagcaccatggtgaattgtaagaactgcctgaagtccagtgtggctgaaagttgggtaggatcggtgggaagatatggagtgaagatggggccaaggtggcaggaggttcagatggtgaagggccttttggccccgaacaggagagtggagtcccagtggtgaaaaatcatgctgtcagtgatgaggacagactgcaaggaggtaaggctagaggaagggagaccacttagggggtcatggaataaatgaagggcacggattccttctagccttctttccattcccttcaaacaaccacgaacatataaagggaaaaaaacaatggaaagcaagagtggattaaataaaccttctattttctctctttggtttgtataaaatttaatatacatatcttgacaattacaacaagctctccaaggaaatactgtttttggatttagaaaagcctcttttagtaattcatttatgctttactgaatacctactataattattcatacattaattctaatgtcaatcttgtgacaaattaaattgaatgtattttctaagtcaactaataacttccctaaagtaaagctgatcctatcactatttcactctcaaattgcaaaaggagttgatttgaattttccttacaatggactctaatgtttgggcaactgaagataaaattttcagagggctgcagtggtttgaaacacacttccatgacaatcaacactagagcctcctcagaagatgcctctgccagcaggcaatacaacatagcagtttcagctttcacaaaaggactggctacattaaaaatcatcaacaattgtatggcataatgaagtattttgtgaatttaagcatttagaagtcagagagaatttactgggttctatatgctgggacacctcagttgtactctttttctgaaatgacttggtcattttgtgcccagatttctagtcaagtacatttctagtcaagtacatgctttttaggatacacaacttaaattggctttaaattcacaatgagtcacacattctaaatcttttatgacaaaggcaaactgtaaaaatcaatcaacattatcacttactgcatctgtatctaatctagaaagtcgggtgttttcaaaaccaagttcttaatagatattaatttatcactagcaaaagatcccgagttagctcttgccaacatgtttttctggtggcagcttaccccgtgctgggcaaaatggagctcaaggccaggagctgataaaccagcccagtgagcttggctgtctaactccatctgactgtgatgcttttggccactggcatgttctttactgcctggttcttcctttatgaggtcacctccacttccaccaagtgcacttgggatatctgccaagagctcctcatgtccttggtgctctcactcttcctaggctatggagtcctgtcctgctgctgtggcttagcatccacgtataagcccctaagggtaccagctggacagcttctctgaatccctacttttgttaatcaaaaattttttttaaactactgctggaagtgtcccacatgctgctcacaataaaggcagatgtgtgaccaaacaaaacaaaacaaaaaaaatctcagtttccttgcttgcttgttttgtttccagtctgtaaactgggcacctcttataagcaaggcactctgttagatgccaaggattaaaaataaaataaaaaaagaaggatgtaggcccagctttcagggagttcacagtctagcaggggagacaaacacatgtatcagccacaggttgatcattttgtaaaaaagatgtaagtatagtgctgtgaaaatctgaatggacttagtacttacatttggtgacattcacactatacaccaacacataatagattatctattcatagatctattttaatggaaataccttgatgtataataaaatgaaaatcatagcatgtcctggtagagcgatccaagaggcatatactggtacagagaactatagggtgggctggggcagaagagatcagctagggcagctgcgaatccagcaccgtgcaaggattctcttacttcctgtcatttctttaatgtagcttctcaggagagagacataagagtgtcagaaagaggttatgtggaaacagttgatacccacagggacacagattattctgtcaagaaaaatttgatggcaataaagagactacatttgtattgaaatgcacccaaaagtatcaattaacaagagaataaacactaaacaaggagataaaaaacccactgctggccgggcgccgtggctcatgcctgtaatcccagcactttgggaggccgaagcaggcagaccacttgaggtcaggagttcaagaccagcctgaccaacgtggagaaaccctgtctctactaaaagtacaaaaaaaattagttgggcatggtggcgcatgcctgtaatcccagctacttgggaggctgaggcagaaggatcgcttaaacccgggaggcggaagttgcagtgagtcgagatcgcgccattgcactccagcctgggcaacgacagcgaaaactgtttcaaaacaaacaaacaaaaaaccaaaaaaacccactgccgaattaatcaaaacagggacatttctaaaagagtgaaagacaacagtatataaacaatttggtaacaggctataaatgttttctttcgtagttggacaaagttgtggaaaaacataaagaatcttacagacgaatcctgggacagcttttagtggcagaaaaatcccgtaggcaaaccatattggagttggaggaagaaaagagaaaacataaagaatacatggagaagagtgatgaattcatatgcctactagaacaggaatgtgaaaggtaaggctgctttgggcaaacaatgtcccattctgcaatctatgagctggccactgtaccaggtctcagggatacaaagataaatatgacacagtctctgttctcaaagatctcatagtccagggtgaggaaaaggatatgtttgaagacattatcagtacaatgtatggataaccagatgtgtgataaggactgtggaaccataaatgttaggcccctaactcttgaagggagtgccctgtgaaggctgcaaagaccaggcaacaggggtctagtccctaggcaaacaagaatgaaaaccatattcatggcaaggggtgaaataagtgtgttagtatagaagtgagaaaagaacctgcattttgagggaactcaagcttttcacatggctacagcatagggcatgattgtaggatgagaaaaggaaaggcttgccttgagcagctggactttatactgttggcctgaaggagcaaatggaaaattgtgaaagggaaaataagatgatcagttatgctttcctaaagaacgattaagggaacatggaggaacaactggaggagctttagactgggcgcaggaaactcacataggaggcaaatatccagatgagaaagatgaggggatgtgttccaacagccatgaggttgggaggggggtgtgcgcatgaactacttatgatgtttagtcaatatgaattagtgactggttagactggaaagaagagcaaggaaaacaaggagttactgagaagcactcctggctattcaggaacatatgaaatatgggaatggggcacagttttctgtgttgtaggattttgatcaggcaggatggtttctacttggtgagtaggtaggagatgagtcctggtttagacatgttgagtatgaggtaccttggtatattacagtatctggtgtaaagaataatatgtataaagtcaacccatggtcagaaatataggtctgtagaaggatgggctggtgatatggacctgcagcaggtgatagctgaaactgtgggtgttggtgtggtgagaagagagaatgttgaaagggaaccctagaatacatcaaggcttggcagttttctggaagaaaaagggggttgaaaatggaagctaaaaaaaaaaatggtggaagcttagaagaaccagaagacaaagaaggcaatgaaatgaagtgagcaaagactttaaaaagagagtgaacagtcaaatagcaccaaataatgcagaaaagaatgaaatgtcccaggatttggcaatgaagaaaatactgaggaacttaatgagccatttcaataaagtggtaagggcagaagccaaattgcaatgctttaaaaaacaaaataagaaataagaatgtagaagcttaaaatgtgaactagcattttgagaagcgtggctgcaaaaaaggagagtttggttggtaaatattttctaaccatatgtagggtagattattttgttctactttgaccctctattctgaaccactgtagacagtataagcatccatatgaaactgaaaggacaattaaccctctctattgatactgaaaagatggaaagtaaccaatctcaaatggcttattcaactacttccaattcatacttcagctaggtaacttaagttagttacctcaatatctaggctaatagcaaactttcatttattttccatatactttatggtaggcattttttcggagtgccagagaatccatggcacttatattcactctattttttccaggaggtttatttttcactacacggcagagagggggcaggggaaaggtcctactaacttgctcctcatgaactctgaaatatctacagggacagattaaaggagcacaagaaatctggcaccaaagaaacatttgactcagacattacaatataagatttgttattcaatgagacaatgttatattaaacattattttgaacccctgtggtttggcactagtggcctcatttggcctccatacttatttggcactaacttgctgaacacagacactttctttcatctttcattattatgaacatttactgatcacggtcagagtgttgcctggcataatacaaagaggtacagactgtccctgcccagggggcttaccacattaatgaaaaggcaagatgatacagatttatggtgggaatgtgaagggctattggaggagagttctgatattcactgtgtatctctactatcttctggaggaaggctggagagggctatcctgaagttatactggaatgttgggaggcagatggcaaagattatttaaaccaagagagcaagaaggaacaacactgagaaatgggaacaaaagatcagtggggataaaggccatgggctggaggaaaagaaaaattgtgggaaaaatgtaaagtgtatactactaaatcaatatatgaagaatagtattttgaaatatataaaatgaatttaagagaaagaacttaagagattacttttagctttataggatataaagtttcctttataggattctttaccttgaagaataattaaagtgaacatgccattaacaagaagtaggaaaaagtgtctatcactctgtttagccattccagaagatatgagaatattcatctatttctatatgccaaggaacaccttccagatggaattctttgaatgtgacaatattaaacctattctcaactcccttgatgcatatgtgacttcccttgctttgcctgaacatcacaattccagtatcttggtagtgtgggcccattcacgtccacccttcatgctttcctgccttctgctgggagactgcaggcctcatgaggcataactgacttctatctgctttaaggccatgtgcatcaaagtagtattaaatgaataccatctaacgaaacaggaagtgggggaaactaatgacttcaggtaaataaacgctcagaggaggtgcttacacacaagagtgtgaaatacccgtagtgtgccttgctttcaagtgacatggcaaaacacaccatgactgagtccttccaacttcactgagtgctttctctcaaggacacagctgcctcccacaaaagtgagactaacttatcctgaagggtcaaagaacaatgtttacttccttcctcaaacaaagtgttgtaaaccactcccaaactagcaaccctcccagcagtgaaacaaagatatcataaccccagtaaaagggaggttggttgaaaatagatacaaaggggtatctggttgaaactctgaaataaacacggtaaaggtttactgctcacattctaagtgttggtttgtatctacctggaaataaaacaaaaattaagaactacgtgattgaggtagttaatgagacctcagaggatgtaataatggatttcaaattaaggctcaatttctgtgttttctttggagaatttgttttatgtggaaaaccctaaaggagactgatgtcacacattgagctcaggccaaaatgtttgccaagtgatgtcgctgtcgtaatcagtaagcaattggctttcccactgagggtgggtgggggcagggatcagctcaggaaagcctgttcccaggcatgttaatgcaaagtttccttagctgtaatctgtgcggtttggtctgtccatatggtaatattctatccatgtttcatgacaacgttcactgaccagctccaacatgtggatacgtgtgtcaccaatgacctgaattatgtacttggctgaattacaggtggagtctatgtaaaaggttttttacacaaaagcaatgccaataatttttggcctttctgtgtggcttcacagtacttttagtcaatgtaattttgcaaaattttcccataagtgaaatgccaattttgtctgtactttcaaaaaagcttgcatatttttttttctttttcagtttcaatggggcaaaaggctctgaagaaaaaaaagagttgcttttttttgaaaccatgcattctttcttagaattctaaaacaaactatgtatgctatccatatatgttactgcatttctggtcttgaaacaacaactaaagcaggaaagaaatattgttatggcagctctgtataaaactgtggcttcaaccatggattgtgttaaagccttaaattacttttcataaaatcttggcctagtaggttagcactgatagttcagttttgtaaatcagaagttcaaatggtagcttctcaaacaccacaaagaaaggagtcaaggtagaattaatctcttgttccttttctgtccaagtttgactagatagaacagtggtgcagaggccttagggccctttggaggaaagtcaccaggtgtccagcttcaagtgttgttgccttgaccacaccctgggaagttctttgctgttaagtttcaatgaagaacaaagcacttccacctctccctttggctgaaacaactttataaacaagtattttcaccatcaatccttttctattatgacaggcctatttttccagactgcatcagacaaggtgactaaaacactgcttgagccatatttgaccctactgttaactgagtaaatcagaccacttttaaaggcttctctcaaaaacatcaaattttctttctagaggatttggaaacctccttgaaatacatacatgaatgagttaatttatctaatttttaggttaaactcattagtttggagctagtgctacttgccattcattaactgaaacaaaacaaaacaaaaacaataattgattaaatatatatgtctactgcaagccaggtcccatactagatactgggcgaacaaggtagatgtggtcctcacctatacaatcctgaatatttgttcattgtgtaaaacaaagacaccactgcaggctttaagacctgatactgattcttctaaggcattatgagttcatgacgggtagaaaaaaaggcaccactatggtaaactaatgtaataacattaatgctcatgaagacagaacattcaggagaaatcaataaacacattaaactaaagtattttactagagaattcaatatcgtgccattaagattttcagtttctttggtcttaaatctcagcttttaagggtatcctacaaagcaatacacagtgggtataaagctttaaaaaaataaagtctacttaaaaaaaatattttgaaagccagcagttttaaatttcatacacactaaactattgttgtagaatacattgtactcaaatgcaatcatttcctttcagtttttctggcaaggagctatttgtattacatattctcaagactatgtcttacaagtattgaaatggatgccagatctccatttgacctttgtcatgggcatctagttctttgacagaacaaaatggagatccactgcaaacaaatattttgttattgtaattctatacagaattatgacatgatcagccttgtgttcatacatgctggacctaacacaggatctgaaaagggatgcagagagattaattacctcatgtgggtactaaaaaaccatttaggaccgtccatcatgacttaactttcaacagatgtcataaaaccatactcttaaaactgcacaattcagcggtttccatacaatgccttttaatttcagaggtcaaaattcagatagagtgacaatgctacctgattgcttttccttcccagaaatttagttttctgaactaaattttacaaataattttgaatgtgtatttgaacatacatgatagtgagtttattgcttacaaaagaatactatgaatgctaaaaagaaaacattaacaagcctagtgagggatgaaccaggagcttagagatagtggcagtctggtctgcagacctgatctgcagctatgtataacttttggcaaattccattcctcaaatctttagttttctggtatataaaacaaggggctgggcgtggtggctcacacctgtaatcctagcactttgggaagccaaggcagggagataatgaggtcaagggttcgagaccagcctggccaaaatggtgaaaccctgtctctactaaaaatacaaaaattagccgggcgtggtgccgcgcgcctgtaatcccagctactcaggaggctgaggcagaaggatcacttgaacccaagaggtggaggttgcagtgagccgagatcacgccactgcactccagcctgggcaacagagcaagaatctgtctcaaaaaaaacaaaacaaaacaaaacaaaaaacaaacaaacaagggcagggcatatgattatgatttctgtgtctctttcacacctaaaaatttgtgattatgtgattgtcatgaacaagtaccttttacctcaagcctaggattctaactccactaccaaaagaggtcagtgagaatgacagtgactaccaccaactttaaatccaaatctgtacatccattcttaaaggacatctagatttcggtataccctactgcttccacatatttgaaacttaacctaatatcacctttgcacatccaagtccactcacaacttttttattcctgttaatacaaccaccatgaatcaatctaccagataactataaaaaattacagaaatctcagaagccaagaatttaagctagaaaagacctagcaatctagaccaatgctttgattttttgaattgagaaaagtgaggcctctcaagcccaagataaaaaaaagtcaccaaatcttccagctaaatagttgcagagtcagagtagaagccagctctcctgacaatatatttgatgatattctagagaatatccctagaatcattcctaggtactcaaactatgtgcctggtgttacgggaggtccaagataaattttacacacaactaaaatacaggtgaaaagacaaggcactcaaaataatctgtagataatttaggaagaatgcaggtgttcattctgtggcacagacaccactgttgcaacactgtggaagatcaggcaaaaaggagattaaacacagtaattatccaacagccagcacagccctaggagaatgcaggacatacagtaaatactctataatacatctactaactagctggtggttactagtttaacagccctataaaacaggtagccaaaaactgaatgtggaaaggcaacctcaaacttctgttccatttggactaaaaaatataaagaggaataagagccactaaaccatatcaaaatagaaatttttgcctcataagtgaaaatcaaggtgggatattagaattaaactgtatcctgaatttgcaactcataggtaaactttcctggcaagtgtattaattcttcagatgagaagatgaagccaaacagctttggccagccgtgaagatgatggctggcacaagtgatgagtgagtatcactgcacagaaaggccttatggaagagcacagggtatcagagttaaaagcatagactcgagttagaacaacaaacgtggagcatggaccatgaagcatggtcccatcctctcatctgatcctactggctatttgaccttgggcaaagcatttaatcttgttaagtctccgattcaccatctgtttaaaaaatgatagagatctcataggttcctgtgattactaattatataatgcacagcaagtgctaagtaaggtgtctagcacataaaaagcactcagtgaccattagcactgtatttgtcagggtcctccagagaaacagaacgtgtgtgtgtgtgtgtgtgtgtgtgtgtgtgtgtgtgtgtgtgtgtgtataaaccgttattataaagtgttggctcacatgatcctgaaggctgggcagttgcatgagctgctgtcttcaaactggagacccaagaaagccagtcatgtagccgaaagacctgaaagctagaaaatcaatggtgtagattctattcccaatctaaagccctaagaatcaggagtggcaaggacagaagattgatgtgccagtgcaattaacccaggcagttaattcaacctgccttcagctttctgttccattctggctctcaacagattgcaggatgtctactcacactggggaaggcagtctaccaactaaaatgctaacctctttggaaacactctcacagatacacctcaaaataatgtttaaccagctattcagacatcccatggcccagtcaagttgacacataaaattaaccattacacgtatctttcttcaaatttgcctttcttcaaagcagtttacttatgtactctgcatgataccaataggtatatttttgagttgccaagaaagcatttatgtagaccctatactgggttctaataatgtgacaattaataagagttttcaagtggcatattgtttagtataggggagacagacataacatcaataagtgcaatgcaaagttgcaggctaatgacaacaaaggatacagaggaggcaaaataagggcttatactcaaggcatggttgtatcctatttcctttagtgtaggagaattgctgaatgtcctaatgatctaacactgtataacactgagctgggcaagacagtgctctgtgaacttttttttttttaaaccattaagactcatttcttctttttggtaaatcactctacttagagaaacagaaatgttagtttggtggtattatgaaaaatgtagccttccaaatatgcgaaatcaagactgaaccaaagtgagggtttttaagtacatccaaagtctccaatgcttctctggcttgccactgtcaaaaatcctcacactaattgcatcttcttgtctaaagttattatgaaaaatcaaatattcccactctaaggtaagcgggcttacttttgatatattttgttacacagccccttccacaggaccaagagtatgggagaggtaaaataaatattttttttgaatgagtgaatgaaatgtaggaaaagttggctacattttaatctattattttccattaatctctcatcatgaattagcttctggattcattcccttcggttagcatggtcatgggagaatgggatataagacaagcccattttgatgaggaaagcagaatgagcttaagagcattgggactatccccaagaaggcagaattaagagcatatggtgcccttatcatggagctagaagaaaaaaaatgatcctaaaaggggattttaagattaaacacatcagagacattaactaatcactaaaaacaactcactcaattcatacattgcagtttttatatccaatattttttcactaacaaaaacatcatgaccattttcccaaatcaccaactactctacatcacaatgaaagtagatgaatactactgtatcacacaggtgcatcacaacttatttagcaaattctctgttgtgggcatttatattcctcctttgtcactagtataaagaactctatcctgaatggcctcacattccaatgaatttttatgcctttctgattattgttttagaattcttatatgtgaaattgctaagtcaaaagttatgaacctatttaagttataaaacctatagctaaactgccttctgtaaaagatatttataccattactaacaatgaagaagagaaccaatttcttactttataactttacctgagactagtcttgaatctgacctcaatttaaacatgatatgatgttgtaaagagtataaagtgaatgttaatgacatgaatcagactttcccactgacttgggctttgtttagagatgtgttacttctggaaaaaaaaatctaacatatcaaaaacacacttaaagattataacattttattgaaagagtattttcaccttgtcaatataatttcagtatatttccttttccctatcaaattcaggttctcatggcctagcatcactggtcttccaaaaataaaaaaacttccattgctcattctctgaaatgtctgaggcttcctccttcatatatcctatatcaagtcttagagtccaaatccaggatcctggcttacctttctcaccacatgacatatttggcaacagctcacaacactcagtactggccctacatggtcctgaaaagtctgatttgttgaaaatagtgggatctaaggcccactttgccaaattccctctctaatttaaattcagttagtttggagtgtttgagaattctttatcagtttcctatttaactcaatttctacttgccaatcctcacttctttaaatttcctccctacttatcatacacatacactccatttatttccatgaatttctcagtaacactctgaaatatccgagatgcctgacaaacttgtagcttcagaagatgtttcagaagaaacgcattagcaagattcatgagactgaatatgtgttttctacgttttttcttttcttaaaaataagtaatttccaactcacagctttttcacactatatcttgcatatatgcttcagggtcacgcacatagccctgctctcacttcctactcctcaaagataatccaccatgaatagtttcttgtatttatctttaaaaagattattacaagcatatatcagcaattcatgaagatcatacaatactttttctattctttttttaagtggttgcatattattcaattttatagatgcaattcatttagccaggccaccttatgagctttagattgtatcctttttatttcctattaaacattctttggttaattgattctcagtaacttcaaatgcctcttactttctactttcctttagaaataggttaatcactggtaacagagagataccacttcatatccactacgataactttaatcaaaaagataataacaagtattgacaaggatgtgaaactggaaccctcatatgctgctgtgtagtaatgtaaaatggtgcattggaaaatagtctgtcagttcctcaaaaagttaagtgtagaattattgccttagtccgctggggctgtgatgacaaaataccagagattgggtggcttgtaaacaacagaaatttatttctcacagttctggaaggtggaagtcagagatgagggtgctagaagtattctggtaagggccctcttctgggttgtaaaccgctgtcgtctccttgtttcctcacgtggtggaaagtgggtgagaaagttcttatgagggtcactaattccattcatgaatgcccctctaacctcaaaacctaattatctcccaaaggctccacttcctaataccatcacattgggagttatgatttcaacataagagtttggggggacacaaatattcagtccattgcagttaccatacaactcagcaattctactcttaggtacacacctaagaagatgaaaacacatgtccacaaaaatctgtacacaaatattcacagcagcattattcatgatagtcaagaagtgaaaacaacccaaatgtccatcaactgaggcatggataaacaaaactgtggtatatccatgtaatggaatactacttgtcaattgaaaagaagctctgtgggccaggtgcggtggctcatgcctgtaatgccagcactttgggaggctgaggcaggtggactgcttgagcccaggagtttgagaccagcctgggcaacatggcaaaacttcatctctacaaaaaatacaaaatttagctgggtgtgctggcatgcacctgcagtcccagctacctgggcggctgaggtaggaggatcacctgagtccagggaggtcaaggctgcagtaagccgagatcacgccattatactccagcctgggaaacaaagcaagaccctgtctcaaaagaaaaacagaaaaaagaagcagcagccctgtgcccattaagcagtgacactacagccgctagaaaccactgatctcctttctgtctctatggttttgcctattctgggcatttcacataaatggaatcatacaagatgtagctatttgtccctgttttctttcacttaaaataatgttttcagggttcagacatgttgtaacatgtatcagtatacttcattcctttttatggctgaataaaaccaaaaaggtcagtatggatgtataacttgattgatttaaatgaccaacaagatagatataaaactattgatgataatgtagatttctcatgagataaagtttcactgtgttcttaacactctaaaaattaaaacttttaatgttattaggaagcaaagaataaagacttggaactgaaagcaaatgattatttgctggaaaaaaaaagagagaacgaacattttggttatatgtgaaaagagagaaaatgggggatatttgttatccattctttcatttaacttaacactatgcttggaactaggaactaggaaaaaaaaataatgaagaagacatggatcctgtctttgaggcccaggtggaaacataagtagaatgagttaattaattgtgagctgtaacagaggcatgtacaagagtgctcaaggatctgattagaaagatggattagctctgcagggagcgaatgtgaaggtttcccagcaggcagcaattagcttcaaggctgagtagacttagcaggcagagaaatgcactcacaggtacattaaaaagataaatttatggagttaagcctcgggtgaggatgagtattttagagccagggcatacagaccctgtatgccacaaccttggatttcccctttatcctgagaccatgagacattcgtcatgcagaaaaatctcaacccaccactggcaagttgttagagaacctagagtgtatacaggccttgtgttaagtgtgtctagagtcaaatttggaaacaacttaacaataataatacttattattttgttataataacatataatatatattatataatatataataacaaaaacaacaaccagaaaactattacgagcaaaacacccaagagaaatggatttcacattatccattattgtacaacttcctgataaaaacttactttacagccaaataggattgaagaaatacatttccatttggctgaagcaaatggaaaaataaatctcatttcatcctaaatcccagaaagggagatgtgggtgtgtaatgcgctacctaatccctttgcctagcctaaaattggctaattacagcaacatgtgaatgaacaaacggcaatgagatataaccaactggaaaagagaaagaaacaggagcgtctatttatttcaactgtaacctgagctctgccaagaagacaggccagtctccatctcttcatccttgaaaagggttgctcagctaaccttacttagagaatataactgcctttggccattgtttgagtttgggcccaagtttcttgggcaacattaaaaaaaataacactagttatgtgttgatgcttccatctataaaatgggcataaatattctagttatctactttcttgcatgagggttctgagaagagtatgggtaactatttgggcaaagaatttgagatctataggccaaagggaaaatataaaccccataaaatgtttatttacatatggagataatagttagaattatagcgtattactttttttcagcctaagggctaaaacataatactccccaggttacctacaaaaattgtttccttggaaagtggtaaggggtactggatataacaacatgcatctgccacttcacctagcacctaacaactgtgaagacatgtgtttgtttactttaaaagctctcagtgataggaagatttattaaagaaatgaaacatttcacctctaaaagctcacagaaccctgtttttgttacattagtcttgccaggagaattctgaatgtgtttgcattctatcagtcgacagtgtgagtcagtgtgtcccaaaccagttttctaaccagaaagctgagaagtttgatgacacatttaggtaaacatactcactggatgaagttatttaaatttttatagccttttaatcctctctaagcctttgaaatccatacaggtttttagacaagatttaagttcttgtaagtcaaagaatagaaattacgtataaaccaactctattaagaatttcacaggttctggacatctaagaatacctaatattatacttgaaagtgcaatgagggtgagctgaccccacactgaagcccttcactgttaagtaatcagccttattcttaaacaaaatttcagctctgaatacacattttgccccgagaactgaaatttctcactcattttggtcagatgacaacagctcttgttgacaatgataaatgaactctgaatatgaagggttcactcaagtgaaagaacaggaaaggggttgcagactgtgactttcatcacctactctccatgcaatttcagaattcaataggcagttgaatggaaatggaataaaaatgtggcaaaatatacactgaggttatctaaattaactataactgatagcaactttaagttattatgagttaaataaaattagcagtgtgatggacttttttcatctgtatgatgaaaaacatgacacacttgataccctattattagcagtattattatttctttatgcaaagatttttcaagtaaatctactcattctcttactctagagagtttctgcttcacctaaaagaaatcttgcccttgccatgaatgattatgtctgcaggaaaatttgacttttcattattcacaaatttgttaacaagtaactattgtacaaggggtggctctaactccttttgataccatgactccacccacaccccagaccccctcacctgacccaaggcttccacatcattcctacatggatatatatgaaacatacacaagcacatggtacagtgtatacacacaatcaaaattcaatttattttgcaggtagcaccaccaaaccctagctcagagtacctctgctccattttctgtttggtattggatcagacagaaaattaattttatgagaagaggccagaacttgaaacaggtgtctccctgcatgtctttcacccatagcctcaacttgaagctcctaaattatgacactttagccatctacttgttcaagaaatgctgcactagaacatttggttcttacattttccaggtaagcattcctttgatggcctgtgcacacacacatgcacacacaaaggttctccaataatttttttaagtatagagttgttaactggtaaattattcacaaagagtaaatggggtcagagtaatctcacacagaattttaactaaatccctgaagctaattaagattcccattaaaagaaagaacacacacacacacacaataggaatttttttttgtagatggtagattctattttgtatattctatacaaaaaatacaaagaaaggtctcttgtaaataacttgataattagtgataataacaattacatttaattaaatatttactgtcaaacactgtgctaagcacagtagattatctcatttaatcctcctaacaaccttttaaaggaggtaatattattgtccacataatattcagataatcaccctgaagaagctcaaagacagtaactttcccaagatcacactgctagtaactggagaggagaattaggcctcaaggactctcatatctgagctcttaacacttctttgccagtggttcccaaacctaagtgatcatcattattgcctggggagacacttaaaagtatagattcctgggcccaaccccaaacatactgaatgagaatctccaacagtggaacttgcagataggaacataatggtatttcaaatatggttcaaatgttcttttaagatgccaagagaacacgagtgaagccagttgtcacatagttgtctaagtcaaatcatctgccttcaatagaaaatagcatctctttttccacatatacctcttctcactttataatagaaaggtcttatttgctaaaaggtcaaattaggtaatggacatactatgtcagcaatttgtactgacatatccagctgcatgggctatgttatggaagatgaaagtgatacagcacagaaattctgctgattcagaactgccgagttagaacttcactgacagagaagacacaaaaacaattggacagtttaaaaatccttggccatgctcattgcatgaccagatcaatatttacaaatattcaatacacagtttcagtacctgaaaaatttacttatcatctagttcatttattcattcatttcaaaatgcttactgagttccttccatgtgccaggcactggatcacacatatggcccttgccctcaggaggagaaaagcattcaggtggtggaaaaagaggtgatcactgattaggggatcaggaatggcttgatctcctaatggatccagatagcattagcgttgcacattaaaagacagacatagttcagacaaggagaaaaagagaagggaacacaaaaatcattataggtggacttaatagcataagggaaggggattagggcaaaaagagcaatcaaattcaggaaaaagcaaggaatatggtttggcttaagtacacataatgtgaaaaaacagtggaagctatgggtgcaatgttatgttcagcaaagagctgcagatgtcaaaataaaggggtacgccaggtgcgttggctcacgtctgtaatcccagcactttgggaggccgaggcgggtggatcatgaggtcaggagatcaagaccatcctggctaacatggtgaaaccctgtctctactaaaaatacaaaaaattagttgggcgtggtggtgggcgcctgtagtcccagctgttggggaggctgaggcaggagaatggcatgaacccgggaggtggagcttgcagtgagctgagattgcgccactgcactccagcctgggcaacagagtgagactctgtctcaaaaaaaataaaaaagaaaattaaaagggtaataggtagttaagataactattccacaccattccatcagcactatgataacgtgacaaagtattaagagtacaagaagctgaagatctgagttgaagggctgcttccagtatatgctaaccaactctgtgtatttgttgaagtctaaataacagtaagagtcccaaaaatatgtttatttaggtttaaatatactctaattattcaaacaagttttaaattatctaaacattatttaaataaacttaaatattatttaaataaacttaaaagtcgttctgctccatgaaaccattcagagttgtcttcatccacatgatcaatactgaaactctaccatatctctgttatagggcatggtagggagttagggcatgggtggggaaaatggcaaaatacatgaaaagtgtcttgctttcaagttagggatgaccatctcttctacttatagttcaatgatccaatccaaactcacatagccacttctcagtactggaaaagctagaaatgtctggttgggcagccatatacccaggaagagggggacaattaaagttttgaggaaaactcagtctgccacaatcttagtgcaaaccacttaacctttctgtgtttcagttttatcttcatgaccttgaagaagttaaaaatttcttgaaaagaacataaagtcaccaatcataaaaggttaaaaaagtaagactttattgaaataaataagttatgttaatcaaaatacaacaacaggatgaaaaggcaagttacagattgggagaagatatttgcttatgtataaccaacaaaagactcacatacagaatatatgaacaactcctataaaccaataatttaataaaaaataagactgacaacccaatataaaagaaacagacttgaaggggccttaaagagaatatgcaaataagcatgtgaaagggagtttcaacattataaatcatcagggaaatacaaattaaatttacaacgagggagtactacagccctaccagaaaggctaatatttatttacttatttagagacaaggtcttggccctgtcacccagggtggatggagtacagtggtgcgatctccgctcactgcaacctctgcctcctgggctcaagcgatcctcccacctcagcccccgcaggtagctgggaccacaggcatgcaccaccatgcccagctaatgtttgtattttttgtagagacagggtttctccatgttttctaggctggccttgaacttctaagttcaagtgatctgcctgcctcagcctcccaaactgctgggactacaagcatgagccactgcgcctggccagaaaggctaaataaaaagatattaccaaatgttaaagaagtgaagcaactagagtttgcatacatttctgatggcaatgtaaattccatttatatgaagttgcatttccattaatatgagagtccacatgcatgcagtccaaaacagacagaattaatctacagtaatagacatcaaatggtggcaacctctcagtaagaaagtggatatcaactggaatgtgccacaaaggaggctagtggcagagttggaaatattctataacttaatctggatagagactatatagtacacacatatgtaaaagtgtatcaatctgtatgcttaatatttgtgcacatttagtaaaaataaattatacctcaataaacgagaaaaatggagaaataatgattatgctataagatgtaaaatggagtatgttacatgttctaaagatgcaagacatacaaagactagaccagcaattgctgtgggccctgatgacaagaagattagtcctagtaagagcaattagaagactggtagaggacaagagagtttggctttggaatcctgtggttgaggaactggtgagatatctaggagtaagtgcacacatgggactagatggaactcaggccagcagtggtgaaggtaaaaatttgggagtttcagcacagaagggaagttgaaacagtagtagatgatagtcccaggggagaaatactgtggaaagcaaagagttggcctgtcctggcaaatgcctacattcaaagggggataagctatctaggaaggtagacaagaagcagtctatgaaacagaaagagaacttggaaagaccagtgggagtcaccaggcagtcaactatgttaactggcatggagcagtggcagaggatgaagtcagagtgaaggcttttggatctgaggatgccaccaatgacctctgagagaacaatttcttcagaatggtagacactgaaacctgacttcaaggacccaaagaaggtggtgaggatgtagacgtaaagagtgtaataatactccttcaagaggtttgccaaggactggtaggaaagagagaggctggtcacttgtagaaacagtgaaattagggggaaaagccaactgagattgaagattctagagcaaaagaggatggatagaacgaagtctcgcagaagagaagtgggtgtgggaggcaagaaggaggtagttgctacagtgataatggggtaaaattagcatgaatctaaaattgactggaaggcaataagcagccataaagaaaagtaaaaacaaacaaacaaaaaaacaaaaaaaagagaaaagtaaggaaacctcaaggcttactatgtttgaaataaaaagatgtcaaaataacaagaattaatgtttggaaggctctttgacctcattttaatggaatatcctattctaaagaagcatagtaaatatatttttaaaaagctctattttaatttgataattcaaaaatgctagggctgaaaacactgccttcatagaaaccaaataaatttttgccaggcagattctactactgaaaatggttacaaatacttgattggatagcaatgttttctctccctactgaaagatctcttccaagattaggaacaaaaatactagcaaatgatgaaaataaaataagcacattctaatggtgaaacaatctggcctatggcccttatagacctttgtttattgtaatgaaagccatacacttatcattaagagcaataataacaaaaacattcatcacactcactattgccagaaatgtaaagtgcttgtctgaaaattgggcagcttaaaccaggtaagcagattttaaggtccaatcagattctgaaataggagtgtttgcttagaaaaacaagatgcatatctcaacagttactcttcctggccagagatcttgcttaactcaattagcttgggcttgtttctattacttgaagccatatttttctattaccaaatgaagagttttttatttaggacaaatgagtaccattaaatgaagcagcaggggacgacagctctattatttcttatttctgcctcagaaataagaaaagagcattgtgtagttttctatatgaagcatcttagtaaaaaaagacacacttttttgggggccacgtcactgatccaaccagcccagggtcccagtttctcatggtagctacaaggatgttgtgtagggtcctgttaagatgcaagcttaaaaaatgaattactcctaacagccaatttttggaatcatccataaatctatcaaaattcttctaaacctactttttttttggtccacctaacccatatggaaaattctttaaaacatgcatacatggccgggcgcggtggctcacgcctgtaatcccagcactttgggaggccgaggcaggtggatcacgaggtcaggggttcgagaccagcctgaccaacatggtgaaaccccgtctctactaaaaatacaaaaattagctgggtgtggtggcaggcgcctgtaatcccagctactcaggaggctgaggcaggagaattgcttgaacccgggaggcggaggttgcagtgagctgagatcacgccactgcactccagcctgggtgacagagcgagattccgtctcaaaaaaaaaaacatgcatatgtgtatacatatacacacatgtatgaatacacacagatttatgacgtgccagctactgttttaagtgcttctctcttaaactttaatcctcataacaaccctatgagagagttactattataagcagcattttgcagatgaagaaactgaggcctgagatgataaataaggtacctagggacacaaaagtataaatgggcaggaaaggaattaaacccagaagtttgaccatttgtttatatccttaatcatgaaacctcagattctaacagttctaggtttaggtgaacaggagtatttgtcctgccacactgcttatgattttatagattttagttgctttaaataaatcactttcatagatttttttcctctttaatctatcaatttatcatctaaatttcagactatcttcacatggaagttaccccattaccattctgtctgtgtaacctccaaattctgttaaaccttttccatgacaggcaactagaatagtagaaagcataacatggatatgcctgatttttaataaaaaataagatcacactattgatttagtgtgaatctcttcctgacaagcattttgttgacttgttaatctttttggttgtccagtgtctactggtaacaatggactataatccaaggtttcttccctggatcaaaactatagttttcagatatagtttgaattactacccttcacaccatttcctcagaatgagctgacagctagatacccttatatatcaagataacttcctattaccatgccatagaatcagaaggtatttcattttcactaccttttttcatgtcctcccatggaaatgcatctgagaaactgcttcttgtaaaacatgagcaaatgagaatgagttgaatatctgttcaattcagttcaattcaacagatatctattcagcactgactctttcccaggtgctgggtgtaatagaaactgttatgagtaacctcatacttttggttgtcaagagaccatgcccccaaattcctactcaaaaaaatgtcacatggtactaagaatgtctcgaatactaagagtcagttacactaattttattgtcctccacaaatgtctaatataacatcatgaatatttctattacttaggaggtcagtgaaagcaagccaatcatttaaatattttgtctctaaaaaataaaacatagttggcttaacactgattcttgtaagacctcatatattactggcagattataggaaattaatgaaaaaaacactctgtgttttgttttgtttattggcatcattatcagcaacacatattttgtgtacctactacacaaaaaacattatgctgagctctactagggacaaggcaggtggtaccactcacaaaaaaatcaaatgtataaatcttaaaaatgtgtgtgtatgtgtgtgtgttgagactcttcctaacctagctggaatctgtgctatttatcaacaagataatgcagagaaaaataccttacccattacttacatcccgtccagagttaataaaggaaaaatcacttggctgagagtagagttacacaacttgattatgcaaagagactgaactttgactatttagctttagaatacacatcgctgatatttaagcagtgtaaactatgtaatattattgtcagcacaaatcataggccttgatgtacagtgagctttcccgacgaacatctggctaatagccaagcaaaagtacataatttgaaacactcaatcagtttcattctgaggcattttgttcagtgtttaatagcttctccagggacaggaaaattacaaaagtgcattgttttgacatgagctaaaatgagtcatcgcttgtcactacatttttgaggatttggcattaatcttctgagacaacaaaccataaacattagaaataaatatcaattttcctaaacagtttagtaaagggagactactcttctcattggagcaattaagttggcatctctaaaggaaggtactatcctatttcaacgtgtagccattttgtttttctaaacaacactttcctgaagatttgtaatgaccatctaagacccaatccttaaagcaatactaaagcttacttgatttgtattaaataacaagttaaaagaatgttgtatacagtttaatcctttggtaaattccacaccaaatgttatccagtatttccacccagtattccctgcctgccttcataattatcaataagaagcaaagcaaactggcttgagtttcaactcctggattctccagggtccagatcctactaccatcatgccccttcccctcaggcatactctagggcctaggccaatttcattttcctttagatcagtgcttctaacactttgctacatgtaagaatcaccagagaagcttttaaaaaacctgataaccggggcacatcaattaggtcagaatctctgaggctgaaacagcaactgtgctaaaagctcacaccaggtagttccaacgtgcagctcagtttgagtatcagcacttaagacttgcgtggaaaagaagaaagagggaagattacacaatgatcagcccatttggtactttatggaagttctgatgaatattaagtgtgtgaagaaatggttggaacaaataacttttatgaaattacaccttagttataacatagggctaaaggtatggcatttggggccaaacttccttggtttgaaatcttgtctatggccataccaccctgaacgcactctatctcatctgaaatctggttatttatgacctcttagagactcagtttcttcatctattcaatggggataacccttatagggctgctgtaaagattaaatgaattaatttatatcaatataaagggttaaaaatagtgtttaacatacaagaagcaccaggtatgtgttagttgttattaatatcctcatcatcaccatctttgttttttgcacctcatcaatgtagatgagttgaatattctgtctcaaactcaaggaggttgagtggttttgacttccatcctgtagtcataaattttactaatgatatcaccattatatataatatttttaatttttaaattaattcatccaatacatatttactgaatacctgctatgtgtgaaacactgttctagatatgtattacatactaacttttcaaatcgctttcacatacatttatatttatttcatcctaaagtcctgacaagttggttctgacctcagaattatacgatttcaaagatccagtagaaccagaacaccgtatttagcaccttaggaatgtactagtaacagctaactagttaagccctactctaagcacttaaagtttgtaactcatttaaatataacaaccctatgaggaaggtactctcaccattcccattttacagatgagaaaacggtggcacagagaagttatgcaattcaacatgcaaacccagggagtctggttcatcaccctgggagttaatgtgcattaagaaaagatgccctgaaggtggaccataatggaatcacaatcaaggaggtgggagtccaaagcatctatcataacaatttcaggaacagtgtactttatgtcagattcctagtactttgtcctagaaatagtttgctgaagaatgcaataggggttaggaaactgctagaaaaaagcaacaacagcaatcacaacagctaccatttagatctcacaaaaaaactaaatcctttatatacaataacttgtttagttgtgtcattaatataattcatggaaaactttgtaaaaagatttaggtagaataatttccaatatgatcttaaaatatgagatttccatttttaactctagtgcattagttatgctcattaaggctaaaggaatgcatcataataagaaatgaccaaaacacccataaagtgtaataacttggtattggaaaccaaaaatctgcttttgaaaattataaccaagtgtcctgttcaaaataaaactgagcagactctttatatgatgcaaaataaagatcaacgaacatcagaaactacattcttttaaaagatatttttagataaaaagaaatgagttcccagtttaagtctctaaataaatgcacacataaaatctccatctaatataatcaaagcacattcactgtagctgtctttgaggtcctaataaggaggaataaccacatttttttttcagtatgtgtgttccagccttctcaggtgatgaaactagcaacagaaatttgattggtattaataagtatctaataagagagtagtttgaaataaagctaaacttcgattagagcttcagagtcagtgttcatgcaatatacctcattcaattgtaccttcttctggtattcatatgtaatagttcaagccttattaaaacaaagcaaaaacaaaactgctaggatgatgtgaaaaatgcactttttttttttttttttttttagatggagtctagctctgctgccgaggctggagtgcaatggcatgatcttggctcactgcaatctctgcctcctgggttcaagtgattctcctgcctcagcattccaagtagctgggattacaggcacccgccatcatgcccagctagtttttgtatttttgtagagacagagtttcaccatgttggccaggctagtcttgaacccctgacctcaggtgatccacccacctcggcctcccaaagtgctgggataacaggcatgagccaacgcgcttgacttgcacatatatttttaatgtgtgagtgggtgcatgtcataattccagatggaaatttgtcaccacaaaacataatttttatttagctgatctttccaggtttctatttataatggaatgaaaagatgaagttgggcttatgaatcaagacaaacacaggccctggtcattgtgtaattccatatagtataatttgtttgcaatctttcattccatacacctacaatacagctctaaaaataatgctacctacaatataaagatatactttttttccaaataaccttcaaaaatgtcaaaatatgcaacaaaaatattgtatcatatctaaaccctcaaataagctacatttaaaccaagcctgcctgcttttgaaagtttccttgagagtctaataacttagataagcctatttaaaaataaatacattctgacgactaactggagaaaaaaaaaccaatgtgagaaaattaaatgtaacattggtatgaggaatcagaattggaggtaggatatcttttcttaatagagttggttctcaattattcatggtgacgagaaacatggaaaacttcatttaactatgaacactggacatattcgtggtcatttgttttaccacatatatttcagcagaaagctttgacacactataggagattctctgtagtggagttctcttacagaatccctctatgatcaccatcatccatcctggacatccccatctggtcaaggtaaaatatgagatagtggtatgacaaaaaatataataaactaaccagctcagaacctcattgcttcccaaatctcaaaaacacaattttggttttctactttcagtattctggatttctcctcaaatacacgataccccagcactccatcataaggcatcccattgtcttggcaataatattaagccttagagaatatagactactcaagatctaaaaaaataactagtaaagaaaattcaaaatttggtgtcaggcaaatgaacacaaattagttgaggtatataatggcaaactttcacttgtttttcttagctttgttttgagctgtatttactgtcaaaggtatagaacaagtaagccaactttttttttttttgagacaaagtctagctcttgtcccccaggctggagtgcaatggtgcaatctcggctccctgcaacctcctcccgcggaggcctcctgggttcgagcgattctcctgccccagtctcccaagtagctgggattacaggtgtgcaccacaacacccggttaatttttgtatttttagtagagattgggtttcactatgttggctaggctggtctcgaacttctggcctcaagtgatctgcccacctctgcctcccaaaatgctgggattacaggcgtgagccaccatgcttggccaaaagttgacaatattcttaatcacaatcatttctatgcaaagaaagaaaaaaaaatttgttctgagaaacaaatcattctctctagcacttttctccaattggccataattaaattttgcgactgaaaatacattttctatttattagccatgtatgacaggtgagtggaaatggacttcagcacccgttgtatacactgatttgttatgaaaattattttttcaaagaaaatcactgtgctttcaatttattagtaggcaacattgcttatgaatatattgtggaacaaaaaccgttaaaccctagtcctctggaaccttatagaatctcaaaactctactgaacaaaggttcggttgctatggcaacaaatgaatcaacactatcattgtagaattataatttaaatgaagagcactccagaagatagtaatttggtgcctgttcctttgttcttagcccatcaaaatagttgttgttaactacttcctctctttttgttcttactactttaataaagggtcctatttcctgactacgttctcttttgggaacctttctctcaaaggactctgtatgaagcctcagtagcttaaggtgactaccattcatgaaaaaaaccaaaatccccaaagcctagaaaatatatacacttcacacacagaaatgctgtactaatggggcatgcagactgtttaaaatgaaacagcctctctctagaaaagcataccaattatgtggctaacattagggcaacaaattttcccttgccttccttttgcatatgcctgtcattttcctcctatagtttccattcactgtttcaaacatatgttgccacttatttgccaggaaaggaatctctgacctactccctttatgtatcatgaaatagcagacggaatggagccagtgagagcaccattagcagttattcacacttctgttttcccttaacttccttttttttttctaaaagtttattccacatatgtgaagaaggatgtgtaatcacaaagacatccatgactcatgctttataatatggaaccgtggcagttccctgcagaagcaaatggttccctcctccagtgagccacatgtctcctctacaaaaagactatctttacagcttagagcttgaccaaacatagatgatgggttcctttgtccagccctgaccaaacatcaacattgttttcttttctagcaatcactgctagagtttagccaacatttaaccagtcttttaaggaggcacctattctatgggtgaaggctgctagggtattgtcctgagtcaacagaaaacttgatggagagtagttaaaaggaagaggttttccatcaaagatgaaggagattaaggaagacaacatgtggaagtgtggtattacatgtacagtgataagaaatgaatgtttatttcgatctgcactgattatccccttttggtatacgaaaaccaatctataggttaaaaaaaattaccatgggttcatagttatgctattgtgaactaagttccctaaactatatctagcaaacaccaccaggaacttggcctcttctgcaaaaggagatcagccaaaaaataagctcttgcccatgagcggaaggaaatacagtaccttgaataagccacaaatattaccattcatatgttatgggatacatagtaaaaaaaaaaaaaaaaaagtcctgctgactgaaagctcactaaatatatgagaccaactgcaaagctagttggattatgattcattctttaaagagggatgttttcagcttttccagcagtgaacatgggtgactgcaagttgcctaaaagaacatgctatcatgcttgaacctgagacagctaagaataaaatatagttaagtttaaccatcctggccactatatatatataagcattctctgggttatgaacacctgagttgtgaacattctctctatataaaaagccagcctacaccctgttcgaaggatggcacctggagggcaagagtatttccagagctacttttcttcaggttagttggcctgaggctgccatggatgtgacagggaggtattcacctggaatccaaagtgggaacctggaacacatttgttaattaaatatcatgtttcgtgtaacacatagggtcccagctagtccacaaaaagctagctgacctaaatatagcttgaactctatacgtttgcaagaatattgttctctactccgtactgtaataataggagtacatataaaccttgtgaattatgctattattgtgctacaaaatcaccatactatcacagttacctaaatggagttttcagctttattatgggttgagtaagcttccttgtgctagtctgggaatcaactccataattaataatatcgtttttatgaggaaatatcttgaaacagtctttctgcaagatagtaaacttcctacatttaaaaaattaaagtattcactttcctccttgctgtaagaaagcaaattgccctaagatctaaattcagagtaaattcagcattatcctacatttcttccatgagcaaaagaaataataagcaacacagactttagaagtatcaaaaaaccaacccaaaacaaaaaggtgacaactaaaagtggaaacaagaaaatagcacaccagcacacaaagctaatggggccagtgaatccacctctggccagacctggcaccagactagctcctgttaggcacccacaacagatgaacaaatggggcagatcttcacctgaactcctaagtgccaccttctcttacaccttttcagatacagatcttctcccttagcactgaaagagtattttatttatgtatcttatgcaatctacttagtttttaaccatcctatctccttttctattaatacctctccaaccaactcctagctgtaattgtcttaaagcaggagatttgtcttactttctgcaatatcacaaaaaaactttgagtatcatagcagagaggaaagaaaatttactgaagctattatatgctggttctatgttaactggccttcctcctccaaaatgtatctcacttaacatagcaggtccttaataaatgaatactgaatatcttgacacccagcttcaaaaagaagaaaactgtagagcaactcacagaaatatttgtggatttggcaaagggggagccagattttttaccttcaaaacgtcttgggttggggtggagggaagtaaaacctaaagatatttttaagtatctctatatttgataaagggatgctggcaaacaaaaatcattctcaatcagcatgaaactatttctgctcatcacagaaaaataaattatctgtagagtataaatgatttgagattaaagcaattgaagattactttaaaatagctaactttaaaggaattagctatctgcttttgtcaaacaaatgatgtaattcttagatacctacatgatagtaaaaagatccataaaacctcataccttaaaaaaccaaaatctagtcttagattgagaagacttcaaattctataaaatgaacaataatatttgttactgttactaaatgcctattaaaaaatgtctagatgccggctgggcgaggtggctcaagcctgtaatcccagcactttgggaggccgagacaggcggatcacgaggtcaggagatcgagaccattctggctaatacagtgaaaccccgtctccactaaaaatacaaaaaattagccgggcgtggtggcaggcgcctgtagtcccagctactcaggaggctgagacaggagaatggcgtgaacccgggaggcggaggttgcagtgagccgagattgcgccactgcactccagcctgggcaacagagtgagactctatctcaaaaaaaaaaaaaaaaaaaaagtctagatgccaattttgttactggaaatagagatacctgaaagcagaaaggtgtcttctaaaaatccccagatttcttcccagtaacacttgagagaacagacacacagagcatcatgcttgcatcttagcaaggcattgccactcctcctccagtcactgtcctgatcacttctaattcagctctgttttgggggatcagcaccaacaggggcctcatcttctttgtgaagaaaaatacaggccaatagtacgcttagaatttatgtaaaagataacttagaataatccattaagcccacatgatcgacatgaacttgacctatgtttagatcaaggataaaatctgattgatttataagctagttatgtcattctctttccctttggcagttccagacaataaggcataagggcaagcctttgagggtgggtgagatggagtaaggaattgggggagagttatgggaaaggcttactggctcctaaagagacaccagaagagatggcaccttctccacctctgggtgttgcaggtttggatgagatgcctggaactactgaggtcatcttgctaccagtgtgacaatgaagccatcaaagggaagagatcaaagccacaagaaccagggagtcagaggcaacatgctatgtctagaacctgccacaaggctggattttttgttgtgtggtgacatatttcactattgtttgagccaatgggagttcaggtttttggatgattacagctggacacttcctagacaaagtataattttttggttactcacattctagaccacttggagaagccagggcactattttcatgacagttctcagtgaaggtcaatagtttaaagttgccatatcctgggaattcttcaaagatgtgaagccctcacattacatggttctccatacaaaattggagacttgcctagtgcactatgaaaaacttcttaattcaagatgcagttctcaaagtggcatcattcacataagaacagtttccctttgaagcatctggaatgagactccagtgatattctatttctcacagaggtttggtaaaagcatagcagaagctcttagaccatccctctttacatcaggctctgactaatgtgtttgcctgaactaagaagtaacaactgtgaaaaaatcagaaaaattattatattgtatttaatataaatttaactaataagtgttagtgaatcatagctattctagatagccgactgattcttctattaatatgtagacctaagaatgactagaacttaaaaagtgtagttttgttaatagttggaccttatcttggacacaatgtttatacaattaggcaactgaaaaatcactggtggcttattagtaagctgagcaatgaatggaaatgctgtgatgtaaatctgtactgggttaagctaaaactccatttcttaatttgaaatatttccttttagacatagttttcaggctgattttcggtatgagattattattgttctaatgtccattgctgatggtgaaatggattagctaccctaacctagtgtctcaccaacaaaacaaaacaaacaaaaaaaacccaaaaaatccaacacatattaaaaagcaaaataaaatatatacaatatttcaaaaaatacatctataagatggcaagtaatattaggaatattcaaggccaaagactgaataaaagtgaaaacctagaaaggtaaagcaaagcacaaaagctggtttttgctttgagaatgttttgttaaactccataaacttaaattttagttttcatgacatcatagggcatgtagacagagtacaaagcccagggtcctcccagccccacataaagctgagatttcaaagagctaaactgtcagaatgcccagatggaagtacccacattacccagacgaaagggtaatttagaaacaaaatcaacctctaaaggactgcaaggaaaactgctttccatgaactatggcattgggagttagagggaaaataaactccactgagaaggtatactaacaagctagcccacacgagaatttgcagattcatactaactgggtggtctgaaaaaaaaacaaaaacaaaacaaaagaaaaaaatcccaaagatcctaggtcaaaaaattcagtttaaaaagattttaggctgaaaatacccctttggcatttggcacaaatggaaatcctctctagaggaaactaccttcaactcagggctcaaggaattcctacatataaaattctgagatacgtgacttcatataaaaaaatctgaaagcatacagaaaataatatacaattattgaaagccagtgacattaaatggcagaatcagagctgcaaagacctcagatatttaaataatcagacagcatgtaagacatacttaatatgtcagaaaaaaaaaaacagcggattggtatttctagtttaaaaagtaaaagactatagaaaatggtcaaactagaaaaacaaatagaaactttgggaaatgaaataggtaacaactgtagatcaaggaatgagaattagtaaactggaagaaaaattcaaagaaattgcacagaatatagtctggaaagccaaacagatggaataactgaagagtagttaagggatgtgaagataaagaaagtctaacatgtgtctaatctaggttataagagattaaggagagaaaaaactgttcagaagccatatttgaaatgttaatataaactaagaattttctagaactgaagaaagacactaatctacagactcaggaagctcaatgaaacctggtaaggacaaaataaaagaaatctgcatttaagtacatacaaatgaaatagtataatatcaaagacaaagggaagatcataaaaacagccagggaaaaaaggaatgacaattagatagatgatttttcaacagtaaaatgggaaaccagaagttggtggaataatatcttcaatgtactgacagaaaacaagtctcaaccaagcattctatacccagtaaaaatcctcaagaacgatggtgaaataaagacagattcaaataaatacagtgtgcaaagagcagacttccactaaaggaacttcaaaaggatgcatttagattgaaggaaagtggtcccagagagaagtctggaataaaagaagaaataagaggcgaagaaagtgttaaatatattggtatatctaaaccaataattgcctaatagaacaataatagattataatgtcctatggaattaaagttagaactaaaatatataataacaataatataaaaactgggagggtatgctcagaattaaaagtgttttgaagtccttagatttttttggaggaggattaatatactgagtagctttagacttttgagaatttaacttgtgagatggaatttatagggtcattaatccctaatagaataggaatacagtatgtattacaaggtagagagagagaggaaatagataaaaataaaattcagaagaagccaagaaatgagataaaagcaacaaaaaggtggtacaaatggaattatcaaataagacagcaaataattactataaacatagacaaaatgatcctgctaaaagataaaaattgtaaaactggattaaagcaattttaacaattataattcctagctatacgttatttatatgagactcaccagaacataagggtatggtaaagctgaaagtaaaaggtcagaaaagacattagtaactactaattaaaagaaagattatatagctatgttaatatcaaacaaaatgaacttaaagttaaaaacatctataaagggttattatataatatgaagagattccatttcctaggaacagtttgaatttgtgtgcatctaaaaatatgtaaagcaagaattgccagaaacacaaggacaaactaatccatcatcacagtgggagagtacagcacatccttgttagttattaataaaccaagcagataaaaatcagtaaggttacagaagatcttaacaacacaattaacaagctttatttatatacagaaaactgttaagtttcatgaaacataaattatcttcaagcagatagagaacctgaacaaaaagtaaccatgtagtgaggccatgaaacaaaccttaatgtcaaaggatagataacatactgatcaaattctctgaatataatgtaatcaatgacaaaaaagatgctcttcctctacctaaaaatatgtttataaaaattaagaagcacaattctaaacaactaagtaaagagatgaaagcccaataagatcatggagagaaaagagacaagctaaagttcttagcagagttatttttttgcaaggaaatttatgaaacatcaaaatgaatcaacaaagatggttatagaatttcttttgctggaagagagaaaaatgaagataaagtgttcatatctctacaaaaagcagtctaagaagattcttttctctactttaccttccacagccagtatataaaattgttgataggttaagcagttaggagggtgtacctaaaacataaagagcctctctctattttcagtgatggatcaaacaggcacctctacaaaaccaaccaacgaaccaactcattaatattcaggggtgcttttgttttgttttgttttgtttgttgtagcctgggagatctttacccagccaccaacttttctctgggaagaacctttggtaaatcataattacttatcaagtaaatggctcaaaaaccattctctagcagtcactttttttttttaagctatggagtctcactctgttgcccaggctgaagtgcagtggcatgatcatggctcactgtagcctcaaccttccaggttcaagtgatcctcccacctcagcctcccaagtagcaacaggtgcacaacataatgcctggccctctgacagctattctaatatttaataagttcaaaataaagtctcctatttaattacaacttcatagacccattttatttttattctcagagcagacatttaaaatttttcaatagatgctgctccacatcaccaattgtccgaagatagtacctaagagaagtattaatatacaacaggaggccaggcacagtggctcatgcctgtaatcccagtactttgggaggccaaggtggatggattgcttgaaccttcccaggagttcaagatgagcctgggcaacatggcaaaaccccatctttatggaaaaaaaaaattagccaggtgtggtggtgcacacctgtagtcccagctacttgggaggctgaggtgggagtagggagtatgaattgagcccaagaggtcgaggctgcagtgacccgtgattgtgccactgcactccagcctgggtgacagaatgaggccctatctcaatatctacatcatatccatatctatattatatgtatatctgggtattcccagttccatttcatataaatatattgtacttatataagaaattgaaaaagaattttctaacaatgccatgattcatttaaaactgctttcaacatgttattcaactgctcaaaagctgctgatggcacccgactgtctgtaacatgaagttaaaacccagaacccactacttaaattttaagacctattcgtagcctggatccatcttatgtgacctctcagtcatggctgtgatagccaccacatgcacaattgcctgcagaggcccagctctgctccatgagagccaaccaatgactatagtaaatccagggttcctttgttccaccattctccttcctggaatgccttactcacccttcaaggtccagatgaactttaacttctgatgaagatctaccagatatttctaagcctgatactttttttttttttgagatggagttttgctgttgttgcccagactggagtgcaatggctcaatctcggctaaccgcgacctcctcctcctgggttcaagtgattctcctgttagcctctcgagtagctgggattacaggcacgccaccatgcccggctaattttgtatttttagtagagatggggtttctccatgttggtcaggctggtctcaaactcccaatctcaggtgatccacccacctcagcctctcaaagtgctgggattacaggcatgagccaccacacccggccagtactttttttttttttttgagatggagtctccctctgctgcccaggctggagtgcagttgcatgatcttggctcactacaacctctgcctcccaggttcaagcgattctcctgcctcagcctcctgagtagctgggattacaggtgtccaccaccatgcctggctaatttttgtatttttggtagatactggtttctagtagggatgggtttcaccatgttggccaagctggtctcgaactcctaacctcaagtgatctgcctacctcagcttcccaaagtgctgggattacaggcatgagccaccacgctggccacctaactgatatttttaaaatattcttacttcacccaactcaatatcttaatttaatgttaatttttttttgggcctttgttcatttgtttgttctatctacccccccaaaatctgggcaggaatgtgctgtacaccaaacttgtccaagccgtggtccatgggttgcaagtgacccaggacagctttgaatgtagcccaacacaaattcataaactttcttaaaacatgagattttttttttccgatttttttttttctcatcaggtatcattagtgttaagtgtattttatgtatggtacaagagatttcttcttccagtgtggcccagggaagccaaaagattggacatccctgctttacactcattcccctctcaccaggaactcagcatagtgataacatccctgctttacactcattcccctctcaccaggaactcagcatagtgataaacacacagaaggtattcaacaaatagttgctgaatacctcttaaaagaatacagtaggactcttctatatctataaatcatctctcactcacgtccatgtgcacgtgtgcacacatagagtgttctgtttgaatattccaccttccttgatatagaaaggaaagtgtaatacctcttttatccactcaattcctttacagtgaacaaacattatcaacaaaggtggatttttagtcagaaatatcctcatgcacaaagagtgctactagttgttggaggctaccatgactcgctgaaaagatactgcatacagcctttgggaaatagattccccattctagatttacagagttgagctgtattgttcttcatttcttgttgttgtagtagttggtaaatgtacacaaaagccttcaagtctctgtgtgtacatgtgtgtgtttgtgtgtgtgtcttttgggcagagaggagggaagaagaagggagaaagatatctgttccacaaagtttcaacacatagtagccacaaatagatgacagagatatatagacaaatattgtttttaactaaaagtcagtcagccacctttcagaggtcaagtgagccctaagccacttttacattttgagtctactgatgtatttttaaaaaggaaatgaagaagtatcaaagtaagtttatgaacttgtgctaaattttaaatccttgagtttaacaaagaaattttattttttgccaaaaaagggcacgacaataaaatgtaattgggctagtcataattataactctaaggggcatagtctagtaatgggacaaattagcaataataagataagtttgtacttctataaatcttagaatgcatcagcatttgaagataaatctcagagtcaaagtggaagtcactgagagtcaacaccaggtccccatgaaatagccctacaagcatccaatacaaataagtaggctgaaagagtctctttggtattactagggcaataatagcctcaatggtaactgaaggctgcttctgtgtgtttccaaactcagctggaacagtttccattagaattgattatgttcaaaaagaaatcagcactattttaacttatgttttgtcaagaagtgactgagcctatagttgactgctgaaaggaaactctgctcctgcagttttttccctcaagtccacaggctgtcagaacagtatcgtagcacaattttccccacttgcatggttaaataccaccccaaagaagaaatttccttagcaaataatatttgtggtcaaggaagtaaagaaacctgattaaatgaaggaaaaaaatagtttctggacacaggccttatcagtattcagctgcttcaaaagtacaagaaccaaaatctatacctgtaaacagcattccatggtatcctgtatacacatttgcctcaatggttaaattgtacaaaaatgaactgaaagctaacagtcaataggcaatagctgggagtagttcgcacatgattgttatctctttcttctgctgaattcaaagcacttcctttcattcatttcctcgttctttaggtttgcagaatgctcactttgtgcagggtattgtgctggtcctcctacagaatcccataaagtgggaaggaagtttgagacatcagagacagcaggtaggcagagtgactgacagacagtaggctcttaataaataacagcaattcctttcccttccctttccactccctggaacttctttatagaggttccatatttgagctatgaaacttaaatcaatgtcataatctaacaagataacagattcagaaatcagcaatacatgaaaatagtttaaaacatggtgtggtaggattttaagtgatcttttccatgtactttctattattgttgttctaacactgatagcaccataaataaaaagggagagaagacaaggagaaagaaggggaaaaaggacagagagaggatattatatgaagcagaaacattttagaattcttcagtaaaaaagcactccattctggcttgagcttttcccatatgcatatccctgaacaggctactgcacagcctgggtcttagttccatgaactataagggctgctaactagataatctccaagatccattctcactctcctagcccatagttcaagtccaatgaactaaatagcagatgagagaagtacaaagttctgtaactctctgttagtactgtttaccccctaaatccaaatcttactacaaaacactgagtgtgattttccccagaagttgctggagtcagtatgcagttcaaactctggtgccatcattccctagctctgtgatcttagacaaattacctaacctctctgttcctcagttatctatcccatagggttattatgtggattaaagttgttactatttgtaaagcgtgtagtgtctgacatcaattaaacattaaatgtgtcacctattattgtttttgttattattataacaatgaagtcatacaaacaaaaccagtatagaagtgattatcctagattatcacagaagcagtacatgatgacaacatttgggtgtgcagttgttcattagaagactgatgatcagtaagctctttgactcaacagtgtgatatggttgtctaaaatggtaagaaaatctgtttatacaacaccccccagccaacacacacattcacatagcctataaaaggggaggataactctgataatgctgaaataatcatgatgaaataatctgttcattctaagcaccaaccttttggacacagggtgtgaaaagactaaaatgatataatataggaataactgaagactcaagacaaacttttcaaatatttaaaagacttttatgtcaaagcaacgcatttattcaacatggtgtcatggaaagatgaagaacaatgagtggaagttagaagcagccagttctcagtttggaatggaatggacttgctggggaagtaaaaaatctctggagctgttcggcactgattaataacaactagactgtgcatgtaccaattcttagataaaacactgaagttttgagagataattcaatctaagcgtagacacaagacttttgacatatcttccaaacctgcattttatgatgtagactggatgcttagtgacataaattataatagaatttctcatgtacagaacccccaattggcaagcatgcaagataatggtgttacatgataacacagaaatttatattaaaagttcagacatctccattagggttttgacatgtggccaatcttagtggcctgagatgataagcagcaatctataaatctccaatttaaaacaaatgcaacaaaagaaaacatttctaatccataaagtagacaactagctcattaatgttccaaattagttttgcagttagtataagctaggtaaattactcaattattaattgggatttcagatactaatcacactgtttgtgccattttttcatgtttcccaaaagaaacattcagtcccagaaaacacagtgactgggtcaccaatttactgtgtgaccttggggcaagtcccttaacctctctgagctccagttatctcatctatttaaaaatgggaacagagagtggcaataagaagatcagatgttttctaaggcctcttataccctaaaatatgattttatgaaaggatcattcttcttaataaaactctaagcacaccttttactcttaatttgttcatttttctcagtgaatacatttccagccattatatgaggaagtggaagatttagtcttaccaccaccactgactgcttatatgagacagttttattttgtccttctagagtctggaagaagttgccagacaaaaggaaaggattttacaattagaagccaccttcatatcaagcaattaactacataaataatggacaaagcagaatttggaaccgaaagggacgttttaaaatgtaattttcataaaaataatcttagaagaaatagttttactcttatttttttacttcctggatgctttattttctcaggctttctaggaccatttcaatgagtcttgaagtttataattaaaatttatgctcaggaattgctctatttgagttccaaagataaaagaaaacatataaatccaatttacctaactgttctactcttagttggtcaactattccaaagacatcctaaactattccaatgacttcaaactaacaaaacttgttcaattgtactttgaatccacaggtctttctctgcaaatacttaccctgaaatcaagctccacatctacatgggaaaatctgtcagtggtttctttaaaaatgtattacttaaaaaagaaatgggtcagtcacggtggctcacgcctataatcccagcactttggaaggccgaggcgggcagatcacctgaagtcaggagttcgagaccagcctggccaacatggtgaaaccccgtctttactaaaaatacaaaaattagccaggcgtggtagcacacatgtataatcccagctactagggaggctgaggcaggagaactgtctgaacccaggagtcggaggttgcagtgagccgagcttgcactactgcactccaatctgggcaacagagtgagactgtgtctcaaaaaaaaaaaaagagagagagagatgggctacaaattatatgacaaggtccctttaaaaaatggactgaacaaagcactgagaacaatctgtactggcaagggacagggaagatgacctaataggtcttttccgtctctaatttctgtgatttgggggttttttttcacttctgcagtaatacttgtgagttcaacattttctcaaaactattattagttaccaaggaaacacaaaatgtttgtaggaataaataagcaaatggactggacctaagtaacagacttttcctgcttcccatttaataatcttacagtggcgtcacattaccaattcttcattctttctaagtcattctacttacctactagtatgctcactagagtccatagccaacttatggcatcccctgtaaaccaagggtaggaagtctcttaccaacagatgattccttattaaatagacttccttgctttgtttgatgaggaacaagaccgtggcaatgttagggggccaacaggcagtagttggctttgtgaccaccaatgctagggagaatatgtaaacatgcgcttttaaatagcccaatgtctacagaaaagccactaacatgattcagaaatatataataaaggcaaaaagaaacataatatacatacacatatacatacacatacagggtccatccacactacgaaaatgatgctttataaatgcttagaaaaagactaaaagaaacacagtacattgaattgttaatagttggcagtattcatgtggtaggactacatgtaaaattttttacttttatgcattttccaaattatgaagggtgcctattaattttaaaataaaaaaaattttaaattaattttaaaacaaaaaaattttaaattaattttaaaaccacaaaatatcatcattttaatgttttaataacaaaggacttcccattccctagcatcacatggacactactactgtaatcacttctcaaggtacatatgtcactgttctagagtcatagtcagctgaagtatgagcagaataattggaagccttctggaaactctgcggaccatatataggcctgggaccagagattcaggctacagataaaagtaaagagggtctatatatatagacctgcagttcatatatatattcagttactgcagtttatatgtatattaaggtctgctggttaaaggctcttttaagtacagtttaagtgcggagatatggtatatttcatgtgggtatctacatgtacagagccagacaggtggcacccaaagaactgaaagaagagtgaaagaagagtgaagaaatgaggttgattagaaaaatgattgtctagggcatggagagaaggttcttttaccacagacatcccctttggctccacattcacagttgcctacaggtcccttcagccttcgtcctaagttgtgtagcagcagaggagaagggatcggagagtagaagcacaggatcggatccatggcaaggttatccagtgctcagtggcaaagctgctttgcaagaaggctgtgggtaaggtggtagaaggtagcgtggggtgcaataaacaccgaaagctcatattctggccaatccaactgtagtctgaagcaatgcaggaccatggaactatacctctccctatgcaatcctgggtctgttcccactctgttcagcttcttatacaggaccaggtccataagaccaggtcttatacaggtcttgctgtttttctttgtacatgacagtgtttccatatatactatctcacagaggcaaagaagcaaacatgtcatatacaaagttagcattaccatctcatagctcaaagcagagctcctagggagcagagcgtaccaactgcttaaatgaccaaaggaccagcaatgaaaattttgggtagctgcaagaaacatcctattaattactgcttctttggcacttactatacttggatgactgaaagacatgaccagtcaaaagaagaaacaaaggcagggagagaagacatgaaagaaaataagagcagttacttcaaaaagaggaactggcttgatgtgattagcagtatattaatggtattttttaaaagttaaataatgatgatgttgtaattatggtcagtagcaactgacttcactaataacacctgttaatgtggtcattgtcatggcctcctgacaattagctcgaaccagggaaactggtgatattaagctgtctttgacataatataatatggctaaatctagttggtatctccttgtttcttgccttgttacctacaaaccccttctcccgcattagaaagcaatgaacttggtagaaaaatttctttgtatcatttctaaataacagtttaaagctagtgctgatttagatcataaactcagattactaattgtagaaaggaccttggtgtctaggtatgcttatttgtagtaaattcctgattaaaaaatgaaaagaaagtcacaaaagtaattggacagaacaaggttaggaagtaaaactctctcatccaattttgaggcacagtgatcataactctactattttcacaaatgaaaccaagagaatttcacaaatgaagaaaatttcagaaaccaagagaataaaaattacatctcagaaagaattttggttgaaagagggaaggaaataaaagtctactcatctacttatgtggccaatggcgcacaatgccaacagctggttggagtttgcaatacaccacccagggtactcttgtatcagttaaaggtcctgctccctcaaaacccttgactttcgtttgaagtgaaatggtgatgatattctaattttactagaacaagatacgttgctgccaccttccagaaaactgtcagtaaatccacaaatccacaaaaaagaggatgagtcttggctttcccagttcaagattcagtctagaaaataaacagaaacttctcagttaaatctgaacactcctttaccaaacatacctctgagagattctgaacaaactattaggagaagacaagactatttatgtagaagaaggctatatatgtaagactatatatgtagaaggctatatatgtaaacattgctttaaatccctgtatcattactttagtagcggtgtgaccttggtcaagccactttagccttctaaatgtctttatctgaaaagaatggatcatatcacatcaaaatgtgttgtgaagattaaatgatgaaatgcttgtagagcactaagtatggtggtaggtatgatctaaaagctcaacaaatgagggctattaatattggttcctgaagacagtggtcacataactatgacctcacttggaaagctgagtcatagctgggtcaagagactgatgtttcaggagtaacacattagtaatgtaaccaggcaagtagtgtaccaggcaagggcatacaaggagtagaagccctaatcctctttcctctattcttcagaatatagctaaagaaaaggaggaaataatactaacatatttcatgggaaccagcaagtcaaaagaatgaaaataaatgcaaaacttgagtatggatatgtgagaaagaaacaaatggtagtgttaaatgttaggaaacatatttgcctatcagagggaaaaagatgcaaaacaagctacaaaactgttagctttggggtaaaagtatgctatcagtttggggctgagattcaggtgtttatgcatcatacaactttcataaaagtcatttaatctcatttgtaataaaaaatgcagcataaaagtctcaaaaaggatatttaataagtatgaggtaagcacaggagactaaaaagattacaatgcaattcacaagtatagggcagaagagttaaaaccaacaaaactacaaactcaacatccaaaatgttagtacacaattgcaaatcaaatattaaattttaagttcggctgaagagtatgtgtaattcacatctcttagtatactgtatatgaaaagcaagagtgagtttactttaggtttctcagtaggtacttagagtgatctagaataatgataaagtgaactcccaatttagtgaagaggacatacatttaatgttgtgccctgcatctttattccacaccatttccactaacaactctgcaaacatcctttctccactccacactaagaaaatgaagcgagcagactattttcgtcattcttgtttgacaaaacatatggaaacaataattctacagacatatgtacatcataataggaagcaatcctattttaatgtaattttaaaagaggttttaaaaggactcaagctactaaaattactcatctgaagcttgcaaataagaatgccacgtccctaatttatttagcagattcatatagttgggctagaactttaggtatgacttctcttataattcggaggtgaattctcattcacaagaagtaggatttgtacaagtaaatctaccccatactagaggataatattcttaattcaatcacatttggctaatttcttttttcttcacgtggttatttttggctttattttgtttgccggtagaagagaacaaacattaaaactggctctaaagttctaattttatacattgtcttgaaagtacagcacaaaacatttaatttctttaaaaattttttccctgccaaaaaatgatagttttaactgctttcgttaaaacacaggcatgcagaaatggggaaagaggaagttctttcaggaaaaacactgaaaaaaataagatttcatctggcctttccatcatcacttgaagaattgtttggtagttacatcatcaggaaataaaacaccatcctctgaggacccctactcattacaaagaggaaagagaaggtttgaagtctaaatcacccccagagatgtctccacaaaaccccagacttctcctttccctctcccgcctacccccagcaaccaaaaataaaaagtataatgaatttacaaaagtttacataagaataacaggatgtgtattgaagtccctgaagcaacaacagctttagggacccagagggaaaaaagttacaagcggatcgaccctgcctcccaatgactttgttagcccgacaggagggcgccggcgccccggcccaccggcccaccactcattccctccgctgggagccgggaaccacggtccgttcacacggccggaacatccgcgggagctggggtgtgtggctgcgccgccgccgcggccgagggtcccgcggtcaccggcgcccccgccgacagcgccgcacacgcggagcgccttataaggcagaacagtgacgtaacgcccataggccgggcgcgctcagcgccccgctcgcattgttcgggcgactctcggagcgcgcacagtcggctcgcagcgcggcactacagcggccccggcccggcccccgcccggccccggcgcaggcagttcaggtaagcccgggagagcaacttcgctccaccaaggggcactgctgtcagacagccaggtagcaagtctgtgggtggctgttaaagctgtctcagcatcacaaactgcagacaggtttcgcaaagcgcatccaatgaattctaggttcaaaaccgtttccaactcacacaaaacttgaaagtagaagttttctctggaggagaaaacagattagagatttaattttaaatgttgagaggtgggaggtgactgtattacatacgctttccaagtgagctacacattgaatcctgcccatattgagaaatctttggggaaagggtgggggagactatattgtactgcagcaaccctatctctcctccggactcaaactcgcttgtcttacatgagcagaatgcgaaaatttgttagtgccaggttttcccctctttttgtaaatgttaatataaacgactagaaaaacactgttaggaatacatcttggaattaagacgaatctaacttaaaaagtaaaatctttttaagcttcaaaaaatcgtacaaacgctattttgtcgtaaaagcatatgtcaatttgtacaaggaagtaactatcatagttttgagttctaactttctgcttcaagtccaggcattggaaaaatgacaaacctcacttacagctatcatttctagagtaatattttggatagtagtatattatgtaaaaaatgccaatttaaaaggtaaaacttatagagtaactgtattaatcagtaacattttaaaccataattagttacatctaaatcctgaagaggctattgctaccaatgaactcttacagtatgataactgaacacttggcagaaaaatctccataatattttacttcattttttccaactaaaagtcaacgtaggaattaaaaataaaaaggttatgtcaactttagaacactggaataggagatgaaaaattgattcatcattcaatccttatctggtctaaacatatattgtaaaataaaactttaacaactatgtgacagaattgtcccttttaaaacagtctctatgttttataagtatatacaattcaaactcagaattcataggctgccatttatatttactctgagattttaaaatgctggcattttagttggcactaaaatgaccatataagataactgtttggaggtacagtaaaagtttaacagaggagcagagcactataaccactgaggtgtatgtgtgtgttacaaactcatgtttttatatttaattgtcagaagaaaatgtcagatcccagattttatcattgaaacacagcatttaaaaaatactcaaaatgtgggttatatctgtatatttctaataatttctgttggatggtttttaaaagtatatgacattggtgcctatcatttttgcctcatagcagtttttttgtttttgctaattttgtttggagcaatgcacgactttggttttcatattttaaaagaaaaattatatgttatttggcctgaggataggctatataaactgcaggttagtactgagaagtaggattttccacaaactattatttcaaacctagggaagcccaccataatgagaagagcggggccaacacccatgtcactgtggagaagtacagaatatgcaatggaagagttgtttatctgatataagcggtaattggaaactgaaaaattcctgctctggaaaaaagatattctgctcttctgaatctaacagaggaagagacaaacagaaaccatcaattattgtttcaggtatacccagagtaccatctgtaccataaactacaactcaactgttgaaaatcataacttccatcaaaattctaacagctgtgtttcccagtgtcttttatttttttaaagcaggcaagcatcgattttttaaaatttaaaaataacactctttaatattccacactttttcccatttattaactttaaagcatggttcaaagaacaatcacataagacctcttttaaaactgaaagctaagtatgacttatcatggataccctatctcacactgggctctttggatgagcaatttcttagtccttgggacaatctgtatgatgggaaaatgtttttgatagaatgaatgtgaatttctacacttccaaataaagcacataataattttatgcttagtaagttcatttgcacttttgtggtgattaaccttaactgttaagccctggtatttttgtgctattttcctaatgctgtgatggagactatagtaacagccagtatgaaaacacaaatcaagccttgacttaattttccggttctcttgcagttcccattaatttgccttctcaaaaggctgtaaattttgtttaagggttctctgctgtaatttcccctccaaaaaagtgcctttggtaataaatggattttgagatttaagaaaaaaaactgaaaatgtaggaggaagaataagattccaataattctgcttaggtcatgttctgtccatgtctagtgcttcagggcaaagtgaacattttacaaggtgaatagaaaaaaaacatacagcccctcctatttaaaggaaaaaggaagaggggcaagaagagaactgtttataaaagactggatattgtggatgtaaggcaatattggtctcaacctgcttcaggaactgaaatggccccatctgttgttcacagagcctgtcatctttgaaaaatctaatacaccctaccttatctgttggacatattaattttaaacgattttaaggtccatttaatttgtatttgaccatgaattcagcttcaatttaaactgattgtttagtttttgtaaattatatttaaataaggatttaaagatgaagagacactgcatatgcagccagcatcacaaaccttcaaagcaatatttctgtggttgctgctgtcatcaccacaacattttctagccaccaacccagtcacttatgcttaaagtgtgctgcaatgacttttagaacctcctatggctggtcattttctacttaaaatgaggtaggacattcatgttttgagtcattttgttaggtacactaattcctagcagattatcaccaacacttatcagcctttgcacatccctcctttttttaaaaaaaaaaaaagacttgagattctccttgaccttcatctgcactaacatcgtctctgcctgggaaagctgggcaaacaaaaatgggaaggcttaccaaggaaagtccctggtttctttttcagatatgagaaacactccctcttcatgcttgttctctgagatgctttagcagattaagataggacagcagcagttttaattctgagcccaagaacgagaacacattagcagtattctttttccagtctgaccgtcctcacatttctatgctctactggctccaaaatatgataaattgttaagtatagaattttttttaaacaagcttggggaatgatgtgtttgtgggggcaggcaggggagcagtagggaggtaagtagaggagtagataggtaagtgtatgattgggacagacaggatgcagacatacctcaactccttgtgtctgtttatgataactacttattctagcctaaaggagttattatcagcaaaagaaagcatacattacatcagaacagcaaacattcaactatgaatttgagaagtaccttgataaggtacttgactatatggaaaatgggataccccaggccccacagtcacacacacacacacacacacacacacacacacacacacacacacacacacacagtcctggcacagaatatccacagaattttacagctggaaggggcaatggaggtcatctgatccaaatgcctcactttacagaagaaactgatgtccacagtgtgacttgccccagagacacagctatgcagaggtagggccagggccccctgcattcttgggctacagctcaccagtagtttttccttaattagtgctaggaagagaggagaacagaagccccagaaaaagcctcagtactgtaggtgttaatttagatataaaatccattaaaaaaagaaagtagaaaggttcaaagttcttaagtataagcaataaaaaagcaaaggataaggaagcattgtgaaaatcaatacaatttaatcaggctacaacaacagaagggaggtgataaagggaggaaagagaaaataaaaaataagtgtatttaaaggtcctccggctggcaaatcccactctctacttggaaggtgagaggtgccctggaaagactgtgtactctgtggtcaaagacatttgggtctgaaccactaacttgacaaatgaccttctattagtatcttccagctaagcattttgcactcctcagacgtccgcagctagcaggatccctttcaaaattcaaagtgactcaatgccttcaaaacaacctcccccaaaactgcagaggaagtcacctatgaaggctacaagctcctggtggtacttaccctgctttattttccttcaaactgtgcactgtgatgtgacattaaattactcattaatgatttatttgcttattatctgtctcttggactataaactccttcagggtcagttttacaaccagctttacctccagtgcctaggaaagtaccgaggtacaattagtaggtgtgttgctgggacagaaaaggtgttggataaatatatgaacaaattacaacctagaagctgcttatttgatacaaaaaaaaagtgtttctgcaaacagtgggctgtggagggccccttcttctagattttgtttaggagctgaaaacaaatctcagccactacttaaagcaaccatatggaagtgacttacagaaaccagttaggctcaggttaagtcaaggcagtgaacttaactagaaaccaagttaggctcagcttaagtcaaggcagtgaaatctgctttgtatggcagtgtatgttatataggcagactaagtcagatgcttttctgcccatcttcatctacctcagtttaattccctccccaataaaatgagactttgtatacctggtgaaggagtatcaggtgagtcacccgggggcatggaatggccttcaagcaaaatatggaagaacacagtgcagtggttaatgaagggtggactcctctgaatttctctaatctctgtgcctcaggtgaaggcctggaagatgcacttacggggcacaaatggcttatctttgccatgcagcagactgccttttcccaagcatgtacttcattccaaagtttctgtgggtaaaccagtgtatctcccagattttacagaagagtgatttttctttaatttcaaagttactccaatgtcaacctgtgaagctagcctagggcttataattctcctcagcagtagcaaacatttactgagctaagcacaaggcatgaaaacaggcccagcaactaagttcaccacacaccataccatgtcactaacccagctatagctactagcatggactggtaccacattaatgacaaggactaagatcactagcagctcttggacaacaacttcaattatggtcccatccctgctctattttaattgactggtaatgcaatgaaggtaggagagatcagctacacataaaaactaagtaaagataaacaatgtgggagaatgcttataaaaacttcaacagaatatagtcaatggccaaccttgctgaatagtgacactgaattgacagggataaatgttagtgtctcaacggtgagactaaaagagtaagaataatgggtggataaatcagagttctactcttcttagctctgccatccatttactgggtgagcctcctgttcccttggtttctacaaattacaaaaagggaacaatgtcatccaccccaagtatttctcagtactcaataaagattgaataatgagcaataaccctcatgggaactctgatcaagtagagaagagacaatataaaaataaaagctactgattatatcactacagagacaaattagctaaagaaaatgagggtaatttgagggaaagagtccacatgtaaatggagaaaagatgaacacagctgtagcacttgggcctgtgagagctccaaatcactgtatctaaagcagcctcaaggctgaggtcagtcctctaagatgggctgccctgacagaagcaaatctgccagatttattgtgtctcatggcccaccagtcctggaacaaaagtttaaaggtgaaatatgtttttctctttctttttaaaatgcttttttatgtgaatcaaaacaaaaacaaatctctgagcagagatcataagtggaatgtaaaacatcacatttgggctcgcaagacttaagtgtctgcctgttaaatttgaagaaaaggaaggagttgcctggtccaggagcctagagagaacatgagaaagttgctggtttcttgctgaagacaaacacccattcagtgagatattgtggaagtcccttagtcttaacttgttagtctgttaattgggaatggcagaagaagtgaattactctgtggaattttgtgaaaatgaatccactgctgctaaaaggaaaattatctacttttcaaacactcatattattaaaataaatacattatgtttgaagtcgcatattattcttgaggctttcaaataaaagtgagagtaactttgccaagtgatttggggctccactaatctccccccaaattctgccccataaaattctttttacagttcaataaaattcattaggctgaacacagatgcaaagaatcacaggcaaagttaagattctctggccaattttccccatctggactttaattaaatttgtctccaagtgaattcttctcttcactaaatggttctccttccagaagtgacaagaacaagaggaacaaaactctacttgtccttcttccattctaataacaagtcattctgagaactttaggtaccactcagcctaagggatggttatactcccctaggaagtggttctttttacctctctatcatttggtcaagtatgcacagagttcaacccatatgagggatacagaggtattattcctttaaggagcttacagttggcttaacggcaaaagtaatatactaaaacaaattagaaagcagtacaaaataatgtagaatatttaggtaataaagctgtaagggctgtggggacttagaaaaggaaaatcagccagggttagacaagttaagaaacattcatggaaaagatgggaactgaaatgtaaatggagatgactgaatgcagcattccaaaaaagatggcagacttattcttcagaagtctattatgaaaggagaacctgaggttaaaagacaaataaggcttgtgccaagatcagagcacccaaactgtaagtttaaaaacccattatttggccttcagaacaacctggacttatgcagaaaggaaggcagcttaaagtaacatcacttcttaacctgaagcttaaacgtgatgaagcagttggcacagtgccaaacctatagcagctactgttactcttctggttatgctagtctatccatagggatgatgctccttcatcatctggtgctgctgggctgacatatagggggctgtctcaggccaaagaggaggtcctttgtaggatgcagtcatgaagaattcctgttctcagacacccagctgtgaagtggagtaaaggattaagcttgttgaagatctgtctctagcgtgcctaaccttagccactctgtaaggagaggttaccctttaccttgatttccctgctacaaggcagtccctcctgtgagaaacccacaagaactttcctaaaaatgtcttactcatctgaagtaagaaacaacttcctgagcaggtaaaggaccgaagagagctggtgactgcaaaaggcttaaaagctagtttggaatctccctgttttaccatgcacccacaaaaaacaaatctgtaagacaaatctttacaacctgggctaaatggcttatatcagatcctagccacaaacaataaagagtctcttttgaaattaacagtctaaatactttttgcctaggtgttaatttttcagtttaattgtactttgaatttagtataacattttaagtacttatttgcttttacagcatacttacaacttgtgaactacaacagactcaaataaatctgaatcccatggaattccaattacggttttccattcttttgaaccattgagacttgatgagccataaaatctcttgacatgtgaatttgtatacagtgttatataggaaagaagggaggaaaggactctaaagattgttgggagtatttattttgtggaactgagatttgagattgccaaaggctttgtagaccttagagacaaaattgcactgctcttcccatgttgcagctaaggtgacaagcagatgaggtaaggtcagatagttaagtcactagcagattttggtccaacatttcctgtccatcagatatgtggcttttcaattgtttaatacctggggttctgctttctttgtttttagctgtgaattagtaaactttaaaaagcgatgaatagtgaagccagagcttttttcaaaaacctttttttcagctactaaaacctgagatagtttgccttctcttaaaattcaaatcacaaggtaagatatggtcagggcaaaaatggatggtattcaaatagcacatacatgaggtatactatagccatttctttaactgccacaaacagaacatttctcacatagataaactaaatgggtgaaactcctgctcagggacagtataagcagcagacccagggccaagagaagtggggtacagtcattgctctcacctctagcagatatgctgttgaccactgtcatattttgatggaattactccttgctatgcaagcttaatatcctctagaacatgttcatcttaaaagaacccaacttacaggaaaggaagtatgatcagactgtttatgcattttctgtcttctcagtattcagaagttgctgaaaaggaaaacataacccaaatgctctggacttacagtcaagggaaaattaaacaaggctcagataaccaaaataattttaatttgtacaaagcatgcaagaggacaagcaaaacacagaccacaagaaaaatggtcattcatgttccagcagattacagaataaaacttttccacctgtctgtaattagagatggcatatggcccaaactctcactttgcaaaaatcatggaaaagatataaaccaatcatcctcaggaactaggaagagtgggtaaaggtagaagtaggatgctcactgtggctcatgatttaattgtttactcagcaggaagccaagccacacattaaccctcatcctctaactgcctgaacctctaagtactcttaaatgtattaaatttccctattttccttgctccttgtttactgatttatgacagctaaaatcgaggacccaaaaaagtcctctaaggatcaaaatgtttcacattttatactcttcaggctgctatccatcctgtttctatggcaaactgtgacttcagtagtcacagtaaaacataggcatctgttgttgtggtttctaaatttctgaagtttgaatttcccactaacaagttaggaaacgtttggtttcccaagcataccactttagccactgcctctgtgtaggcagccagactacaaggaggtgaaaaccagtgaacttatccattctggtacgtgactggcccctgctttggctttttattaaatgtggtgaactgaacaacaattaaggtaagaaagccacataaaaaaggaaagcctttaaaaaaaaaaacacaggcttaaaaaaagttttaactttttgctcagaataagttctggaaaaggatacatgctttctacaaaggagagaataaaggagagaataaaggaaagaaaagcagcccaacgaagagtagaggttaagagaaggaatcatattaaatcctccaaaatgcccacgtgcaatatctaagtgaaaataacctgtgacctgggaagagaaaaaagggactaatggaggttaaaaacaaaatttaacagctacattggaatgattttctaaagaaccattcctggattctttaatctgctaaaatacaaaaggatcattgaaatataaatggattgtgagcaataaaaaaacatataaatattcttaataagataaaatacatacacacatatttctaaggatatatatatatatatttattattatgcccttgaagtctgtcagagaaatggctgcctgttaaaaatattttccaagaactttaggttccttgaaatgttctatggaaatggtatttatgacaaacccaccacctctggggaacatgagatgttattactggcaaagtcacaattttttaaaccatccaaaaataattatgaatttatgccaaatgacgaaacttgctatattattataatgactaagagaatatttgctaatgtctcaagatcaaggctcaaagtagccatgaacctataggaaatactgtgacacaacactgaattgctagtggtggtgatttgggatctttgacaggcagaatattacagcacacaaattcactggagaggatggctcatgagatataatatatgagataggaagtgtggatgtatgtaatggggtgagaaacaggatttggagtaaaaactacactggcattctggctctgccaattactcaccaggacctgtggcaaattaacttttttgagcctcagttcttatttgtaaaataagaagacggtaatacctgcctcctatgactgtttgcaggactaacacggtacatggcatataaaaattgttcaactagctgttattcctagactatagagaggagggcctactatatgtctattgcttagttatacccatgctttcaaatatggtacctatttcaaaaatagaagaggtatttgttcaaatatttattgaataccaattaagtaccaggtactgttccctaccagaaatatagtattaaacaaaatagaccaatgattgactaatcattgaatgagatgcgtgtgtgcgcacatacacacacaccattacctgcatgtagtttacattctagtaggagagacagtaatcaataaatacataaaatatagtatgccagatggtactaatgaggtgagggggaatccagtggttcctggggagacagcgagcacaaaagcacaccatgccgtgttctgtttgaggaatagcaaagaagctggtgagtgggcagaggagcagagtgagcaaagaggagaacagtagaaggggtcagggagccaagtgggtggagcagaaagcatgggaatgaacaaatgaacaccaaaaacatggtatgggataagaggaaactcttctgaggtcaacattttttgtctggggtttccggcatgtagcctggttgttaggtagaaagaacacagacttcgcagccagtgaatttttattctggtctgttacctgtactgtttggaaaattatttaacctctgtaaattttagttttttggtttctcctccatctgcaaaatgagaataataatacttagctcatacagttgctataagtattaagtgagatctagtggcacagagtagaccttcaatatgcttgtttccttctctttataagccaagtctcacactctagtaccagttccagggccaccataatgatggccttgcatagtattaatctgcctgggcctcagtttttcaactaagaaaataaatgcatgtgctctacacagacattataaagatagatatacaacactcaagctgttgttataagtcaaataatcttactgttacaatctatcttaataatttcaaaacagcaaaagtatatgtcttccatacctcctacatattaattccattaaaaatagatcctacaaagtttaatttctttagcatgaagttgtaaagatgtatttagcaaccatgtttatttttattcccttttcctgctcctgcttaagaacactgatccaatggaaagatctccaagaaatgtttggctgcaaaaaacaagatgctgaggaacagtgtttgtaagctacttttgtgtaaaaaggggagagcataagaatctttatttatgtttgcttatgtactcataaagaaactctacaagtacataagagaaactagtatcagtggttacagttggggagatgaacgatgtggtaagaggaagactgttcctagtatacgttttaatacacacattttgaaatatgtgtcaaatatttaggaatactaatttaatctaaaaatccataattgaaatttaaagagttaaaagtacacaaaatagactgaaaaattaattatccaacaatatgaaaaccccaaatgacctatttctcagacaactagggtatctttcaatctgctgctttgtattttcttctgaagagtcaaaaaaattataaaatatccttaatagtctacttgacatttttgactatggaaaccaagcccaggaatagtatatacagtgtactaacccagtcaacccacccagactttgagtccccacgtacaggagtccccaaccccagggccgaagaccagtaccagtttgaggcctattaccgggtcacatagcaggaggtgagcagcgggatgaggcagcattactgcctgaactctgcctcctgttagatcagcagcagcattaggttctcataggagtgtgaaccctattgtgaactgtgcaggtgagggatctaggttgcatgctccttatgagaatctaatgcctgatgatccgagtgggacagtttcatcccaaaaccatccaccaccaccaccctctcccatgtccatggaaaaactgtctttgacaaaactggtccctggtgccaaaaaggttggggaccgctgcctaagtagaccaagtctatgagtatctaaacccagcagacaaagtacacattcacatccaaaaaatgaagagcaggagtaagatgagcagagcatcagtgaggctttgggaaggtcaactattagcatccattttgatatgctggcatttcattggatattggacattcacagcatcattctcttccaggaagggagaagagctgtggagtagatctgtgagcaaaagagaaatggaagacagtggctgatcccaaatacatttgagtagcagataattaagaagagttatacaggccagagacaacgaacacaaagaatctaacagtctacccaaaaattatgccctaaaacagtgacttctcaaccagactcaatttctctgcaatgtctggagacattcagtagttgtctggagacattcagtagttgtcacaactgagctggaggtactgtgttgctcctggcatttagtaggtagagatcagggatgctgctaaacaccctacagtgtacaggacagcccctacaacaaagaattaaccaaaatgtcaacaatgctaaggctgagaaactctgacctaaaatgacaatcattatgactaaccatgtgcatagctgaaaagatccatgaaaagccttaaaatagatcgcaataaacattatgtagtcatatctttcattccaatgtgatttgtgctattcttcccccagctgacccctactttaggtcagctcattgtgactgacgttgtctcactgtgttgtctcactgtcctacttttttttccaatatgccaagcaagtagcacttatttttatttgatttgattttttaaatgaaaattaaaactatatttagggcctataacatgatgtttttatatatctagatattgtggaatggctaaatcaagctaattagcgtatttgttaccttacatacttatcatttttttgtggtgagaacatctaaaacctactcttttagtactcaccatcctacttctaatgagaacggacatgtattgtgccaggcactatgataaggactttttgtatggattgttttttattaatcttcagaacaaccctattgtgagggaggctctaatattatccccattctacagatgaagaaaatgagacttgtagggaggttaaattgcttgctcaagtcacactagacagaagttggaaagccgggattcagctgcaaaaactgaactccagagtctgaatttctcgctctgcactgccctgccctgcctctcatagttttccactgtctcgttcctattggtgcttcggtactagagagtgtacatgctgtcagtcattccacctgccctctgccacctgcactgtttactgcaatctcttgctgggggtaatagggaacaggcagtagggaagacattatccctgtcttaaagaaggctaccttgggcaaacagacaagatacagaagaacgcagatcacagagagtacaaaatcaactgcagagagtgggaggaaggaatggagacaatgataaacaatgaaagcattaggaacctgaggacaagcccaggaggagcaccatcacaatgctaggtgtaaaggcagctctgtatgccatgaactaggaggcactttcaggaatacacacacatctgtgataatacaaggcatcacatgctgagtggctttttggatacttctccctagagggacagggcagccaggggaaggcatcatggctgtggaaggcccaggtaggctttggaggattaaggggacatctacctgaaactgttagtctgacaaagacctaaagtcttaatctgttggaagacaggtaattttttttgggagggcgggggtgtattaacaatcaaaatggaaagtatggaaaagaggaaactttgatttaagggatcttttctaaataatcaagaaccccaattcagagtggtggtgggagcagggggtgggggaggaaaacaaaaagaaaagtgagaaaaatgagtagactctctagcacagcagtgtattcacagtaattaactttttaaaagctccttcttgatagatgtcatctgagtaaacggcataaagaaaacttcatttgagtaggtatttttaataagaaaaattaaaagagtgataggagaggcacaatattcacggtattaaatgaacatccattgtccaaaggttcttactagaaagctccctaacaatacagtactgcagaagtcaaaacacattatttaggcagtaattatcctggtacaaatttacatgtgctgtacttgttgtcactcccctgtcagttccagtttcttcttccaggtctagcctgagcatcttttcaagtctccacctggccctttcatagcagcatggacagtgtcttttctagcccagaatcatgggcacctcctttgttctcaagatgaaaatattctccttgtagctgcctaactacccaagttctgtgcctgtggaccctcagactggccttttacttgttctggaacctcacctttcagagaccctttttctcagttactttgctcctttttctgctcttaaaagagtgagatttgcctcaattccagtccttgtgctcaatttgaggatttcagtaccgctttttagaatcctgattctctgctaaaagctaccaagctccttataattaatgggtcatttgactatttccatcttatttcacttctcctgacctctggggggcctagtaagattaatcgttcaggtgatgaagagtaatgactaacagtataccatttttaccatatattcctctgacaccaagctaaagcctccttcttaacttcctgccctaattcttatttcacaatgaaggaaaatagtattaacccaaattgctgggtctggacccatttatggtatctctaaaggatctcagtgatgatgacaggatcttcagtaacaaggacataaagcagacatagatgtacactcatattcaactagcagatgccaaaaaaagtgttactgttctactgatcttgctgactaagtcaaatgaattgtacattacattatggctatggtatgctgtagctgtaatttttagaaaacctttgacttgtgaaatacaaggaagcagcatacacagaataaaaaagacgggtcacagctatttttatgagtgctcttaaaatttagactaaacagtgaaaagtcccatagaaaaagcagggaggaaagcaaggaaacataaattataggcctgataccaaaatttatctcaaataaagaagctttccaataaattccatgtaattactctgcaaactgctagaaatccatggttatttaaccatgaacacagctactatcaacgcaacacagttaaaattatgtattagacaagaattgctaaaagataaaatgggatataatcataatcaggctatcaaagtctagctgtgagagcagatataaaaataaataaaggagtgtgatgtatgcagttttctgcttagtaatcaacatattaaatcaggaagaaaaagtaatgtattaaactagctctggaataatgagaacaaatacaggaatttaagcccatcaaaatgaagttacatacttaggactagggtgactgttacactgtttcaaacatcttaagaccaaacaagctttggtatcatcatactatttggttgttactgggagaatactgtaagtatgatcagactgatctgtgcaagaatacaggcaggttttggggaaaaaagaactgacaaatagcaagtacagtgccttgcacatagtagctgtcactgtatttgtctcatcaaggtctgaaatgaattaaatgtcagctgaactgcatagcactatggatggacccatttataaaaaccaggcaacttagtggtttccatactcttatttcaaattggagtttcaaacaaaacacaatgtcttatgaaaacagttttgtcatttaggacttttctgtggactgggagagaacatttgaaggcagagaatctcccatctatgtttgacggttagcaagtgactggctttattaatgatggaaacatcaaagcagtgactaagccagtgaattgggggacttcatcaggatgaagcaaaaggctgacagaagaagcacaaggtgacagcccaaaccagacgcttttccagagaaagacaaatttgccactgatgtttcaactgtctatcctctggagtaatggttcttaaagtgtggccccctttgagagtgaagaagatatcttcataataacacaacctttttctctctcattctctcagaagtgtatatggagttttccagaggctccatgacgtgtgatgatttctctgacagctaatggaatgtgtgaaacagatctgaggatacagctgtcttcaattaagccagacattagttgcagaaatgtaaaacaatgcaactcttctcactaaataattttgtaaaagtattttttcataaaaatatgttatttagcagatgatggatttattattatttattatttttaacaaatgattttttttaaattttatttttgagacagagtcttgctgtgtcgcccaggctggagtgcagtggtgtgatctcagctcattgcaacctctgcctcacgggttcaagcaattctcctgcctcagcctcccaagtagctgggaccacaggcacgtgccaccatgcccagctaattttttgtatttttagtggagacagggtttcaccatgttagccaggatggtctcgatctcctcacctcatgatccgcctgcctcagcctcccaaagtgctgggattataggtgtgagccactgcatctggcactaatgagtatttttaaaatcttagtttgaatttctaatacagtaaagagatagatacagcccatacactcaaaagctctttagggtcctcaaaattttttgagtgtaaaggggtcatgagacctaaaaggttacgaactactgctctggagcctttactgaattgtgctggaactatctcctttttctttcctaattagcctataaacactttgagaataggatcctctatcccctgttcatctcaggatagccttagtactaatgattgtctttgttgtttgtatattaaatgaataaaagtcttgccatattcataacatcagaaacattaaattcaagatttacatagtgaacatagtgaaaaataggtttccttaaagagacagatgagaagctaagctgactctgaagttattctctatttacaggctgatttctgaaactaatagaaacaatacagtaccattaatggcttgtggaattcgttttattgcttgatgatcaccctaagtttatttctatggaccaagcatctgaaaaactgcaaaacaatctgtgaaaacagaaacataattgatgttttagggtggtcagattatagatatttcctttccactgtcactgctgttgatacaatgttgcttatgtaataaacaaacatatttgtccagtagatctctggactctgaggaaaacataaaatagtcactcctttgttagcagagttgataaagccaaaggagactgatgggctaggatgtggacgtttaccacctaaccctgttctcctcaaacaagcaagcacatacagttctaatgcagggatctgaagaaaggagagaaggacctgttccaacagtgttgattctttctagaggctctgtagctatgaaatagagaaaataatgttcttggagaacactgatgggaaacccactcatacctcattttcttaaatgcctaaaaacatgtacatggtaaatattagagcatcctcttaaatagtgaataaaactacttaggacagtgctacagtatttttcacaaaagggagtatttgttcattctttcatttattcaaaaaaaattcatgtggttccctctacatataagtgctttgtggtagacactgtaggacacagaaatgaatcagacagtgatactcatcctgttctcaagaagtctgtattttagtagggttgactgtaatgtacaaaaaataagataaaatcaaaagcggtaagaattataatataagttattatgggtatgactggtattatagcatttagatataccatgtgtttcatatgtgtattatatgatgcattattactaatactcagtgtctcacagaggagataaaatataggcacacatctgtgctgacatatattatatgtgtctgcaaataaaaactgaaaaaaccctctgagtgtatcatttgtaatgaagaaccagaattatggttagtaccaaagaatactgaagatgacagatgtgatgtttttgaaaaaataaggaactggtattgtacataataatagtgataaaccacagtaagttataacaattctgagccatagtagaaactctaacggaaagctgtaataagatactgctttaagccagtttggatttaattacctcacttttgtgtccataaaaccagcttccacaacccatttttattggagcggattcactgaatgttcctataatgctgtggtgtcagtactagaacatgaatatgagtactccaagacaatagtctttaaactggggtacatgtacccctgagggtacataaagactttctatgggtacaggcatggagagatttaagggatcaacgtctacgtccactattcatacctatactctttgtgttctatgacttctccttttccaacaacactttcaaaacaaacttcttagcaaactcttatcaagtgcatcttcctgggttggaaacccctctggggcatcagacaaaggtacaactatagaaagccttaatcctgagagtcctatgaggacagagcagagcagagcagagcagagcagagcagagcagagcagcaagagcagcagcagcaacaggttcagaaccaaacaatggatggagcagtgccttgtttcttcagctgaggacaatgcagggcaagtcctcatgccttatcttttagaaatgagatgggtaccagagggatatgtatttacagatttcgttaggttgaaaaatgaagtcagacttttcctgaatgactggtttggctgtccgatttgttaatgaggacttttacattagatggcaaatgttaaaatatatccttttacaactatttaaacattgaatgaaagaatctagatgccagttaaaaatgtgaaaaggagtacttagtttttcaacattcttttggcagatataagaacaaacatttaaaaacccctgctctgagagatacacactttttaaaaagaatacaaatgcaatgttaagtaagattttttaagttgatagttctccattcagagtgttcttgataaaaatccttgtgtgtggaccagccctatgcaatggtttgtgttctttgcaatataatgtggggaaatcgcacaggctttgctccttcttgacctttgtgagcctcaattttcacagctataaaatggagataatcctaaaccctgtaaatttgtcatgagaattagaaccgacagatgtacagactcagctcactgcttggcaacacatcactggcactaagtaaagaatggcagctattatatatatattttagtctttgtgctgtgtgagaaaaaccacaaattggaactaaaatcatttaacgccctttttgcatgaaaatgtagctactgacccaccaactatggtatgcattttgagtcattttgttccccagaaatgtggacagattttagttaatttagccatattctctcacctggtatcttctttgaaaaaaatgggtggtcatgtaggtcaggaatacaggctgtggtactgcagactgggtataaatcaataatgaacaacaattggcagagttaatattcaaacagtatcccatttccaggaaacatctgacatgtaaatggtaaagccttgttacccacagtcagtctaagggccagcagacttgacatcatctgggagtttgttataaggcaaattgtgaggcccaccccagacctactgaattggagtctgcagtttaacaagattcctatgtgattcaaatgcactttacactgtgagaagcattggtaaagaataggccactagcagggaagataaaatcaccaggtgtacatgtaattcaggtgggagctctcagttgcacctgtttaattaaagctgagtaaagcaaaacgatggagtctaacttctactgacagactgacatacacacatgccacaaacatacacatgcatagatcagtagttctcaactggaggtgactgccccccaggagacatttggcaatgtctggaaacatttttaattcacaacaaagggatgctgctaaacatcttgtagtgcacaagatgatctccacaatgaacaaattatctggccccaaatatcaacagtgctgaagatggagaaaccctggcatagattatccctgtataaaggcacataaactggaactattaatggaaaaaggagtcataatttgactacacagctcttagggaatgaattttagatctgcagagttctgcacctcaaggtctatgctactttgaagatcataaaaacctggttaaaagcaatcaaaatcattgatctgctttggctagcaaaccgagagttcatgataacctgcattagcatataatgcaagtatcaatgctaaatcctgtacatatgcaaagaaaaataatggagacagaaaattaagttactgtgttgtctaaaatccattcctactcaaagtaggaagcaggcttaggaggctcaactccacaccctcctcaccctataccttcttcaagaccaaaaactagcctcaaacttcaaccttcaaatgctcctggatacaaggcaagaaataacgatttagggtggaccattcatcactatcagaagtgctaattccttcaaattcagtagcataaccagctgtctttccctctctctgacacacatgtacaaccacacaatgtgtaacagcattacacgcaagcaactggctctgaaaagattccatcagggcctcctgctctcagttctcactggttccttgtcctgagctcccaagttgatggctatgggtatagttttttctgcatataaattcttgtttaccttcccgacaggctttactagactagacagctgactgtcctatggtgcgctcatgagagtggcccaagaaaatagcaggttattggaaaacaagtagtaaggaaatgcttagagaaaatgcattcaaataatcagacagaacttggggaacagatggggatgccaactaatttacaaaaaccatgaaaaagatgcttatgtttgcatcatgctgaaaaatacgcaacatgccccaggctgaaaaatatgcatcatgcctactccaaaaacactgaacaaaatggaagcaactgaatttttttctaaaccttttttgcaggttactgcactgcactcactaatcaccattcccttttaatactcttttaattatactgcaaaacaatcttccctcccttatatcctaagaaaacacacccccttctcataaaaatgacatagcacatgctataatttaataagttgaaaataaatatttaaaagcttttgtgaaactgttctctaataaaactgtaagaactgtggtgtagagaggggaaaaatatttcactgtaattatgctcaaggcattgtcaaaaccattacatcgaatgaattctaatgctaaggcaggagaaagaagcactttgccaaagttttttttaactatttcaccaccaaagcagtttacccatggactctgccactgggttgagaagtcccatgaccatttgagaagaagctgctatgcttatcttttcaggctctcatgtgtctcagatagggatggggcatggccagaaaccatgggcaagccttttgccaagaccttggatgagatcatcatcaacgacaccccagcatcctgcctagcatcttctgaattttataagccacagcccttgggccagcctcctgttaagttctcaaaacagaaaaaactaaaagtggactcccacaaaaaagatgcagaattcttatacaattattttcaacatgttcctcctatggaatgtaattacagaaaattacagaaaagagcagattagaatctcaaaaagaaggactcaatttccaagacgatgaccctaaattagtttccttttaaaatgttctctcagccggcacggtggctcacacctgttatctcagcactttgggaggccgaggcaggtggatcacaaggtcaggagatcgagaccatcctggccaacatggtgaaaccctgtctctactaaaaatacaaaaattagctgggcgtggtggtgcgtgcctataatcccagctactcgggaggctgagacaggagaattgcttgaaccagggagtcagaggttgcagtgagtcgagatcgccccactgcactccagcctggcgacagagtgagactcaatttcaaaaaataaaataaaataaaataaataaaaagttctctcaaatccttacacaactttcaaaaagtaagttctgtgataaggatgatagacatgcatttgataattaactcattcctaatagaaaagatacattaaagttttatgaattctctatacctatcagaatgtaagtagtcataacttcatccatgacaagtcctttggttcaattccttagggattccattctattttagcttctgtataacagtactgcaaagctgtaattacatcctctataatcagcccattcgcagtataattgagagtgccacaaatttaaaactttgacctcactacttaagtggaagagatagtttatactacatgtaaaataccctcctgttatgctgacaaatttaaaacataaaagaagaaaatagcatgtcatagtagtcatcatttaagagggaattattatgttcctgataacagagtttctcttctgtcatgtctagcatcagactctcatcaataagcactttcctaccaaaccgcatgctcttctcaaatgttatgaaaacaccaaacccatacagatgtctctcaattctcctcatttaattgctatccactatgaggataagatatatgtgaagtagttcctagaataatgttgtgctagtgcaaaccaagttttaattggcacagaggtctatcagtgaagtgcataacttctaagcaatgtgactaaattttttcttaactaagaatcaaggacttgaacatcaaacattaattgaacactttggttcaagcaagccatttgataaatataataaccatattaataaagacagcagcaacaactaataccaaatgcttaccatgtgccaggacaatgagaatcttagatgaattaccgcatttaattttcataaaaagcccctgaagtaaataaaattattgcccccatttttcatatgaggaaattgaggctcagagatgttaaataactgcccagatcaattagttggtaagagtagggtcggccttgaagccaggtctaactgcatcatctcaagcttgtggctattttcacagccttcaggccagactgcctactaattacatgttacccaagcaatttaaactaaatattcttgcccttactcttttactaaggctcctggtgaaatgcagctgttactgatcaatggtagtcaaataaaaaagcaagataactttatcaagattttcctctgtcatcaaattcaggaactcttttgcatattgtatatgaactgacacagctcatataattacataatttctaaattacatatatatttaagtacattcgatgagttactaaagcatcaatcacaaaataaaatgcactttacatttttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttatttttaccattgcttgctgaattttcttttggtcattctgtgttatatttctgcatgtacaatagaattttgtcttttgcttatagtctctattaattcttccttaaaaacaaacaggacctatgtcccatttatggtcaacttctaatcacatattagaggagagaaaagtggttcaaataaataaaaattacatctctttgatttcaaagtgaactataagatctttcagaagcaaacataacttcatgcttgggatatatttcagtatctctaagagcccagcacagtgcttagactacattaggaacttaaatgtttataataatgaaataaaatactaccgaataattttggttttcatgagcacatagaagcagatgataaaattaaaaagctctgacatgtgataggaagccagagaaagtacatttggaaatatagttacattgacaaatcaagagttgactgtatttctaccagagatcaaacctcccatagaacatgtatgtctacaaccaaatctggaaccagccactgtgacataaactcttgaacactctacttcaaagcaaaaaaaaaaaaagaaaatgtcattcttgtttctttttcctatggggttcccaaaacagtttgaattacttaatgtaggtgctacctaccctgttcataaggggcctgcattcaaaagcttacagtttttttttttgttttaacctcttacagttttttttaaacaagcaaataaaagccaaagatagttatgaacataagctatagaaaaggcatatttaaaaaatacagtatgttagttgaaagaagtaatatagtgtgaatttcttctgtgattattatgccatttacaatatagatgagaataactcagccgaatcctcctagaaattctgatatctgcctcatgggagtccctggggataatccatacttctgagcagagaacaacagctttcagggaacatttaaattacaagtatggtccccaagtcacattccaaaacgacgatttcagacaaagtagcttattgccatttccctttttctaacctcataattgttaatttagtgtggttaattttattgccagttattgattttaaatacaattcatttagacatccaggcaaactgtgaagatctttaagaataaaaggaagctttcacaattatcctcctttcccctacaaaatcaatttcatgatagtaaagcgaggatttgttgacagaaacacttccatggtgacgaactgcaacaccaacgctatgggcttgcatcatcattaaataaatttggatgaaagctgaggctgctgatgaatgagaaagcttctgtttaaacacatttatcttaggaatcaacagtgacccaactgtattacaaaatacatgatggtctaaatgtttattaaaactgtttttaagtcaccttgggccagaactctagaaggaatggcaaacttaattttagctctttcaaaacagacaatgataatgctgctgcttcatgagatctttttctagttactgagagtgggtacatgtaatattttggaaggcatcgatcaactgatcataaaattatgaacaatggaaatcagaatttaagaacaaagtcttcccaactttgtcacataatggcataaacaaaacacatgcttgtgtggcactgggggaaacagataaagaggcagagataaccagccaagggattcccatcaccccaggttcctcttggctgtcccaagtgctggtgggggacggggggagggaagaaatccattcttggcacacttgtaactaatagagtttgggagccaaatttgggctattcatcagcccacccattttgaaaggattcaatttcttatgtgagctacagaaattctctataataaagttaacaccataagtcttgtgttctattatgataatgcacaaattctcatttaatcatttgttccagattttaactatatagaggcttcctaagtagttaatctaacataactggaaatttaccaaactttcaaggaatacctcttttagaagtacctctactgggaggattccttcagtataataatttgtatcagcatcaaaataaattttaggagacagattaataacgtgtagattattacaagtgttactaattaaagttcataaaggcagcataatttctgcaaaacatctttttttctatagaattacacctaaaatgacacaatgtagatttctggcctttaattttgaaaagatttcttatatttttttgtgtgcgtgtgagagaggagagagagaaagagattggaagattacagaacttcctttttcattgacagataatcatagaactcccccaaaaaccaggaaggaaagaggaagtgacactggaaaatcttcagaaatcttcatatgaaatatgtgggggtggagggttgtattctttggtccatgagggctcacagaagatagactgttttttcgtctctctgaaaaactcataccattctttcattggtctaagtcctcgcttcagaacgaagtttcattttactcacattcccactatctctttaactctttaaaaggtagaatcctatcacagattcgaatgattttatcatgttttttctatttaaaagcaatggcaaaactttccccaggaggatgccactgctctctaggggcactgacaaaaataaaattgtcatccttactagaaggacattgtgcattactacacttgaatctgtacacataagaaagaatcttgatacttgttcaatcaagatcatgataaaattacatacactctttgtaaggtctccacaactatattttacaatgctaagacattaggcttggggtcttcatgacaccagttttattagtccatttttatactgctataaagaatacctgagactgggtaatttatcaagaagaaaggttttattgactcaccattcctcatggctgggggaggcctcaggaaacttacaatcatggcaggaggcaaagaaaagctaaggcacatctcacctggcagcaagagagcgagagagtgcacaggggaaactgccacttttaaaccatcaggtctcatgagaactccctcagtatcacaagaacagcaggggaaaccaccccacgatccaaacggggatttcagttaggagatttgggtgaggacacagagctaaaccacatacataacccataaaggataaaattaggggagctgtgagatggtcatagaagggatattttatcaaaaattttagagatttgtagtctaaggattctatggtctttactggttgaagtaaaactcccaataaaaacgttttagtagcttctttgattctgaatatttacaaagtgagtctcctttgaaatatgttagacaaaggcagggaaagacctttaaattaaccaacactctagctttttcctataccctggtttctgttattaagatttttttcctccaaataatcattttgctttgtaatcccaagagaaaagataggcaaaaatgcatgccccaaaactcttatagatcagcgtatctcagagtaaaatccaagatacctgtgtgagaatcccctgatattaagttccactcagagctatccaatgagaacctctgggggcgtagggcccagaaagctgcattttaacaaactcttctgctggttaattgtgccctaaaacggtacttcaaattttgatctttttctgggctagcaatatgctgtaagatactctctcccagtgctgggtagtggcagtgagccacagctcccagtcagccacacaatcatgagggtaaacaaccgatactgtacagcagcagttcccaatttggcacaagggactgttttcatggaagacaatttttccatgggcggggggttggggggatggtttcaggatgaaactgtccactcagatcattaggcattagctagagtctcataaagagtgctcagcctagacccctcgcatgtgcagttcacaatagggttcgtgctcctatgagaatctaatgccactgctgatctgacaggaggcagagctcaggcagtaatgctcgcttgcctgccactcaccttctgcttgccgctcggctcctaacaagccatggactgctaccagtccgtggcccagggtttagaggcccctgctctacagtgtgctgtgttgctagacaattttgcccaattgtagatttatgtaagtgttctctgagcatgtttaaggtgggctaggcaaagccatgatattcagtaggttaggtgtattaaacatattttcaacttttaatattttcaactcacagtgggtttatgtggttctaaccccatcataagtcaaaaagcatctgtattgacaagcactggcaaatgtattctgaccatagtccctctctttaaattacatctgtagtaggaaatgtggctattctaccctctagtggctggcatgacaaacagaaggtttattctccaagttttctttttatttaaaaggaaagctcaataaaaacttccattttattgggtgggaagattcccggttttataactgtagcaaagcatagatgcctaaatctttggctgagctaaagtaggctgtctgacacctacaaggtctgtttctctctcaatcccaggccctcaacttaaatctgtagcatttcttgggaagggtccagaacacacattaaataaggcagttagatgaaccaaaacaaaggactccattcaacttatggcacagtgaagcaaatacaagaaagagcaaggaagacaagtagtttactaaggttctcaaaccttaaaccccatttaaattcattttacttaaacttcaagccctttcctttccagcagatggaccctttccattcctcaaggtacatcaagaagggtaaggcttttgggcagtcaatatatcagagcagccatcccccaaaggcaatgctgtagggtaaggaatcttgagggagtctagcgagttaactggccaacacctctaagtacttcataatttgataatgaattaacaccatttacatgggagcacttacaaatctgtcaacattccatcaggtaccaggttttacagttagaatgccaccataaaaatgtattcaggaataacctttggcattgcagtcagccattccagggataatcacttttatttgtggcatcatttaaaatttcattgtcaaaattgttgatcaagagaaataaaacttatcttattatttgaggcaatattttgaaaaactgaaactagttttcttattttagtgagttcttcttcctcctcatagccaaatggtcctggtatgatatttgaggggttacctgagaccatcttttttttttttttttggcctgttttaatttatttatttcaataggtttttggggaacaagtggtgtttggttacatgaataagttctttagtgctgacttctgagattctggtgcaaccatcactcgagcagtgtacactgtacccaatgtgtagtcttttatcccttacacccctcccactctttcccctgagtccccagagtgcactgtatcattcttatgcctctgtgtcctcatagcttagctcctccttatgagtgagaacatacaatgtttggttttccattcctgagttacttcacttagaacaatagtctccaattccatccaggttgctacgaatgccattatttcattccttttcatggccgagtagtattccatggtgtatatataccacattttctttatccgctcattgactgatggacatttgagctggttccatatttttgcaattgcgaattgtgctgccataaacacacttatatgcaagtatctttttcatataatgacttcttttcctctgggcagatacccaggagtgggactgctggatcaaatgatagatctacttttagttctttaaggaatctccacactgttttccatgctcgtactagtttacattctcaccaacagtgtaaaagtgttcccctttcaccacatccacaccaacatctattattttttaatttttttgattatggccattcttgcaggagtaaggtggtattgcactgtggttttgatttgcatttccctgataattagtgatgttgagcatttttttatatgtgtgtttgccatttgtatatcttcttttgagaattgtctattcatgtccttagcccatttttatgatgggattgcgcctgttttgttcagctctttaaaggctagccatatttggacaactacaatatacaaatataagccctacagacctacaaagcctacctcgtcctcagccattcctgaggcttttggataggtggaggtgaggttactaatgaatattcatgcctgtggtggttacaagctaatacagagggaattgagacttccgagagaggaccttttagaaaggtctaaacaatagagggagttatctgctgttccggcaaaaggcaaaggtggttggttatctacattatttttctgccacaggcatagtagaaatggaaagctccagtttatctgaaaactctagtttataatttgatatatttgaaagaaacaaaggtacaatgtattaacacaaatataattgttcaaatgtacatatactctgggccaatctgtcaatcaagtgagtggaaacgatccttatgcaaccaaacttgtgtctcagtgacatgcgcagtgtcttagtatgcaatatgttttcttcaaagcatcacatgtacacaatcgatcaatccactgatcatgacacattaaactgtgtacctcttacttgccactggggcagatattatggagatgaaagattcactgcccttgaagagcttattaacctgggcaaagaaatgaaacaagagtatcagacaacatttaatcaagtgggaaactgtcaatctctaccaataaactggagattaaggaagaccacagtagattaacaaagcctcagttaagtgaaaagattgggggaaggagcactggaggcaggcaaatagatcaggttctagtttatgccttttctagtcagctgtgaggccctggacaagtcatttaacctttgtgaaataagcgaattgaacttggtgatctttaagatcacatctggttctaacttccaatgacttctgaatttgaagtcttgccaccctccttaaatcatttaaaattccttttgggaaataaagttggagcataaataagccaacaacctgcatgagtttctttcctccagaaattaaacttcttcctcatttttccacttacagatgtcaaaactactagatgtttccttctctaagattctatgaattggctgggcatggtagctcatgcctgtaatcccagcactttgggaggccaaagcgggcagatcatgaggtcaggagttcaagaccagcctggccaacatggtgaaatcccatctctactaaaaatacaaaaattagccgggcatggtggtgggcacctgtaatcccagctacttgggaggctgaggcaggagaatcgcttcaacccgggaggcagaggttgcagtgatctgagatcacgccactgcactccagcctgggcgacagagcaaggctgtctcaaaaaaaaaaaaaaaaaaaaaagattctacgaattaatttcttttacccctaatcctatcagctttttctccccattattctttcaactttaggactattaatggttttggcctggtaactctttgttgtggggaagaaagaggtgttcatgcactgtataatgtttaggagcatccctggcttctacttacacaccatgtagcatcccccaactgtgacaataatatctccagacatggctaaatattccctgaagggcaaaatcgccctctggttaaaaatcaccacattaaagagatggaccaagtgactctataagagttccactcttatataacactgtgggaaaaatctgacaactcatatgaaaactcttatgtctggtgtctagagatgagaaccttgaatctgatgaaacataagcctcaaagcaactttaaaaacctatactgaagagttttgttgcataattgtttccacttacttgacagactggctgagagcatgttcatacttgaacatctatatttgtattattacagtattttatacttctgtctctttcaaagatacctgaattctaaactagaattttcaggtcaactagagctttccatttttcatgtgcccttgggagaaataagagtctagaaaccaaccaccttggctttaaatggagtcgggggagaagggaattggttttcagcaggaatcccaagaattgaagagataactctctactgtttagacctttctaaaaggtcctctctgagaagctgcaattccctgtgtattattagcttataaccaccacaggcatgaatgtcttctattaggatacaggcttccttcattcctcaaccaatcacctacaagaatgaaccaacaaatatttatgaagcatgcaatattgctcattattgtgccaggcagctatgcagatgttaaagtttggaataaaaggtgggagttaaggggtagcttaaaaggtaactaagagctcaacacagagaaggaactatatagacagtaagtactacaggattttagaggaagagcaggttactttcaggtgggatttggggatcaggcttcagaaacagatgagaattgagcaggggatacaggatggggaagactaggatatagagaaaaaagaaaggtgctccaaagaggtgcccacaaggtaaaggtgtgggggcaggcaggagggcagataatcaacattcaaggaacagtgagcagtgcaatgtggatgaagttgagatggttggggcagggtaaggcttaaagggcaaagacctgttgattgtgaagaaccatgaatacagcactagggagtctctgtgtcttcacagaaggtttctgcatagtgaggtaacataaaagagagggcaaaaaacaaatccattatacaatattattttattttacaacaaccctagaaagtgggtattatgacaactttagggataagtagattaaaactctgacatataaggaaagctgttccaggtcattctgttagtatgtcacaaaactgaggagtgaaaacaggtctgattctgttgccccattctctttccgtggcaacacactgagttgcaaggggttttaaattcattataagttgaatttgatcctttccacaatctgtggtgacagacagattgtctaatgttacctccttgtgctccacctcacagatctgccacttcagccagaacactcagaatgtccctaaacatatgcagggctttctcctccccacttctctacatggacacaattttcatctcttgtcaagtgaagtaagacccacactgaagggtctgtatcaatgctcgcctcttctgaaacctcccatgatcaccatagccaagagtgatttgcctctccttccaactccacctgcttccctgaagccactgttagggtgacaagagataatgaatgtgagaagccaagccccacacaaatgggcaggcacggggaagactgacctgggataggagatgtgagaaagcaagtccaaagagaagctcatgttctcattaggagactgttctcagaacacaaaaggtgcagtcagtgtccactttatcctaaggtaagattctataagcaaagggcacaaatgccaagcatgaagaatgagcttggacaggcaatcaatatgtgcagagcaggaggtacctgattagcctcagagatgatgggatagaaaagcatcagaagtgagtgaaaatgattcacggaaggaacatcacaaccatgcacatctgagcttataagtaggtggctgccttgacagttatgataatgacccaagactttcagaaaaggcaatcaagggatcaaggtccagccactataaagacaagcaccaccaacttaggccacatttggtgtgattctgcctttgcagaaacagaaaattttcccagatggtacactctaaatctggatttctatttctcaaggaacactgtaacttaataagactggcactcccaaaatcattttttagaaataatcactatgtatcttcccaggtcagaaggagaagtgttggggttcaaccctgtcagtctccaaattcaggagtacaaaactgtaaaccaaggaagcatcccaagtaaaaactgccactgcaaaggaaagttgtcaagttggctcctatgtctcccctcacaatacaataatctgcatcaacacagacactcttcaaacaactcaaagtaattcctcaaaaatgcattattatcctttacaattagtggtttggctgttttttttttttctctcttctctttaactagaaaaagctattcttcttctattcttatgccttttcatggtgttcttgcctgaattcactgtgcctgagatcagtcacttttgaagcctcagaaaaccactgttttatataaacaggagctaactaaaaactgcaagaggtcctcaaaagttccataacacaagaggcagatagttattcctttagggcaacagggagggaatcagtgagtacggatcatgctgagaagaacagctctcatagtaatttatataagcagcccatttatttcatatgaaatttcctgattataagagtatgtattaattacagaaactgaaaaatataaatgcttctgaggctgctgattatagcttctaaggacaatgagaagactagggagaacaatggacgattattactatttttttaggccaaacctatcaaatatggtcctattccaggtttttctcagactgccaataaggaaggaaatacgctttagggaggctatcctgtccttactgcatggctctgtgccacaaagtggcaaacctttctgcgagtacaagtttatgtaatttgtctgattggttcagacacaatggctgaggggccagccaggttactggaagagaggtgcaggatttcctttcccctagcaagccaatcactccctggatagtggttcaatcactatgtactgttcaagtaatgggaataaatgcctccttaggtggctgttctcagaactagttatattcttatcattaagatagagtggccttgtgcagaggatgtgggcacatggtagggtcccacaaaattcatctcaggctctgggaaagggatgtagaagtacctatggtgggagaagaaaagagcggcagttgagtgggaattacatttttctctctggctgtctcaggcacttgagtagtatcaacaatttctctaccacgatcctcaaagcaacatctccaaaatttcaactctaccaaacagttccacatggaaggcccaactatacacttcaaacttagcatgcgcccataacccaatatactatctttcttgaactgctctttgtctcgcctctattgatggtccatcaccttccccactgctcaggttcaacatctgggaactattctccacttctctgctcatcctccactctgtcatattatttctttctctgtcctccccacttatttgtactactactccccaagcccagaatttaggacagatggtactgtaagatagttaatctactacacttaaatcctcacctctataatccagccttaaataccattctgatcacagcaattctccagcctcccagaaaacagcacttaaaattgcttagtgcccaaagtccaaaccttctaccatggccttcatctttcgtttcatctccctttgaaactctggacataccctcacatcttcaccaggacaccatactaactatcctcccacatactactgggccttcttacctttgatcatgctgtttgtagggctgaaatactcttcttcctttgttcctcatactaaaatcctactcatccctcatgtgtcacttcctctggaaaaccttccttactttttagttttccactgagtttccaaaactgctgtctgtaattctattattgcacgtcattctacctcataattatttgttacccctcctatgctatcatctcaaaagcaagaatcagctatcatttatttttgaactccttatatcaatgtttcttaaaatgcagtcattgaccaccttcatcagaatcacatatgactttgcagagtttcacattcccagacctattaattcccactgcagggattctgcatcctaacaggctctctgggcatataaaatttaagaaccatggtcctattctacccaggacttaaatagtgctcatagtaggtgctcaacaaaagctcatatggctaataaaggcacctggtagccatagctggcctgcatttgtccttttcacagaatcacagaatgtcaaagccaaaggactttacaggtgatctaaaagaactactgcatttttcaaacaaaagacatgaaaacaggaaagaacagataatgtctctgggtgaactctaaaaaagaaagattcacaaggaccagacaaagtagcataaggaggataaaggacatgtgagtgggccttttctgggtcaaaggtgattagaagtatagcccaggaatcagtgctgcttattcagctgccttaactcccacccttagcaacatattgcctataaataattggagagagaggaaagttgagagataaagcaggaaaacaagaaaggtaaaacaatcaaagaagttaggattatgaccaagaaataggcatcttaagaagtgatataaggaaaaagacaaagatgatgctgatgatgatcacaacaggaacacctaacacccgaaactttagatgggccagggactttattacacaatatctctactccccaaagaaaacttacaagtaggtatttcaatccccagatgaagattacaaaagaggaaactgaggtttacatgggtaaagtgtttgctcaaagagacacagctagttagtgccaaaactagaatgaagacccaagactggctccacggcttgtgctctagatactacccaaaggctgttataagatgtaagcctgagaatgactaaaacaattaagtgggtgcaaatgaagaaatgagaaagacacaggagaggggagggaggaaagggtacaaaaaaagaaaagctgagtaaaaggaaaaaagttcacagatggataaaaagagaacaaatgaggaagacaagtatttaaggttagtatattttattttaacaaagtattgctacatctgatgcttggtctgacacaaagtgggggcaactgggtttggagcgattttgaaaactttatttcaatgtttattcttggattgcccccactgctgactgtataatttccacagaaagagagattgagaggtgactaggtacaaccacaaaccatgatacattacagaataaaggcacctatttactctaacctttgcatcagatattggacaactctttaatataagccatagaagtagaacactattcaaaaccaaatgatctctcataggaggttaatgagaatgagctaataaaatcaaacagctttcctttgaaagaccctttcctgtataaagcgtaaaacttgtagtgataaagtttcattgtttaataggggagctctgagaaaaatcaagagaaaaaagccaaagcatcattatgaaattttgggctagctgccagattcattatctcttatttccattccaccactccccataaattagcagtgatttgtcaaacaatataaaagacaaaagaaaagaaggcaataatatttcaaatatatttttcttcagtttagcatttccttcttttcatcaccatatccatcatcattgcttatatactttcccattaaacactgagataaaaacaaaactacaaaaacactgtcaattctgataacacatggccttggccaagcattccacagctaagtccccaagggagtgagcagccctgaatccaaccaccgtcccacaccacctcaattaccacatatcaaaatgaccagaggtctctgggagtcttcaacttctcaacctctagagctaaggtgtgatgcagtccctggagtcaggaccgctcctgagaaaacactgctttcttacacaacacgttgtcaatacagatcaaaaagttcaaagcacttacaaaattaatttcctttagagaaaaggaaacatcctgactccagctgtctgagatctgatagtttctccataaatgctgattttgttctggtatatttgtgctccatgataaagtggaagaacaaaagagtcatgtagaaattgggctatagaactgagactttgaatacaactgaaaacacttcacctttccatacttcttttgctcattatgactcaatgccttctaataactcactgtaaccagggagtcttctagattgctaggtttcttttgagaatctatggataaaacaaaccaacacttttagaatttaatatattccacaaatttactcctcttctttctactgctccctaggtggaaccacttcttctgcctcattgaactcaacatccttcagacttttaaggcattccaaatcccagtcttcatgttgaactgggttaagcatttattaaaaaatcgttttcttcta

SEQ ID NO: 36548 - DNA, 155116 bp, Homo sapiens
ccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccaggtaagggggacgcggcgctcgctgcggctccgctcccctctcgtctcctcacacccggccctgtgccccgtcctggcatcccttggccccttgtcgccttctgctcggtgcctcccggttgtccaaccccgcccccgagcgcggagccccgggtctggcccgtccggcccctgctcccacgccccttcccccatcgccggcatttcccgggctcggcttcgccccggccgccggggcctctcccctctgccctttctctcccttctcgcagccctgggaccacgtcctagccccgcagtcccctgggatgagaccctcgtctcgccgggatcggacatttgcccccacgtctaccccggctgcgcttcttgagctcatcgccccatcatcctacccgttgtacgtagtcctgtctgcatggcagtcgcccgccccgctccaggtgtccctgggtcttgcccttttgctcctaagcaccttcctttcccaactcgcctcttctcccctcactttgaccacccaccatcgcaatctcctcttccttctcttactcttaaacctccagacactttcccactctctgcaatgccggattcatcgctttttttttttttttttttgagagatggagtctctatgttgcccaggctggcttcgaactcctgacctcaagctatccttctgcctcggcctccaaagtgctgggattacaggcgtgagccactgcgcctggctcagatccatagtgtaatatcttcattcgtccttacatgagctgcaccccataacatgtaaagtcccttgcccagagtctagcacacagtaggcctggcacatggtgggtggtcacgcatgttagcctcttcctccttccaggcgttttgtactttccagatgatggtagcaagaagtccagtgtccacagggatttgactctgcctgaagaatggtatgggagatggcaggagaaattggtgaactccagtaaagcgattaaatggtcaattactgcattcattaagaagaaacaattctgctatccgtgccatgtattgttttatgttaattgcctttgtaaaggattcttaggctgctagtcagcaggctttgcggtgtaattactccccatcccctctccatccccatctgcagtgtttgggtaactttctttttaggaaagaaagagcccctacctcccagctaaagtggcatagtatataagcaatgtggtacgtgtttatctattagctggatagtccagggagctgcaatgaattttcatcttttaagatccaggaggaatcaggatttggatttcctggaatcagctgctgtacagaccaaatatgcttaagaatgaaacttctgacaagtcctctaagagtgagagaggaattatccacccctctccctccccctctccaaacactcgctcttggaggaaatagcgagtcgatttttaaaaaagagtaaaatacgtttgactttttaaaatgataaaagcattgtcattggccctgtactattcttgccacctttgctctgatggtctcaagcctggacgaatcagtcagctttttctgctcctgggctcccaaggcagactggcaaaaatcatataactaaactgctgggtgctgtttctgcacttctggatcctggagatcctttgacttaacctctagattcctcttatgtcctaaaatctaaatggctgtttatggatctttaccatttttctctgactctttgtcctactcttgccttctcttcattgcttattttgccacttaacttcacagaataaattggtgggcatcagccctgaactcttaaggagaggtcatttttgtctgtgcctgtctgtacctgatttctaatatcctttcctctgatctcagaagaagaggggtcttactttcgaaagctaacgtctttgatctcttcccatattattattttttctgttggatggtatacatcctcaggtttccaccattcagaccaaaacaaagcttttcttgatgcttcccttttctttttttattcttctcagattaacgtggcattccttagggtttcatttttgttcttttctctaatttccttgtgtgattacacttcctttcatggcttcaaatagcacctatatatttatggttttcaaagacgtctatttagtccccgtttctcttgaacctcaggttctaattttcatctgcctactgcatagctgtatgtggatgcttgattacttcaaatgtggttaccttttccttccctttctctccacccatagccccctttaagcacatatacaaacattactattttaagatctttactctagaaaccttaaaatcatcttcttttctcctcacattaagtctagcatagatcctattgttgttgctacctcagatctttttttttcctctcttcataacatcttttttttttctctctcttcattgccagaagactggttcagaccttggttatgctttttctgaacctctgggtcctgtagtctacttaatcctccacgttgctgctggaattggttccatttctgaactatcaatctgatcatgctgcttgttttctttaaaaattctcatcagctcccaaacccttagcatgttgagccagtccttccaagccttctgtagcatgggcgcatccccttcctgggccctttgtgatccagagaaaaaagcagtaaagaaacagaccattcactaccgtaaaatcaagactgtgacagagatgactacagggtgctctgggagcatcaccctggtgagagtgaggacaagtttctgtctacaggcacctaggactttttctgactacccctcctccttagtttgggttaggtgacttttctttgtgtttccacagcaccctgtacatacttccatctccatttttaccacttataccatttttagttttttttttgtgacacagtcttggtctgttgcccaggctggagtgcagtggtaacatcttagttcgctgcaacctctgcctccagggtttgagtgattctcgtacctcagccttccgagtagctgggattacaggcgcctgccaccacacccagctaatttttgtatttttagtagagacagggtttcatcatgttggacaggctggtctcaaactcctgacctcaagcagtctgcctgcctcagcctcccaaagtgctgggattacaggcgtgagccactgtgcccagcccatttttactatttataatgttctgttttcttatttttctcactgacttgagagtgaaccctttaagagaaagagttgtgtcatatctcattgtatctccagtttctagcaaattgccaagtacatagtgctcagtaaactaagttttcagaagagctgaatctagacaaggaaaggtaaggggagatgggcagtttggaagagaaggtaacatatggaaaagtgtgtcttaggctaggcgcggtggctcacgcctgtaatcccagcattttgggagactgaggcagacggatcaagaccatcaagaccagcccggccacatggtgaaaccccatctctactaaaaatacaaaaattagccgggcgtggtggtgggcgcctgtaatcccagctactcaggaggctgaggcaggagaatcgcttgaacctgggaggcagaggttacagtgagctgactccagcctgggcagcagagtgagactccatctcaaaattaaagaaaaaagaaaaatgtgtgataacctggtgcttttgggaaagaactggtaatttggaaaggctggagaatgggcataatgagcaatgaggctgggaaggtatatgggagccgctcatgaatgaccttgtgtgtcctaacacataatcctgatgatagcgaggaacctttgaaggatttcttcctgggcagatcttacaaagtctggcttgttcccatctcaggctttgtgtcttgctgcatgccttgccttttgcctcagccatataaaatcacctctattacctgaacatgcctaaatggctttatgtttctctttctccgtggaatgcgttttcccacttagccacctgtagattatacaggcttctggttatctctgcagtaaagcattcccacatctgcctgcaatccatgtctcttcatctctactgtcatttacttgtttacatgtctttctctactctaagggtagggctttgaaatcaggatgggttttgattcatgtctgcatcccctactctggcaggtaacatgaatgagtattgtgaccaggtatattttgattatgtttatttatttttctagagatgggagtcttgctatgttgcccagattggtcttgaactcctggcttcaggtaaccctctgccttgacttcccaaagtgttgggattatgggtgtgagtcactgcgcctggccccaggtgtattttcagaaaaattactctgatctctggtagcattgtagagaacaggttagagaggggcaagactaggtgcacaaagaccaataggtggtcattataggaatgtaggtgaaagataatgaggccagtgaggctaaggggttagatttgggagtgaatttgtggagtaaggagaactggttaggtgtataggtgagagagagggagaaggaagggtcaaggatgacatactgagttcaggcttgggtgtctgggtaatggtggttctgttcatccaggtaggaaatacaggaaaataaacaaattttgagggaaaaggaggaagccaatgataacatcttgatgcccaggaaatcgcctgagagagcagttggccctaaagatggagatatatatggagggtctgtgctagaattgaaagtgaagtcatcagaagtaggtgagattgcctggttcagtgattttcaacataggcactacttaaaaaccacctggggagcttttaaagaatgaggatgggggatcgaggcatccacagggattctgtatcatttggtctggtgcagggccagaccttgttactttaaagatgcttcccatgagatggtgataggtatctaggactgagaactgggctgagagcccaaagagggagtgatagaaccctgaagaacaatagtagtaactcatcctttaaatatcaggacagctgggtgtggtggctcacacctgtaatcccagagtttgggcagattgaggtgggaggattgcttgagaccaggagtttgagatcagcctgggcaacatagcaagatccctgtctctacaaaataggaaaaaactagccaggcacatgtgatggcacatgcctgtagttccagccatgtagaaggctgaggcaggaggattgcttgagcccaggagtttgaggctgcagtgagctatgatcatgccattgctctccagcctgagtgacagagtgagaccgtctgtctgtctgccacacacacgcgcgcgcacacacacacacacaccaggataaatattgcctttgttgacatagtttcttgctttcctggtactgtgtacatttacctattaaaggagttatcacattttatttaaattatatctgctgggtccatttttatttttattttatttttattttttttttgagatggagtttcgctcttgttgcccaggctggagtgcaatggcgcgatcttggctcaccgcaacctccgcctcccaggttgaagcaattctcctgcctcagcctcctgagtagctgagattgcaggcatgcaccactacgcccagctaattttgtatttttagtagagacggggtttctccatattgaggctggtctcgaactcctgacctcaggtgatctgcccacctcagcctcccaaagtgctgggattacaggtgtgagccaccacgcccggctggtccatttttatagctaaggaattccttgaagtctgaaaccatgccttatttatcttttcatcactgccttgcacagtacttgatacattttagaaacttgataaaagttggttgaataaatcagttgataagtgatataaaacagagcttgaactcatgattttgcaaactgaccagctgtttctttctttcctgcttaacaagtcactggtcaaatatgcgtagtcattcttgttttaaaaacacacagtcttgccgggcgcagtagctcatgcctgtaatcccagcactttgggaggccaaggcagggggatcacggggtcaagagatggagaccatcctggtcaacgtggtgaaacctggtctctactaaaaatacaataattagctgggcatggtggtgggtgcctgtagtcccagctactctggaggctgaggcaggagaatcccttgaacccgggaggcggaggtcgcagtgagccaacattgcaccactgcactccagcctggcgacagagcaagactctgcctcaaaaagaaacaaacaaaaaaaccccgaaacaatctttataaattagagtggattaatataaatattatttgctctgtaatgtcttggcttttaaggtggttaagctgtgacagttactacagaggtttattcaggctttgtctttagaagatactatttaaaatagactttatttcatacgattaaggtatatcgatcttgtatctttttaaaacaaatagctcttgattttaggctcatgagctttggaatttttaactagaacaaaaactgtcaatttgataaaagatcttgaacagtggcataacaatttctttttaactaagaaaattaaggaagtaaggaatatgccttaagcaagccctatacctaaatgaatctcactgggattggtgatgggtaggaagaaataaataattcccatgtatttaagcactgttgtaggaagcacctgtgattgctcatatattgatatcagtgtattttcttttcttttttcttttttttttttttgagacagagtcctactctgtcgcccaggctggagtgcaatgatatgatctcggctcactgcaaccttcgtttcccgggttcaagagattctcctgcctcagcctcccaagtagctggcattacaggctcccgctaccaggcccagctaatttttgtatttttagtagagacggggtttcaccatgttggccaggctggtctcgaacgcctgacctcaagtgattcccccaccttggcctcccaaagtgctgaggtgtgagccactgcgcccgacctcagtgcattttctattttctgatttctcagggcttagatataaaccatggaatcttttgttctttgttttttcttaagattttgtcagctgtttctttttataggatttgtggttgacagttctttgcttttaacatttgagaaatgttgagaaacttttttcagataagaaaccctgtcattagaattcattttcttataggtaacatcctttctccccaactgctttagaggttttttctttgtctttagttttcagaagttaaattatgatgtgtctgcacgaatttctttgggtttttctgtttggagttctcttaatttcttgagctgcagatttgtcttttaccacatctgagaagttttcagtcacttcttagaataatttttcagtaccactctctgtctcctttcattctgtgactgaatgttagatcttttgttactgtctcacaggacgtaaggcactattttcttttaatttttttccagtcttatttttttgtctgttgtttagattgggtaattcttgtttcaagtttattgattcttacctgtgttatattcattctgctgttgagctaacccaccgagttattattttggttgtttttcagttctataatttttattgggttttttgtctattctacttctttggtgagattttctattttgtcatttgtttaaagagtgtatgtaatggcttgttaaacaataggctgggcgcggtggctcacgcctgtaatcccagcactttgggaggccgaggcgggcagatcacgaggtcgggagatcgagaccatcctggctaacacggtgaaacctcgtctctactaaaaataaaaaaaattagccaggcttggtggcgggtgcctgtagtcccagctacttgggaggctgaggcgcgaacccaggaggcggagcttgcagtgagcggagatcgtgccactgcactccagcctgggagacagagtgagactccatctcaaaaaaaaaaaaaaaagaataatggctactttaaaatctctgtcagatcattccaacatctgattcatcctgttgttggcatctgttaattgtcttttctcattcaaattgtggttttcctggttcttgctacgatgaatgacttttgactgtatcttggacattttggatattaggagttatagatcatatttaaactttatgttttagtagacagtcacctgagaaggagcatgtagctcccagcctgccttttgtttcataacagctttattgagatataattcacatgccacatgttcaaccatttaaagtgtaaaattcatttacttttagtatattcatatagttgtacatcattaccacaatcaattttagaacatttttactacccacaaaaaaaccataccacacactccttagccattatcctcaactctcctactcttcatcctctccatccctaggcaaccactaatctattttctgtctttatagattcatattatatagaatagaaatatctattttgagcacataataaagacaatcatatataatattgtcctcctttatttcatttttagagtaatatatactattaccctatattaactattaatatttactaatttttttgtaattttaaagtatttataagtataaatataaattatatttatttataaatagtgagctgcaatttatttttgtagtgtttttggtttcaaaatccaactaaaattggctgtatatgtaatgagttcggaagtgtcgttaagaattggtgttgctggtgcagtgactgatgcctgtaattccagcactttgggaggctaaggcaggcagattgcttgagcccaggggttcaagaccagcctgggtaacatgatgaaagcccgtctctataaaaaaatatgaaaattagcatggcatggcggcacacacctgtagtaccagctgcttgggaggctgaggcaggaggatctcttgaacctgggaggggaggcgagatcctgccactgcactccagcctgggcgacagtgtgagaccctgcctaaaaaaaaagccaccaacaaaaatatatatataaatatataatatgcatttaatatgtttttaaatatgtattatatatttatatgtatatttttattggttaaaatatatatttttatagatatacattttatataatatatattatatattacactaaataatttataagatatatgcattaactatataaatattaatatgttttaaatatatatttaatatattaatctatattatattaaatatatttatatatatatgttttttgagatggagtctctctctgtcaccaggttggagtgcagtggcgcgatcttggctcactgcaacctccgcctcccgggttcaagccattctcctgcctcagcctcctgagtagctggaactacaggcacgtgccaccaagcccggctaatttttgtatttttagtagagacggggtttcaccatgttggccaggatggtctccatctcttgacctcatgatctgcccacctcaacctcccctcccaaagtgttaggattacaggtgtgagccaccatacctgaccctaatattatatatatgtatatatatatattttttgagatgcagccttgctctgtcgcccaggctggagtgaagtggcgcgatctcggctcgctgcaagctctgcctcctgggttcacacgattctccttcctcagcctcctgagtagctgggactacaggtgcctgccaccacgcccagctaattttttgtatttttagtagagatggggtttcaccatgttagccaggatggtctcgatctcctgacctcgtgatccgcccgcgtcggcctccaaagtgctgggattacaggcgtgagccaccgcgcccagcctcctaatatatatttttaagaagaattagtgtcaatttttttttttaacttttgatagaatttactagtgaagccatcttgtcctggtttttctttttctttctttttttttttttttgagacggagtctcgctttgtcgcccaggctggagtgcagtggcacgatctcggctcactgcaagctccacctcctgggttcacgccattctcctgcctcggcctcccaagtagctgggactacaggcgcccgccacgacggctggctaatttttgtatttttagtagagacggggtttcaccgtgttagccaggatggtctggatctcctgaccttgtgatccgcccgccttggcctcccaaagtgctgggatgtgagccaccgcgcccggccaatgtcctggtttttctttgtggaaaattttaaattactctttcacttgctttgttatagatttattcagatttttaatattttcttgagtcagtattagtagtttgtatcttttagaaatttgtccattttatctagattactttgttggattatgcttgtttatgatcacttttatttttgtagggttggtagttacgtctccttttcattactgattttcataatttgagtcttctctcttttgttattggtcggtctagctaaaagattgttaattttgctgatcttttcaaagaaccagtttttggttttgttgattttctctgttctattttctgttttatttatttcactgtagtctttattatttccttctttctgatggttttggtcttgtttgctctttttcttttttttttttgagacggagtcttgctctgtcgcccaggctggagtgtagtggcgcgatcttggctcactgcagcctccacctcccaggttcaagtgattctcctgcctcggcctcccgagtagctgggattacaggtgcctgccaccacgcccagctaatttttgtatttttagtagagacgaagtttcaccatgttagccaggatggtctcaatctcctgacctcgtgatctgcgtgcctcagcctcccaaagtgctgggattacaggcgtaagccattgcacccagccctgtttgctctttttctagtttcttaagggagaaagttaggttgttgatttgcaatcttttttaatacaggtgtttacgctataaattccctcatagcactgcttttgctgcatcccatgagttttgtactttcaactcaaagtattttgtaatattcctaatgttttctttttttgctcattggttatttaggagggtggtatttcatttccacatatttgtaaatttcccaaactttttttttggttattgttttttaattttatttcattttggtcagagaatatactttatatgttttcagtggtttaaatatattgggacttgttcgaaagcctaacacatggtctatcctagagaaagttccatgtcatttgagaacaatatatattttgccattgttgcttggaggcttgtatagatatttgttagatctagttgatttgtagtattgtagtcttctatttccttgctgatattttgtctagttgctttatccattagtgaaagtgggatagtgaggcctccaactgttattgttaaattgtctatttctcacttgaattctgtcagtttttgcttcatgtattttagggctctgttgttatttgcatatatgtttataattgtatttttttgatgaattgttggattttccctcttataaaatgtcttttttgtctcttttgtggtaacaatttttgtcttaaagtgcattgtatctgacattgtatagtttgctgtttgcatgatatatcttttccctttgttttgctttcagcctgtttggtctttgaatctaacacatcatttatttatttatttgtttgtttgtttgtttgtttgagatggagtcttgctctgtcgcccaggctggagtgcactggtgtgatctcggctctgcctcctgggttcaagcaattctcctgtctcagcctcccgagtagctgggactacaggcgtgtgccaccatgcctggctaattttttgtatttttagtagaggtggggtttcaccatgttgaccaggatggttttgatctcctgactttgtgatccgcccgcctcggcctcgcagagtgctgggattacaggtgtgagccaccgcgcctggcctttttcttttttttgagatggagtctgaccctgtcgcccaggctggagtgaagtggtacgatcttggctcactgtaacctctgcctcccggattcaagcaattctcctgcctcagcctcctgagtagctgcgattacaggcacccaccaccatgcccagataatttttgtgttttattagagacaaggtgtcaccatgttggtcaggctggtctcaaacccctgacctcaagtgatctgcccgccttggcctcccaacatgctgggattataggtgtgagccactgtacccggtcccccttaagattcattctaatgtcattttcttcgtgtagccttttctgagcctatggatgtgatccttccttgaaatgcctgtatgtctttgttcatgccttttgtatgctctttttattattttatcatggcatatatggttagtttcttttcttctctccttgctaagctactagttctttgaaggcagatgataaatcatactcatttatatgctcatttaatgtatgtaacatttaattgaaatgtatgagtaagaattttctaccctgtaaaaattaaataacagtacatggttgtacatgtgatatgtttttataattattggaaaggtataacaagacaatgaaagttcagttttgcccacagaaattgctattatagggctgggcgcggtggctcacgcctgtaatcccagcactttgggaggctgaggcggggagatcacaaggtcaggatatcaagaccattctggctaacacaggtgaaaccccatctctactaaaaatgcaaaaacgttagctgggtgtggtggcgggcgcctgtagtcccagctacttgggtgtctgaggcaggagaacggcatgaacttgggaggtggagcttgcagtgagctgcgattgcaccactgcactccagcctgggtgacagagcaagactccatctcaaaaaaaaaaaaaattgttattatagtgttttattttattttattttattttgaggcagagtctggctctgtcatctaggctggagtgcagtggcgcaatctcagctcacagcaacctctgcctccccggtttaagcaattcttttgcctcagcctcttgagtagctgggacttcaggcatgtaccaccacgcctggctaatttttttttttttttttttttggtatttttagtagagacagggttttgccatgttggccatgctggtctcgaactcctgacctcaagtgatccacccgcttcagcctcccagagtgctgggattacaggcatgagccactgcacctggccatagcagtggtttctgatcaaatatttgatgcccagcttttcatagagaacatcacaaaattccagctccaagtaattttgggctagaggcataatttcccacaacaaacatgggaaacctactttcatatgagagtgactaggctaaagcaaaactaaactggaaaatatacaggaaaggtagagctatttgccaggctactttctagcctccgtatatatctgttatttcttgagtccaaatctagttctccattcttaatctctcccagatgaaatcttcagggacttgcagaaagtgtgcaaatatgcatcctgctcatttttataagtaaagcataatggctacatggatttatagttttcttctgtcattctaattagatctgaggtggtcatgataggacaattctggagaaaatacagttcaaaagctgagtatatttttaaaaactatttgctaatgaaagccttataaataatagcagatggtcttaaatttacttcatttgcaccataattgttgcatacctggctttttgttcatgccaagcctaataatgactgggacgtaccatggtatacagtcagacctgggttccagcttggcaaataatttgccatgtagcagtatattaaggaagttttttattccttctgggcctcagtttccttatgtgtaaaattctagaacagaaatgttcctttaccttatttttcgttgcagcaatgtaagggattgcaaaaaagattttgattcattcatcaacaagagtgcaaagtgatgatagaggcagatgaaatagactgatcaataaagggagtggattagaagagcaagggtcaaaggaaaaaaaaaggaggtgaactctgtatttttagttttttttaaatgtagtcaaaccatattataacactggaaccagaagaaaaaagtaatgttctaatcctaggaaagcattagctgtctgggcttttattgagaaagttttagcaggatcagtcaatgcacatttatcaagtgctcaatatgcttgtagtatattgttatatactatggagaaactgaaaaagataagatatagtcaatatgtcccaagaactcacaactaattatacttatagaatctaattacagccataattaccttattggcaatctaaaattcattaattcattcaaaaggctctagtttcaaggagctcacagcctactggaaaaacagacaaagtaaccatgtagtgtgagatgtgatatagggtaaatacaagggcactaggaaggacacctgtgtcgtatgtggcagagagctttcaggaaagctgcgcaggaaagatggcattaaagtggaatgttgaaggatgagtgagagtcatcaggcagagagacacgcaaaagctgcagtgcatgcggaggctcaaacaaggaagggatgcttcaggtggatgacagtggcactgggtgagtgtgtgggggtggtgggtgggtgggtggtgaaacaggctggggagcagacaagggctgggtcaggaacggccttgtactaacgttatggtgaggacttaatttttttgaaaaaagtagaaagttgtggaagaggtttaagcaagggagcatcataagtatatttgcattttagaaaggtcgttcctggctgggagcggtggctaacacctgtaatcccaatgttttgggaggccaaggtgggtagatcacctgaggtcaggagtttgagaccagactggacaacatggtgaaaccccgtctctactaaaaatgcaaaaattagctgggtgtggtggcacatgcctgtaatcccagctactcgggaggctgaggcaggagaattgcttgaacctgggaggtggaggttgcagtgagccgagattgtgccactgcactccagcctgggcaacagagtgagactccgtcttaaaaaaaaaaaaaagctaattcctgagacaagttagtgattcaactgatggaaagaagtcagaactcagaccatttaggaggctgtggagttcatatgagaaaggaagagggtgaggattaaactgattttttttccgtaattatcagcagggaaaaaaattgagggaaatcaagtaaagggagatgaaggaggaagaattgacgggactttaccagttactcatggagaggttaagggagaaactacataaaggttccctggttttaagcttgagaatcagagagaaagtggttcattgaccaatggaggaaagggaagagtaaaagagatttactagggaaggtaggttccatttagtgttcgttgagtgtaacatgccggtgaacatccagatagaattgtcccttagcctttaaatgatcaagtctgagattgggatagaagtcttggttgcaaatcgatttgaatcattacagtgtaagtgagagctggctgcagatgaagcagggtgagtgtaggagtgtgagtaagggaatgcagtgctgtaaattaatctttggtcactgctttgtgatgttgcttttgaaacataagtttgaatacagagttgactttttaaaatctgggcttttctttttagtgtcattgattactgttagtattctaacagttaatatctgtaggactctttctttccaaagacttggaaaactgtttttcctctctgctatgaattttgtaattattttattgattgcagaatatctttttgaggcaatgattgaaattgcaaagtttttttcatcagttccagattactttctttctgtttattcatagttccttgtttcattttcgatgtttatttgttgactatttgctttatatcagatgactttataggtattttaaggggatttaagaaagatatcactagttacctattcgtctataaattccttgcttaggccaagtgtggtggctcacgcctgtaatcccagcactttgggaggccgaggcaggtggatcacaaggtcaggagattgagaccatcctggctaacacggtgaaaccctgttattaaaaaatacaaaaaaagaattagctgggcgtggtggcaggcacctgtagtcccagctactggggaggctgaggcaggagaatggcatgaaccccgggaggtggagcttgcagtgagctgagatcgtgccactgcactccagcctgggccacagagtgagactccgtttcaaaaaaaaaaaaaaaatttccttgctttgtattttatctggtgttcatgtatctgctgcatattaaataatgaatgggttttaatttgtgatttaaaggaacttaaatagtctagtgaggtaaactaaccacaatacagtggtatgtgtgctttgaggttacagaagagggaacaattgatttttgtgcaggaaagacgaaaaaaggcagtcagggacaggttgactgaggagatatgtgtaaaagagagaaagcggcatggtactggaggcagcaccatgagcagaggccaggcgtggaggggtctgatgtcaatggggaatgattctcagggggtcaggctgcatgggaggagtgctgggaggtgaaggtaaaggtggaagatgagcaggagacagtgaaggaagggtgccctgggcccctgttctttaaaagccccttcacatgtttccatgtgattgccccagcagtgctgtgagagagaacttgcaggtgtccctttttcctttgcattttgtctccagtctgtcttcttccttttgtaatttctactctaattacttgtgaagaagggtttgattatcattatctctattttgtggatgacagaactgaagcttaatgatttatctagtgccatgtgactaagaaaaaactgattccagactagagcccaggtcttctgactctaatacaccaggcttcttttacattaattcaatgccatcttctcttctactttttctattcagttacttttcattctaaaggttatgaggggctgggtgtggtggttcatgtttgtaattccagcactttgggaggctgatgtgggaggatcacttgaggccaggggttcaagaccagcctgggcatcataaggaggccttgtctctacaaaaaagaaagaaagaaagaaacaaaaaattagccaggtatggtttgcatgcccctgcagtcccagctacttaggaggctgaggtgggaggatcacttgagcccaggagttggaggctgcagtgagctatatgccattgcactccagcctgggtgacagagtaagaccctgtctcaaaaaaaaaaaaaaaaaaaaaaaagttacaagtttggtagaaaaatggcataaacttgagttaccgaataagaatatataatttgaagaaatttgctttctttgttcctcatcatgggtggtctaaacagattataaacatgaacttgatgaatctaaaagataaatagtttagccaacaatgatttcctgatttataggtctgagaagtttggaacttggtaacttcaattttttattttgttttatttcattttaactctttattatgaaaaatttcaaacatatccaaaatagagactgctatattgagccctcaagtgcccatcactcagcttcaacagtgagctcatagcagtctaatttcatatataccctccacacattcctgctctcagatatttctgaagcaaagccgagacatcatttcatttaacttgaacctttacagatgttttgctttagtttaacttgtgctcctgtctccatttgtgttctaggcattaggtccagttcttggtatgggtttttttgaagttcactgctcctttaagtagtgagtatcagctgactttcaaagattgtcagctgtgtataccatattcttcttgccatttgctactcgttagtgggtctggtgccagcccctaacgtgcagctaggaaaaggtgttcccatgttgatgctctgaccatgagctgacataagaatggctcttgcaacaatggtttcatttaggtcagatttgaagtctgtactgcatggcaaagctgtcattcaaaatcagtctctgtgcatttattcattggcaagttcaagcatgtgataaaattatttttccttttgctaacaggctagaagtaaatggagaaaccagatacagactggactttagtcagcaggcacagtggtattggctgttgctgtttgccacgttggttggcatcatgaatgggtatgagaggcaaggaactagtgattaacaaaggaaagacagcttttaggggcgttgttacattcctgtaatttatcttttgctaggacatgtccccagcatctctttggacctagaatatagccatgttcctgattataacagcagggtgtggtgaatgtgctcttgagtgtgtgtacctgggcctgtgtgtgtgcactgggtgttgggcatggccttgctggctgctgacctctgtatctctacttttgttgactgatcctgtttttggttagcaatcttagtttataaaatttgcaaatatgtaagtatagaaatgtaatgtcagcactctcttctctaaggcattatttctaggagtctatttcatttggcctgctgggaaagagcagttctattaatagtgattcctcagatacgtttattgcagtgtttcagtgctttttctctcccctggagataaaactgagcctgaacattctggtattctttttttttttttttttttttttttttttttgtgagatggagtttcactcttgttgcccaggctggagtgcaatggcacgatcttggctcaccacaacctccacctcctgggttcaagcgattctcaagcctcagcctcctgagtagcagggattacaggcacgcgccaccacgcctggctaattttgtatttttagtagagacggggtttcgccatgttggccaggctggtcttgaactcctgacctcaggtgatccgcctgccttggcctcccaaagtgctgggattacaggcatgaaccaccgcacccggcccattctggtattctttttagatcaaccttagctctataaatgtcctagttgagaaaatattgatctgctgtctgaaaatacagcaaagtggagtttaaaagtaatggaaagagggcctggcacagtggctcacgcctgtaatcccagcgctttgggaggctgaggcgggcggatcacctgagatcaggagttcaaggccagcctgggcaacatggtgaaacctcatctctactaaaaatacaaaaatcagctgggcgtggcggcacatgcctgtaatcccagctaccggggaggctgaggcaggagaatcacttgaacccagaaagcagaggttgcagtgagccgagattgtgccattgcactccagcctgggtgacagagactcagtctcaataaataaataaataaaaagaaataaagtaacggatagaggccatgtttgtgtgtgtgcatgcacacgcacacgtgtgtaaacacacatgcacacagtgttttagtatataagggtaatgatcaggccagcttttactgtacttcttaaatcaaaggactacctttttttagaatttgagaagaattagtatgaaggtgtgagtggagcctcaaacactatagtctcttatctagaaaaaggtacttcccagtttggttaggtacctgttttgtttttgtttttgtttttgtttttgagacggagtcttgctgtttcacccaggttggagtgcagtggtgtgatctcggctcactgcaagctctgcctcccaggttcacgccattctcctgtctcagcctcccgagtagctgggaatacaggcgcctgtcaccacacctggctaattttttgtattttttagtagagacggggtttcaccatgttagccaggatggtctcgatctcctgacctcgtgatccgcccgcctcagcctcccaaagtgctgggattacagacgtgagccactgtgccccgccaggtacctgtttttttgtaggttcagtatacactgtgagctggtgctctgctaagtatgctctggtagaggatgggacataggcaaatctctgggcttcaggcattcaacatcttttggactaagtaaaatatatatgatttgatgaatagtgacctttgaagaataggtaagatttagagaagtcacgaggagaatgtgctacttgggcctcagtttgtacatctataaaatgagagcattatacgtagatgatctaaagacccctcttaggactgattctgcaagttaagaaacatccaaagagagaaaattaggcttcacaagcgtaatgaaaactaatgagaatgtttttggagaagccaaaatccctttgttttccctttttggtatcccttacaaggcctttgatcatttacttgtattcagatatcttgaagggctatggaacatactctccccctattaattaacgtacatttagcgaatgccttttaatgtttaatttaaaatacagcaaaaattaaaacttgaagagaatcactcaaatttgtgtccgttgacaactaacaagtatgcttgaatatatggcaaggtattctttgccctaaattatcccttagtaaagagggagttgccttcatttgagtccttatgaaatctctgaaggtgaggggtgccttctcaattactttgaacaacaaactactgttttgggatgataagctattatcatcaattagtgctactttttggatgcctatagggatttcctgacagaagcagtggaaaaacaggcggagaaatttaacacagtttggtgttggatgccttaaaataagctttttttttttttttttttttttgagatggagtctcactctgtcgcccaagctggagtgcagtggtgcagtctcaactcactgcaacctccgcctcctgggttcaagcaattttctgcctcagcctcccgagtagctgggattacaggcacccgccatgatgcctggctaatttttgtatttttagtagagacggggtttcaccatcttggtcaggctggtcttgaactcctgaccttgtgatctacccgtctcggcctcccaaagtgctgggattacaggcgtgagccactgcgcccagcccaaaataagcctttaagtgaccatttggaaaacaaataccaggctttcagcagaggaatggcacaatctttttgtttaattaattaattaattaatttagttagtttttagagctggggtgtggctctgttgcccagactggagggcagtggtgtgatcatggctcactgcagcgtcgacctcctggatatcagcaatcctcccacctcagcttccccagtccttttgttttataaaaacaaggacccctctggatgccgagttgagaatagactctaatgggcagcagtagaagtaaggatacctgtcagtaatcctggtgcaagatgctggcagtggtagtggatgtgttgagaagtagtctgattctgactgtattttgaaagtagagccaacagatttttttttttttctcagatttggatgttgggtatgagaaagagatgaatcaaatatttattaaatcctttataatcaagcacacttcaccctcccttacctaacaattcctcttctaaaatttagtttaagaaaacaatcgtgtgtaaagatgtttgtaaatacaagaatagttatcatagtaatatatcacagtaatgaagatttaaaaacatgcaaataataatggagaatcagccaaataaatgctggtaaatcctttcagtagagtactatgcaggcattaaaatgatctacaagtatgtttttggacaaggaaatgcattacaagtatatttccaggtttagtttttgtatgtattttgctgggaatttgaggtttctttttttgtttttcaaaattagttttcaatactgggagtattttaatgggaagtcattagagggtatcagaaactattggttgcttctttagtaatgtagaaggctttcatgttaacttttgattggtgaatattttgtatctctactttcaaaggtagttaccttgttttcctacaatcaaattgttgttaaggaaattttattttcttgctctctttcagcaaatcaactaaggtaatttttgaaagaagttgaatcatttattacctgttgcattctgacatgtatcagaagttggcaagttaagtgtaatttaaaatagtacaaaattttatcaaaaagctttgccatttcagagtagttatttatcttccctcatgtatcatatatgtaaccccctaaataaatggaatatactagaagaatcattcctgtataactgtataaatggttgaaatgaaatcaaccatattggatccataagcttattggatccataagaacacttctctttggttcactgagtgagtttggtttgctttgttcagattttaaatcaatttttatttaagtgttcataagatggaaaatacaagactttttctaggatcattcctctgctataaattatttgcttcatatatttctatcacaccgaatctattatctgttcaatcacaaacattaattggaaaattgaggatcagaaactcctgttcttggttctctcctgccatctgtcttcctccttcccccagtgtttcccctcaaatctcttgtgattaaaaaaaaatttttgaaattactacataataaaatagaattttttatgcacagttctgtgacttttgatacatatattgagtcatgtaacagttacaatacagaatagttccatcatcccagttatatccctttatagtcacacagtcccctggcatccactgatctatagttttgtctttttgaggatgttttatgaaaggaataattttgagactggctttttttttttctgagacagtctcgctctgtcacccaggctggagtgcagtggcacgatctcgactcactgctagctccgcttcctagattcacaccattgtcctgcctcagcctccggagtagctgggactacaggcacccgccaccacgcccagctaattttttgtatttttagtagagacggggtttcactgtgttagccaggatggtctcgatctcctgacctcgtgatctgcctgcctcggcctcccaaaatgctgggattacaggcatgagccaccgcacccggctgagactggcttctttcacacagcataatgcctttgagattcatccaagttgttgcacatatcaagagtttgttcctttttattgctgagtactattccagcagtgaatatgtcacactttattcagattaactcattggataatttccagattttggtgattatgactagagctgctatagacatttatgtacaggttttgggtgaatagggtttcatttactaggataaatgctcaggaatgccattgttgtatggtaagtatatatttacatttattggactctgcgaaactctttttcacagtagatatatctatcattgggcattcccagtagcaaaatgtgggagttccagttgctttttatccttgtcagcacggttcagtatattttagccattctgttaagtgtttagtgattttttaaaacagtattattgagataaaatccacataccataaaattccctactatctaggtttagagtattttatcacttcaaaaagaaaccccatactcattactagtcacttcttgggaggccgaggcgggcggatcatgaggtcaagagatcaagagcatcctggccaatattgtaaaaccccgtctctactaaaaaatacaaaaattagctggacatggtggcacgcacctgtagtcccagctgctcgggaggctgaggcaggagaatcacttgaacctgggaggcgaaagttgcagtgagctgagattacgcccctgcactccagcctgggtgacagtgcaagactctgtctcaaacaaacaaacaaaaactagtcactcttcatcttcccccaccctccagctccaggcaactattttactgtctacagatttgcctattctggacatttcatgtaaatggaatcatacagtatgtagtctttcataagtgactactattgtgtctggaattggtgggttcttggtctcactgacttcaagaatgaagccgcggaccctcgcggtgagcgttaagctcttaaggtggtgcgtctggagtttgttccttctgacattcggctgtgttcggagtttcttccttctggtgggttcatggtctcgctggctcaggagtgaagctgcagaccttcacggtgagtgttacagctcttaaggcagcgcgtctggagctgttcgttcctcccggtgggcttgtggtctcgctggcttcaggagtgaagctgcagatcttcgtggtgagtgttacagctcataaaagcagtgtggacccaaagagtgagcagtagcaagatttattgcaaagagcgaaagaacaaagcttccacagtgtggaaggggacccgagcgggttgccactgctggcttgggcagcctgctttttattcttttatccggccccacccacatcctgctgattggtagagccgagtggtctgttttgacagggcgctgattggtgtgtttacaatccctgagctagatacaaaggttctccacgtcctcatcagattagttagatacagtgtatcgacacaaaggttctccaaggccccaccagagcagctagatacagagtgtcgattggtgcattcacaaaccctgagctagacacagggtgctgattggtgcgtttacaaaccttgagctagatacagagtgccgattggtgtatttacaatccctgagctagacataaaggttctccaaggccccaccagagcagctagatacagagtgtcgattggtgcactcacaaaccctgagctaaccacagggtgctgattggtgtgtttacaaaccttgagctagatacagagtgctgattggtgtatttacaatccctgagctagacataaaggttctccacgtccccaccagactcaggagcccagctggcttcgcccagtggatcccgcaccggggctgcatgtggagctgcctgccagtcccatgctgtgcgctcgcactccgcaggccttgggtggttgatgggactgggtgccgtggagcagggggtggcacttgtcagggaagctggggtggcacaggagcctatggagggggtgggaggctcaggcatggcgggctgcaggtcctgagccctgccccgtgggaaggcagctaagtcccagctaaggctggcactgctgggggacccagtacaccctctgcagccgctagcctgggtgctaagcccctcattgcccggggccggcagggccagccagctgctccgagtgcggggcccgccaagtccacgcccacccggaactccagctagcccgcaagcaccacgggcagcactggttcccgctcgcgcctctccctccacaccaccctgcaagctgagggagccggctccagccttggccagcccagaaaggggctcccacagtgcagcggtgggctgaagggctcctcaggtgccaccaaagtgggagcccaggcagaggaggcgcccagagcgagcaagggctgtgaggactgccagcacgctgtcatctctcactatcacttaacatctttaagtgatagaagtggatgcaaggtttatccatgttgtagcatgtatttgttcttttttatggctgaataatactgtattttgtggatataccacattttgtttatccatttatcaattcatggacattttggttgtttctactttttggctatgaataacaatgctgtgaacataggtgtacaaattcttatgtggagatgtgtttcagtcctcttgggtagaactgcttgatcacatggtaactattttttaatttattttgtttcttattaaaaaaaatttttttttttttttttttttgagacagggactcactctgttgcccaggctggagctatggtgtgattatggctcactgtagcctcaacctcccaggctcaagtaatcctcccacctcagcctcctgagtagctgggaccacaggcacgtgccaccatgcctgattaattttttgtttgtttgttttttgagacagagtctcgctctgtctcccaggctggagtgcagtggcgtgatctccactcactgcaagctctgcctcccgggttcacgccattctcctgcctcagcctcccgagtagctgggactacaggcgcccaccaccatgcccggctaatttttttatgggtttcaccatgttagccaggatggtctcgatctcctgaccttgtgatccacctgcctcggcctcccaaagtgctgggattacaggcatgagccaccgcgcccggcccatgcctgaatagtttttaaattattttttgtagagatgaggtctcatactgtgttgcccatgcttgtctcacactcctgggctcatctcccacatcagcagtaactctctgtttagccttctgaggaaaactgtcaatgtgttttctaaagtggttgcaccattttacaatcccttcagcactgtatgagggttctaatttaaccacattttatcaacatttgttactgcccatgttgtcatctagtgggtgtcaagtggtatctcattgtgattttgatttgtattttcctagactgatgatgtggagcatcttttcttgtgcttattgaccatttgcatatattctttggggaaatatgtattctgattctttgcccattttaaaattgttatttatctttttattgttgaattgtaatagttttttacgtgttctggacacaaatcccttctcaggcatataatttgcagatattttctcccattttttggtttgtctttcactttcttggtggtgtcctttgaagcacaaaaatttttaattttgatggagtccagtttatccatttttggtggtgatgtttgtacttttggtgttgcgtctaggaaaccactacttaacccaaggccatgaagatttacacctttgttttgttctaagagttttatggttttagcttatacatttaggtctgattcattttgaattgatttttgagaacagcatatggtaggtatccaacttcattcttttgcatgtggatatccagttgcctgagcaccatttgctgagaagactcttatttcctcactgaattgtcttggcacccttgtcaaaaatcactttcccataaacatcgtatttccagataattctgttctattcatttatgtgtccatttttatgccagtactacattgtcttacgattgtagcatttagttttgaaattgggaagtgggggtcctccaactttgttcttttttaagattgttttggctagaatgagattttataaacataaattggagaaagtaactccatgcatgaaatattcaaatcagtgatacctgactacgtctatcataaaattcatatctttaacttgacctacaagatttgtgatctgacctctgcccagtttgacctttcacccactttccctcttggtcactgccttgcagcttcattggcctacttcctgcttctttttttttctgagacaagagtgtctctctctcacccagcatggagtgcagtggcgtgatcttggttcactgcaaccttcgtcttccagattcaaacaattctcctgcctcagcctccggagtagctgggattacaggcatgtgccaccacggctaatttttgtatttttagtacagacagggtttcaccattttggccaggctggtctcaaactcttgacctcaggtgatccacccgccttgacctcccaaagtgctgggatcacaaacgtgagccaccatgcctggcctacttcctgcttcttgaatgcgttaaaacgccttcccgttacatggcttttgcatatctacgtactttttcttggaatgctcttcccttcactaattcctactcattcttcaggtcttagcctaaatgccattttaaaagaaagactgttctttttatttttaaaatattgctttatcttttcctagttagaaaagcaacatacaagttctttaaagcaagcttgaaaaataaaagcatggctacacacacacacacacacacacacacacacagacacacacacacacacggaaaccataggacaagcatttaatgtttcagtgccatcaaatgtcagcttgttattggtcgtttgggtttttcattttttctgtttggaagcctgcagaatttttcgtgcttggaattgccaagatgtgtccagattgggtctgttaccatttgttttgctctatggatgtatagatccttacatctatagtgtctgtttacattcagggaagttttgtttgtttgtttgtttgtttgttttttggagacggagtctcgttctgtctcccaggtcggagtgcggtggcaggatctcagctcactgcaagctccacctcccgggttcatgccattctcctgcctcagcctccccagtagctgggactacaggtgcccgccaacacgcctggctaattttttgtatttttagtagagatggggtttcaccgtagcaaggatggtctcgatctcctgacctcatgatctgcccaccttggcctcccaaagtgctaggattacaggtgtgagcctccgcgcccagccggaagctttctttttttgaatctgtaatatggttttactttctttaaccaaaatgttattgtataataggatcgactcttctctgttttctacattattctcttttcttgccattgtttccttttctttctacctggctccttttgaattgaacattaggatatcatcttaagtgtgtcttttaacataatggatgcaatgttctgcatagatttttttttttttttttttgagacagagtcttgctctgtcgcccagactggagtacaatggcgcgaactcggctcgctgcaagctccgcctcccgggttcacgtcacgccattctcctgcatagacattttaatgctatattgccaccaattatcttaatacttttttctttgcagttttttcttattaagctgatattttaatctcaacctagtctttgtgattctttgttgaagctttatatagtgcctggcacaaaactatgtgctcaaacatatattgaatgaatgattaaaagagtatacacatgaataaataagaaccagttcttagttggtgtattctactgagactgtcaaagtacttctctagtaatgaattccttttttaaaaaaaagctgtattgaagtgtaatttatatatatagtatgtgaacttccaaaatctgagacaggtatcagttagtttagaaagtttattttgccaaggttggggaacacgcctgtgaagcagcctcaggaagtcctgatgacgtgtgcccaaggtagttgagatacagcttggttttatacattttagggagacatgagacatcaatcaatatatgtaagaagtacattggttccgtttggaaaggtgggacagctcgaagcaaaggcaggaagacttgaagcggggaaggggcttccaggtcactgataggtgagagacgcacagttgcattcttttgagtttctgattagcctttccaaaggaggcaatcatatatgcatctatctgtctgactgagactgatacctgtctcagactttggaggttcacatactatatatataaattacacttcaatacagcttttttttaaaaaaaggaattcattactagaaaaatactttgacagacagtgagcagagggatgactttgaatagaatgggaggcaggtttgccataagcagttcccagcttgacttttccctttagcttagtgatttgggggccccaagatttattttcctttcacaagtatgagggtgtaattcaataattttttagtagattttatagggttgtacaactatgacaacagttcagttttagaacagttcagtcaccgcaaaaagttccttcatgtaagcttgcacttaaatccctgctttttcactctgtctctataaatttgccttgtcatttaaatgtgtgcttatgttgctctcatatatatatgtatatacacacacacacttttaggattgtttatatctaaacaactttaatgaagtatatatagtgtaaggtatatgtactttatttaagtatatatacttaatgtatatatactgcctttgctttgagctgtcccacctttccaaacggaaccaatgtacttcttacatatattgattgatgtctcatgtctccctaaaatgtataaaaccaagctgtatctcaaccaccttgggcacaggtcatcaggacttcctgaggctgtttcacaggcgtgttccccaaccttggcaaaatagactttctaaattaactgatacctgtcttaggttttggaagttcacatactatatataaattacacttcaataaagcttttttaaaaacaagtgtgcacacactttataattgttttcatttttaagcatggctttctaggagttgccttcctgtctgcatagcttagtgatcagtggtcacccagtgcttggacagtggttgcctcagacatcttgagccagtaaggcatttgtcctctgccagtagatctctgtgggtagggagcacatacaaagtttaggctttttcagatctgctgtcttttactttccacccagtcctttcatgtctcctctgtgcctgcatgccacttctgggttggccaacaaatgtgccccacccagactgcaacctccaccttctagagctgttcaccctctcactcgcctcccacctgctccatcacttactctgacagtgcaggtggtcatgtgcgttcttccccactccaaactcagtgaactgtcagtcctaatggtttgccttgccctgctctgccttgcagaacctctgtacctactgaatgagtagatgaggtgggagtaaccttacacagaccctcattgttcttacccaccttttagcagtttttcaagcataaatgcttctcaggttgttgtattcttctggtggatttccagagcactgaaagggttgttttgcccatttcacccagctttatcattggtttttggggagaggaattaactaccttctcactaggctgtagctggaagtcttccctctcagaatgtattttttagtgtagttagtcatttccccaggtatatttactgtatccttagggttctccagaaaaacaaaaccaaacccctgtgttagggttttacagaaaaacaaccagtagtcagggtaaggcaaaccattaggactggctgctttgctagtgggttggaagggatctcactgaatttagagtggtgggtaacgcgcatgcccactctgtatatggggaggggtcgggggtagggagagaaagagactgattttaaggaattcacttatgcgattgtggggctttcaagtctgaaattcacagggcagttgggcagagatgagttgatgttgcagtcttgttcccggaccaaactgagggtcgggttgctgtttcttgtggcccaataacgagatgcagatgaactggggaggaagagagtttttatttctgtaactgttacagggaggcctggaaattatcaccagaccgacttaaaattacaaagtttttctgagcttatgtaccttctaacctatatgtctgcatgtaagtgtgcattcatctgaagatgtaagtgattaacttcttttaatctgtaactaaagtctgagtcctgaagcccttcttctggagcctcagtaagtttacttcatctaagtgggtctaggttctggggtgattacccttatcttatctcctgctaaatcacggagatttggagagttccttcagacctccaataaacttgtttgtggaggcctggggagtttcttcagacccctaataaaacttgtttaatcctaaatgggtcctgttaagaattccttcgttattttgtcatgctttaaggcccaggaaaggcctgggcaaaactcttggtgcgcttttgttacattccagcctttgtataacagcactggcttttttttttttttttttagcttttaatatttaacttaaccactcagtcagtactgaaacagttgttatggaggcctgcgttagtgagacctggcctgccacagtcttaactccagattctgctcggtagcaggctggacacacaggcagggtttctatgttgtagttcttttccaggaaacctcagtctttgctcttaaagcctttacctgttagatgaggccttcctgtattatggagggtaatccactttactagaaatctgttgatttaagtgttaatcacatctaaaatataccttcacagacatatctagattggtgtttgatcaaacaactggacaccaaagtctagccaagttgacacataaaattaactgtcacacttgccttctgaggattcagggtaaattattttggtgtacatgtagtctggttgctgtctgtttcccactgtatacccttgctctagctaaactagcagctccagctgtttcatatacatgcttctgcttttgcacatccatgtctttggtcatagtgtacctgcagcatggagtgcttcctgtgtccagatcttacctgtccttctgaggattagatcacagatacttatacatacaattttgtttgcagcctatacactagctttcctaaacttcttcctgtcacctaattatgctgtgttctgtcttgccattgtgcttttgcacacaagttcctttggtttagaatatccctccctctgtcttttctttcttaaagagacagggtctcagtgtgggctggtctcgaactcctgagctcaaatgatcctcccatctcggtctcccaaagagctgtgattacaggcgtaagctgctgcacctggtccttccttcctactttctgtaaaacttttacagcttcctcaggtcaattacatgctccttttcattatgctcccattgtccctttgcgtatttccacggaggcactcatcacattttattgttattgtttacatatctgtctgtcaaaaggctttgttttccaacagcagaagttactatactgttttccttttcaaagttggtcctcagtcgagcctatctggtctgtagtacctaaataaattgtgggataataaactgaatctctgttaaagatttggaagttgtttcatatttcttctataatttctcattgttagaatgtggagataatgactgcttggaggtaaagcaagtctgaatagcagagatcagccttgggttggactccagacattcttgggcttattaaatatttggttgactcactgatagaaatagttttatttattttccattctttaccaggtacatagcttcaaaattacttcattaacaaaagctgtttctgattataaacattgatttatttttactcaaatttgtatatactgtatatactgagtaaaacaaattttactcatttgtttttgttttgttttgttttgttttgtttttttgagacagagtcttgctttgttgcctaggctggagtgcagtggcatgatctcagctcactgcaagctctgcctcctggattcatgccattctcctgcctcagcctcccgagtagctgggactacaggcacccgccaccatgcccagctaattttttttgtatttttttttagtagagatggggtttcaccgtgttggccgggatggtctccatctcctgacctcgtgatccgcccgcctcggcctcccaaagtgctgggattacaggtgtgagccaccgcgcccggtctcaattttgttttaagaatatcaaagaatccaagactgtttcagcttctttctacctaaaatgcagtggtgataactggtgactgatttgtaagcaatctcaatgtaatgataaataaccttttcctttctctactagatgttggttatctttctgaagtagactgtccatggcctgaacattttccgaaaatcattttgagcaaaatatctgtttaataacaagataaccacatcaagatggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaagtgagtagaagatacgttttttattttgactctatatttagctaataatgatctatacatatgtatgtatgtgttttatgtatatatgtgtgtatgttcctgtgtgtatatatagaaactgaagaccttttctggaacagatacagcttcattgatgaggtttctttttttattaattctctactagtttattacagatgttcacttatttatacttcattttttcatttatatatcgtggccctctttatttgtttgatggatacaaacccaccttacaggcggtgaaaagccttcttcagggtctcagaccttaatgccaatcattcagttttagtggcttctgatttctaatttctagatattgttgttaatgaggatagttggcttttgtgtggattaaggttaaaatcaggaagtgcatatatcatgttaatgagcacatagtgaattataagcattttgaaatttttagtggtagagaaaaataaaagcttcgtctaacctaatctcttcattttatggacaagaagactgagtcacagtaagattaaaacgatttgttcagatttagatggcaaggccagaattcgaatctgtgccttggtctcaatgaggtcgtgcttttctccgtggcattttactacgtgttgtgcttcctttgtcatctgaaggatataacctctcttattttttacaaaaggctagagaatctccaaaatttggaagcctaatccatacaagaagttccttggattcaaaacttctcaaatgatgatttttagcattttgcttcttttcttatgaagtgacaactagtataccctctaacctgtcttgatgacttatatacctggaatgaggatataaaaatggaaactactattaaattcaggtagcatctcttcatgaagaagagttggctataactaaattttatttttgttttttttcttttatcaaagtaatatataacacctgtaaaaaagaaatatataaggtgttatatatacatatataaaaagaaatataaaaggtgttatatatactttttatcaaagtaatatataacacctgtaaaaaatactttccttgtgtgcccttcttactttcaccaaggaatatctgcttaatttttttttgctgtatagaacttgtatagtaaatagatttcttatgtagataatctcaaaggaacagctgcctgcctgtaccaagctttcaattattgattataagttatgacataccatcattgtagtggctctaggttgtttttattgattcaaagaaaatttcagctctggctactctgattgcagtttattattatttccagataatagactataattgatttttaatcacctgtattaggtatttcagtctttgtgcttgtatgttggcccggcaccgatgccacctacatctgctaatataaaaggaggccattagaccaccagcctcttcagtagggattaaagagatatgcttaagttaaattttggtgctaatcaggaagagaacattttgtgtatatacttgctatgtttaaggtaaacataaaggccaagaaaattcatagaaattatattatgaattaatgaattttagaaagtaaagagatgttacttagcatttcagtatgtggaatggaggccctgtaaggctctatgttttttcaaaaattaacatgtcacaatcatgagtagaacctaccatgcttattccaagatttttgcatttggggtctttctagtttggggctattatggatcaaagttgctaagaacgttcttgtacattacttttggtggatatagcattcatttcttttaggtatataccaatgaatagaattgctggatgacaaggggtgtgtgtgtgtgtgtgtgtgtttgtgtgtgtgtgtgtgtgtttaacagatactttctaacagttttccaaagtgtctctatcattcatgtatggctgtactgtaaatgaacatgttctagttgcctcacatctttaccaacacttggtattttagtcttttctggtaggctacaattgttttttaaaacttaaaagcaaaataatatttgaacccctttttgaaagaaaatcttacccagaattccaatataaaacaagagctgctttggttgaggtgagtctaaactagaccatatttccttcttttgtttttgagatggagtctctctgtgtcatccaggctggagtgcagtggcatgatctctgctcactgcaacctccatctcccaggctcaggtgatcctcccatctcagcctcccgagtagctgggattacaggcacgcatcaccatgcccagctaattttttttttttttttttgtatttttggtagagccccatgttggccagactggtctcaaactcctgagttcaggcaatccatgtacctcagcctcccagagtactggggttacaggtgtgagccactatgcctggccagccatacttcttttttaaagattgaatccctactctcaaaaactgctttttggggaataaggcagaaaatacaaaattattacatagtgccaagttgtaaatatcccatgttcattataataaagaatttattgcccacagtcagtcatcctgtgtgcttttcgttttatttaaacatttttattctgggaaatttttttttttttttttttttcttcgagacggagtcttgctctgtcgcccaggctggagtgcagtggcatgatctcggctcactgcgagctcggcctcccaggttcacgccattctcctgcctcagcctcctgagtaggtgggactataggtgccccccaccacgcccagctaatttttttatttttatttttagtggagacagggtttcgccatgttagccaggatggtctcgatctcctgacctcgtgatctgcctgcctcggcctcccaaagtgctgggattacaggcgtgagccaccgcgcctggccgaaaattgtttaaagtaaatattttaatacttagttcagtattacttagtattacaatacttaaatatttaggcagccttgaaggtttgaagatgtcaccagatggcctagggatacttgtagaagctgttgaaaatagagatatcaggagaccttcacagttctgcctcttatcttgttaatttttgagagttaacctttactttgcttagaaatttccagttatttacagtcagggtggcatctcttgcgtctctgggctgttccagttacagaaaagtcagaggctcctgctcaagtatcttgaaaagaaagcagaagtaaagtttgaggctatttacgttgccctcttctcatggtttgtggaattttttgtggaattttagttgtctccatcagggaacttttgggaagttacaagagcgtacagttacttctgttattaaactcattatgataccatgaaattacgtggaacaaataaaagtcaagtttgctaggtcaaaagagcaaatccagaaaagcagattaatgtaacagtgacgcttagacaacaagtacaggaatcacaactacaattcagagacgagttcttatctacacttagggcagaaagagaatatagcaactattaaacacaaataaattagaatgaaaaagataatagtagtgataagtacaagagaacaaataagaacatgaaaactgacaccctacagcttctaataagtaaagcagacaaaaaatcctctaaatcagatcaaaagcaaagaaagactgaataaatgagtgaaaataatgtaaaaaggtttttggaaatggagacatttttgaggaagtaggaagaataattagtaatttattaaattcataactttctttttaatatagaaagtgaaatttagttttgttaaagaaaaaattattcagtgatacctgctaaggcatgaggcagtgtttatttagcaccactgcaggaggtacagggaccactgcagtcgggtcttgcagtggggaatagagattggacttaactctgaatacagcatgggcaagtgagaatttgtagccagagagtaaggtgagggtcagtggatggaaaattactacgaggaaacatcaggggtcaggggcattctggctaaatttacctgataggattctcactgaagacaggccggggtgatcagacatcacctggagggtggtggaggatgagaaacccgatcagatcctgagagtgattagatatcaagggtaggaggttcttgctaaactgccttagcagggttctttgctaaaactggattttataaagaagtgcacagatggtcctaggagaaggttcaggagcctgactgaagtttggtcacacaaagaatctttgtcagtttggaaacttaaaattcttatgtcttatgggattaacagaaagataactcaatagccacttgaaattcttctgaaatttaaggataacaagaatattttgagcaagtgaagagaatgacagaccatattcacaaagatatgagcattaatagcatggaaaattaacagcaggcaaattaggatcacctgagctctactagctcagtctgaaatatcccagaagaattttataaatattacatgtggtgttttgtttttgtttttgttttcatgaagctatcagagaacaagtctgtttatttgtgaaaacttctcctttgtgaaggcactgcctaaggatgctattgggctattggggttgtgtcttttttggttttttttttggagacagggtcttgctccatcacccaggctggagtatagtggcaagattgtagctcactgcagccttgaactcctgggttcaaatgatcttcccaccttagcttcctgttagtagctgggattacaggtgcatgccatcatgcctggctaatttttttttttttttttttttttttttttggtggagacagggtctcactatgtgttacccaggctggattcgaactcctggcctcaagcagtcttcctgccatggcctcccaaagtgctgggattaccgctgtgagctgccatgcccagcctccttttacaagctatattgaagagagaagtgactgagacatcttagctggagaggaggaattgaataaacaagggatacaagtgacagagtaaaatgggctgtgaaaggaaatcagagagctgatgaaacattgcatttcaaagtgtgtcagggaaagattgagaagaagcagaaccagaacatgaattaataaggcaacatttgtacttttcttggagaatatagcaattggtagcaaaaattagaagttggatatcagatcatttattagtttgattagatttctctacaaatagtagagatccaaaataacaaagatttccaaataatgactactatgtagaaggcagaccagggctgctttgtcagctttgcagtcatctggcatttaggctgcttccagcttttgtctccatcatccccaggatccaagttggagcgccagtcatttcatctacattctaagcagcacagcaggggtggatgtgtgtaaaacaaatggcgtttagtattttttgaggatatttcttagaagcttccaggtagtacttcttgcttttcactggccataactggggttccttttactaagaaaaatcaattggatattgggataggcagatagtagtctctgctacattattgagcacctactatgtgccagacactgtgttagctccttgagataaaaggtctttgccttaaaggaacatatgatctaatagaagacttagattcatatataatgcagggttaagaactatggtcaccactgcttcttcattggtgaataattaaaaacaaacaaaaagaggccaggcacagtggctcacacctgtaatcccagcactttgggaggctggggtgggcagatcacctgagggcagtagttcaagaccagcctgaccaacatggtgaaaccccatctctactaaaaatacaaaaattagccaggggtggtggcccatgcctgtaaacccagctactcgggaggctgaggcaggagaatcacttgaacctgggaggtggaggttccagtgagctgaggtcgtgccactgcactccagcctgggtgacagagcaaaactctgaacaacaacaacaacaacaaagaactatggaaaaccaaggagaggtgcctaacccagtctgaggtgttcagagaggtcatcttgggcaatgtgtcatgaaactgagccctaaagaagggtttcctcaagcttggtatgacattttagtcagataattatttgttgtggcagccatccaagatgatcaacagataaagggaagcgcatttagttttgacttagggaatattgtgctccctgggtgacccatggttaaggcgctgtagttcttccttgactgtccagaatgtctttccttttccttagccaatgagccacccaagaaatgttactcctgggagaagcctgtgcctaactgtggtttacagaattcaaagggaagaggtagtatggaggactccttgtggcttcactcctggcccaacccagggcctcaaaaggacctaaggaacaactacgccctgttatgcctgacctatggaccctaccctcttgaccatataatggaagtcagctaagcttagtcccacctggacctagaacatggtgtttgtttcccataggtgaatatatttttgaaaaatatatttttgaaaaataagtaaaacaaaaccaaatcaggaaataatcattgagaagttacaatatgaacaccttaacaaagatgagtaacaatgtggtgttttttgctagagagttcatttccaggcaggaagtagtgtgaaacaaggtttgagagaaatgatgcggaccaggctttggagggccttatattttaagctaaagatattgaattttaagccagttgccttcagacttctcttattagtggagcaccctttttttcaagtgaaatcttgttcggaaccttggtagatgatgtacttggaagtgaagtggccctcctttaggcagcatttaattttggttggatttaacaaagaaaactgaagtgaagctcatggaattgcaaaactacaattttgtttttaaaagaaaaacattgattgtaatgtgtaaaatttacaaaactgatacacttttaattgggattatattggtttataaaaacatttagtgttttttttttttttttttgagacagagtctcgcactgtcttctgggctggagtgcaatggcatgatctcggctcactgcaacctctgcctcacgagttcaagtgactcttctgcctcagcttcctgagtagctgggattgcaggtgcgtgccaccacacccagctaattttttttttgtgtgtgtgtttttaatagagatggggtttcaccatgttagccaggatggccttgatctcctgacctcatgatccgcctgcctcggcctcccaaagtgctgggattataggcgtgagccaccgtgcctggctcaaaacatttagttttaataggcattttagggtatgtcttagtccatttgggctgctataacaaaataccacaaactgggttcttacaaacacagaagttgatttctcgcagttttggaggctgggatgtccaagatcaggcactgatggattcagcatctagtaagggcctgctgtctggttcatagatggcaccttgtgtcctcacatggtaaaggaggtgaagaatctctccctggcctcttttgtaagtgcactaataaggacacttcccaagttcccatctcctaatacagtcacattggtgattaggttttaacatgaatttggggggacacaaacattcagtccataatgaggtataaaacttagaagattcctgttttttttaaaaaaattcttttttttttttaagatttaaaatgtaagcctagttcagagtattttgccaagatgaagtgtagggcaaattggatctttaagtagagtaacctattacattgattaactactgtcaaagaaaagccaagcacatcaagggaattatggttggtacccatccagatattatacatgaattcatggttcctccttggtccttttctgaattacctgtctaatgaagaattatttcattgtttttgaaaacatccttacatttcctcattgctgaaaatcatgttttcaaacatcaaccattcatcacaatcacatacagaacctttaaaagacctaaaatttctgattcaggaggtctgggataggcccaagaacttgcgcttctaacaggtttcccggtgatgctaatgttcctggcctgatttcactttgagaaccactgcttaaaatcatgctacgttttgtttgcttcatttgtggactcagactttcttgcccctacagcctgggctgcagccacactgaaataattgtagctacaattattgccacaccatttatttaatcagttcctttgaatgtgttgtttcctgtgcctgcaacacctttctctcacttcatttcttcatctgaccaactcatggttgtatttcaagatttagttcaggtttcctttccctaaggaagatctctccaaggcccccctctgtctgggatgtacttcctatgctttcatgagacacttggcaaatggaaaagggttgatactttgaagctggctagactttgtttaaagtctttcattgacactaactggttttgtaacattgcatcaaatactatctctctccgtgtctccattttcttatctataaaacagggaagatggtgatgatggtaatgataccatccaacatctactgaacatttgttatgtgccaggcagtatgctgagctctctgtgtgccttatctcatttagtttttatatttaccctttcacactcacccataggtgccttaaacatcttaattttatagatgagggacttgaggctcccagaagttgaggagcttgtcctccgtcccacagttggaagatggtagagccaggctgtggactcaggtctttgtcttcatctatacttttagctcttgttgtatatacttacagcatttatgaagacaaactaaaacagtgtgacagtggctaagcacacgttttagagtcagacagacataggttcaaatcctagcactgtcctttattgattatgtgaccttgagtgagttatttggttttgtctagtcttggttatctcatctttcctttagttttcttatcctggaaatgggaatgataatatgttagatcccccttatctgcagatgatatgttccaagaccccagtggatgcccgaaaccccactgatggtaccgagccctatatatactatgttttttcctgtgcatatatacctgtggttaatttataaatcaagcacagtaagattaacagcagtaactaattataaagtagaacaattataacaatatgccagtattactacttttgagctttatggccatgattaagttaaacaagagttacttcaacgtaagcactgcgatactgctacagtccatctgataacagagggctactaagtgactaatggtgggtagtgagtgtacattgcatggacgtgttgaacaaagggatgatttacatcccagtctagacagagtgagacaatgttagatttcatcatgctactgagaatgacatgcaatttaaaacttatgagttgtttatttctggagtttcccatttaatgttttcagaccacagttgactgcagagaactacctgaaactgtggataaaggcttactgaaatagtatccattaaggatgataataataactatccatagggttgtcgtgaggatttagttagaatgactataaagcccttagccaagtgcctggtatataatgagaggttgaaaatgttacctgttgtctttattattataataataaggatgataataataccgattgcagatgatggtaagtagtatttatagagttgtgagaattaaattactacaaagcctttagaatagcacctggcacatagaaattgttcaaagtggtacttattagtatgttatttttattgtcgaacgcttatgcactgttcccctccctctccccatcccaaaataatgagtgtgaaacacctaggttagtagcaagtgcaccacaggcttttgttaatgttcttacacatgctcctgtaagcttgtttagggcaaaggtagtcttgaagtcatgaaatgtttgtctcaatgaagcaaagtaagcacccgatttgaatagctctagtaggaaactaacatggcaggttgggaatgctggcattacagtaacaataatctctgaaactacttggaggtgacctttgatatttcattgtcatgttttccctttttcctttgtttctttgtttagtttgcctgttggtaaactttatataaatgggatcatggtctgtgtttttttcggtcaggttctttttttttttctctggcctaacattttcttttgagatttacctgtgttgtggtatatagctatatcatcagttttaattgccaaaatactattctctggtataatatagattatttatacatttttactattgatgaacatttggattgtttttagtttggagctaaggacatttttgaaggtgtttccttcaagagtttctctaagatatacactttggattagaatagctggattatgagcagtatgcatattccacttgtttttcttttttgttttttgagatggagtctcgctctgtcgcccaggctagagtgcagtggtgcgatctcggctcactgcaagctccgcctcccgggttcacgccattctcctgcctcagcctcccaagtagctgggactacaggcgcctgccaccacacccggctatttttttgtattttttagtagagacagggtttcactgtgttaatcaggatggtctcgatctcctgacctcgtgatctacccgcctcggcctcccaaagtgctgggattacaggcttgagccaccgcgcccagccttttttttttttttttgagacggagtctcgctctgtcgcccaggctggagtgcagtggcgcgatctctgcccactgcaagctcacaccattctcctgcctcagtctcccaagtagcagggactgcaggcgcccaccaccatgcccggctaattttttgtatttttagtagagacggggtgttagccaggatgatctcgatctcctgaccttgtgatccgcccacctcggcctcccaaagtgctgggattacaggcgtgagccaccgtgcccggccagtagcttatcttttaacttcctttttaatatcttttttgtcaatgacctcactttaacagaattaagaaaaataagaaaaatcttttgatgaatttaagttttaaacttgtatttaccaatctttttctttagaattttttgtaaaaaaattcttccatactctgaggtcataaaaatagtttcccatgttttttccaaaacttaaaacaaatttcttttcatgttaatctggaatttattaatcaatatggaatttattttcttgtgtgaggtgcagattcattttcatattttttctataaagatgaccagtttcccggaaccatctatggaaatacagtcagtactttggatccatgggttccacatccatagattcaactaacctcaggtcaaaaacattcaggggggaaaaattccacagagttcccaaaattacaacttgagcttgccatgtgctgaatactacattgaatctacgtgaatgaagtgatgtgtgggcatcgttaggttaggtattataagtaatctagagatgatttaaagtataagggaagatgtatgtaggttatatgtaaatactgtgccattttatatgagagatttgggcatctgtggattttggcatttgtggggagtccagaaacctaggggattgtcctaatgacatgcagtaccagctaggttaaacatcaggtttccatgtatgcattattcttttagtgagatcgctttcttttttttttttttttttgagacagagtctcactctgttgcccacgctggagtgcagtggcacgatctcagctcactgcaacctccgcctcctgggttcaagcgattctcatgcctcaattctcccgagtagctgggactacaggcgtgtgccaccatgcctggctaattttttgtatttttagtagagacgggatttcaccgtgttaaccaggatggtctctctctcctgaccttgtgatccgcccaccctggcctcccaaagtgctgggattacaggcatgagccactgcacccagtcaagaaatccttcttcacttagtctatcctaatgccatataccactctattttaattactgcagttttagaaaatgtcttcgagttagccaggcgcggtggcttatgcctataatcccagcactttgggaggctgaggtgggcggatcacttgaggtaaggagttataccccagcctggccaacacggtgaaacgccatcattaccaaaaaataaaaattagctgggcatggtagcgggcacctttagtcccagggaatggaggcagaagttgcagtgatccaagattgtaccactgcactccagcctggttgacagagtgagactctgtttcaaaaaaaaaaaaaaaaaagaaagaaagaaaatggcttagaatctaatagggtaatctccctgcttagttcttctctaggaatgtctaggctgtttttaaaccctttggtcctccgtatatattttaaaatcaacttgcctgatttcatgaaaaatcagactaaatttacattgaacctgtaggtaatttgggggaggattgccattcttaaaatattaagccattctatccataatacagtgggcctctccttttatttaggtcgtctacaatatcctttgatggtattgtattttataatgttcttcataaaagtattgtactttatttgataagtttattattcagtaccttcttttcattggtaatgtaaatatgtgtattgtttttatttatttaagttattcatttattcttttgggatggagtctcactgtgttgcccagggtagagtgcagtggtgcgatctcagctcactgcaacctccgcctcccggattcaggagattctcctgcctcagcctcccgagtcgctgggattgcaagtgtgagccaccaagcctggctaatttttgtatttttagtagagacagggttttgccatgttttccaggctggtctcaaactactgaactcaggtgatgcactcgcctcagcctcccaaagcgttgggattataggcacaagccaccatgcccagccagatatgtgtattgtttttaaatgttcttttagttgctggtgtatataattgtaaatgacttttgtatatctatatcccgcagctttcctaatgttttgtggttttgcctaggctaggacttctaatagtagtaagcaaccttattttaaaacagttgttgttgccaggcgtggtggctcacgcctgtaatcccagcactttgggaggccaaggcgggtggatcactaggtcaggagatcgagaccatcctggctaacatggtgaaaccccgtctctactaaaaatacaaaaaattagccgggcgtggtggcgggcgcctgtagtcccagctactcgggaggctgaggcaggagaatggagtgaacccaggaggcggagcttgcagtgagcggagatcatgccatgcactccagcctgggtgacagagcgagacaacgtctcaaaaaaaaaaaaaaaaaaaaagttgtttttaagtggggacagtttgttccctaggggacatttggcaatgtctggagactttttggtcatcacagttggggaagtggaggtgatactgctggcctcaaatagaaagaggccagggtgttgctaaacatcctgcaattataggacagctactacaacaaagaatttattcagccccaaatgtcagctgtgccaaggttgagaaactgtattttaaagggaatgccttaaacaatattttattattatgcagaattccaaacacaaaaataaattggtaaacagaattcccaataccaacagttaactattgtaggccagtatttaactcctttccttcccccaacttctgctgaattattttaaaacaaatacaagatatcacatcattccatctgtaaatacttctctgtgtgtcactaaagtagaggttcccaaattatggtttcagaatacccaaaaaatccttcagaccctcccagaagatctccaaggctaaaactattttcacaatggtactaagatgttatttgaattttcattctgttgacatttgtgctgatagtgcaaaagagttgaaaattgtggatgccttagcacaaatcaaggctctggcaccaaactgtacttagtggtcattgtacttttagtactgtcaaattctcttctgcttaaaaaaaaaaccaactagatttaagtaagaatgtgattcatgaagcagtacagttttttttagtcttctacctaatggttttagtgatcattgatgaatcattgcccagacctactattttattaagtctggccaaatggtggtagtctaatttaaaatttccttctgtattcattaatgatatttttctataaagaagactgtgcttataccaactgtttagttactcctaaatatcctttgtgtaggaaatggaggaaaatgatttatttattttttcccagaacagagttcactctaaagggaatatgtttaatgaattttgttgtatttattttaatgtacattattggtatatgctgttagttttctttctctttgttgatatcttttatcaagttaaagaatttctcttctatttctagttcactaagagttttcaaagttaatggatattgtattcattttccattgctgtgtagtaagttaccccagaatttagtggctgaaaacaacaaacataaaagtttctgtgtgtcaggaatatggacacagcatagctggatcttctgcttcagagtccctcacaaggctgcatcagggctcgactggggaaggaatgatttcctagttcatgtggtatttggcaagattcagttccttctctgtcttaggtggagggccttagtttcttgctgtgtgtttctgtatatggctacttaacatggcagcaggcaaacaagaagagccagagaaagtaaagaagatggaagttacatcttttccagccttatctcagaagtgacatcctatcacttttgccatattcatgagaatcaaattcctaggcccagctaaaatcaagtagacgggattacacgaaggtaggaatatcaggagttgggaaccatcaggtgctattttagaagcagccttccagcctgccctgtggcccccaatgactcatgtctcttgcatatggccctcttaatttgccccttcctccaggtctccaaaagtctcattctgttacagcatcagctcaaagtccagaatcttgtcatctaaatcaggtccagttgtgagtgaggcttatgggtgaagtttcttttttttcttgagacagcatctcactctgttgcctaggctggagtgcagtggcgcagtcatggctcactgcagtctcaacctcctgggttcaagtgatcctcctgccccagcctcctgagtagctgggattacagttgtgtgccaccacacctggctaatttttttatttttagtggagatagggtttcgctatgttgcccaggctggtttcaaactcctgggctcagccccccaaagtgctaggattacaggtgtgagccactgcacctggccaaagtttttaaaatacagttccttgtgtacagttccattcagtctgtagaaatgtgacattaaagatacaagttatcctcccttccctatatccagtatacaagggtggaacaggcatgggataatagacattcctgtttaaaggagggaaaataggaggcacagaagtgttactagtccatatcaattctgaaatccagccaggatgttagaagttccttgattccacctctgagttattcttcctttttcatgaaaggtagcatgtgttagcagctgtgtagttttttattagtctgcttcctgccagtagaattttgggagtctagtgacctcttttcgtgttatactatttctgggtttttttggtccagcctggcagtgttgctgctgatataattttctcaaaaactttgtcagtcctttgtgaaactcactggtgttcattccattgggtaatagtcacacccacgaatctaaggtacacccttctttactttgtgatctttctcagatggctgagggacaatgttcttaagtttcctagagcccctgttgttgagtcgcgaggacctattaggcacacccttaatttctttaaagagccctttgtatgacagaattactgggaaccattttccaagtagcccaccacaaaggttgtattttgtcaaattgaaggagtcatctgactttccttaatcataagctacaaatataataagctacattaatagattttctaatatttatttaactttgaatttctggaaaaaacccaacttggtaatgatttatcatctgagctttgtttttggctttggtatgctaatttttggcttaggatttttatatctatttcatgagtgacactgacctgtaattttcccttttcttactctctatgtctgtttttttttaatatagttatgcttcccttacaaattacttttgattgtcttttccctcaattttggatcacattttcctgatgctctcatttgagtaattttggagttatattttgtgtttctaagtcctgttaaaatccttggaagaatgctgattttatttttgttttggtagactgtcaggctggttaggttctaaaccacaagttttctcacctgtgaatagtatttccagtatcagttcaaagactgtgctatgctactttgggtctttcctatccacagaccatttattagttagtttggagctttggcaacagtttatattttaatttattctcagagcctttgctgtgcttccctgaatctctcttatgtgtgagctagaagttgtgctggttcatgtgcaaaattacgggaaaccctttctctggctcatcttttcctggattccccacatctctctggctcacagaggctcctttcattgttattctagtcagacgtttggatttctttcagagctttagctgcctgcgatgcgtttctgtatggctggtgccacccttagggtgaagagctcagaaaaagtgttaaaaataatgagaatgattcttacgctccttagaccactgtggtctttcccaattatttttgcctgaaatgaggggttttgcccagagtttttgctgctcacatttgtgcatagtgtggacttatggttctaattttattctaaggatctttatatttctcagggttttttgttttgttttttgaaaaagtcttagtttcttagcaggttatttttggtttatttaattctgggttggcaataattttctcttagtgttttgaagatattattccaccatccactagttgcagtggttgctgttgaaaaacctgctgtcaataattgtcaggcctttgttatatgtcatttctctgaccactttaagctctttatcttttgtgtattttgtttttattactgtattttgtgagtaggtgtggattcctttttttgtttagcttggtaaatgctcttcttgtaaatataattttagtttctttagacaacatagggctatttaaattgtttcttaagtgagctttggtagtttgtctttcaaggaatttgttcatttcctctaagttgttgaatttatgggcataaagttgttcataatccttattatcattttcaatccatagaatctgtagtgatctgtagaaccttgcattcctgaaatcagtaatttttacttggaacgtgttgagctctttggatcagtgagttttatagtttatataaaatttggaaaattgtgtactttttttttccaaattttttttctcttctttctcctttccttcaggactccaattacacatatatgagactgttggaaatgtttccatagttcactgatttttttcaattttattttcaaaaataggctttgttttttatagcagttctggattcatggcaaacttgaacagaaagtgtagagagttcccatatatgacttatccacacacatgcactgcctcccccaatatcagtatcctactggtatatttattacaatcgatgaatttatattgacacattattataacccaaagtccatagtttacattaacgttcactcttggcattgtatattctgtgggttttgacaaatgtatactaccatatatctaccattttagtatcatacagaatattttaactgtcctaaaaatcctccgtgttccccctatttatcctttcctttttcagccccttggcaaccactgattttttattctagccatagttttgccttttccagaatgtcatggagttggaatcatacagtatgtattcttttcagattgggctctttcacttagtaatatgctctttactccatgtcgtctcatgtcttgatagtttatttctttttagcactgctgtcaatacagcttaagtatctcttatccgaaatgcttggactagaagtgtttccaattttggattattttggattttgaaatatttgcatatacctgattagatatcttgagaatgggatataagtctaaatatgaaattcatttatgtttcatattacaccttatgcacatagcctcaaggtgattttatacaatattttgaataattttgttaatgaaacaaagtctgtgttaagtatgtgtggaatttcccacttgtggagtcaatgtgaatgtcacaaaatttcgtattttggagcatttcagatttttagattagggatgctcaacgtgtacttgaatgactgtactccataataactgtggaataatctgtggaataactgttttaatgcatttggtaattctaacatctgtgttatttaaaaatgagtatttttctcattacgagttgtgtttccctgtttatttgcatgcctgataatatttggatgccagatgttgtaaattttacttttttggttgctggatattttttgtttgttttatttttgtttgctggatatttttgtagttctgcaaatattcttgagctttgttctgggatgcagttaacttacttgaccagtttgatctttggggtttttgcttttatgatttgttaggtgagtctgaagaaatacttagtctgtgcctgattattccctattactgagtcaagacctggctgagtactctactaatatccaataaattatgagtttgtccactctgggtggtaagagcaagcactattccttgttctatgtgagttctgggcacagttccctgtaaattcgttctttccatttagcacatctccagaattctctctgtatacagctctctcctctttgattctctggcctgaaaactccaaccaggactttcagctccatttctcaacttagagtctgctgggctctgcctgggacccccttcttataccacagtctggatattttctcaaggcagtaagctggggcaattatggggatcacttttttccccatttctcgggaaacagtcttcttcattgcccctaatatccagtgttttgaaaattgttgtgcaacgtatattgtctttttttttttttttttggttctttcgggttggattactttgaagcctttcatttatagatatttcaatatggtcctttgaaagataagcactctttacttttttctgaaaccttttatattatctgaactcatcacgtgtgggcagcactgtgttgctgtgttcatgaaacatttataagttatgtactagtttgctttatttcccagtatatcagttttgttcagtaacaatcatttgatagattagtgctcacctttaaattttttaaaattttgggcagctgatggctatgtgtgttatctcctatttctttatgttatcctggattcagagccatagaatactacctagattctttaggaaagtctttgtgtgcctgacattctgtttattcttttcatatatttaaaaaaatatatttaatacatgtatttttccataaaatatatgttgtcatattgggttcagatcttggctttaccacttactgactgtgggaccttgaatcagatacctaacctttgtatgcctcattttcttcatgtgtaaaatggtgatagtaatggcatttacgtcatagggttgttaataaggtttaaatgcattaataatatgtaaagagcttaggatagtatctggcatctaagtgctataaatgtgtgttagctcttattatttttaccacaactaccaccaccactgcatatattactgctagtgtccatgccaggagaaccatgtctgttccctaggtggcatatgggtgtgtgtatgtaaagatgaggtgactgtgtggtcttgtgctgctctctctgagccctccttggcctctggagtaatagtattgctgtccacctggtcaatgtgtcctgctgataagtgctgttgcagtctgtggtcagcaaatggtccagtggttctccttgcttcactggcctcaccttggctcatgctgactctgaggtttgggtgtcatattctttaagccctggacctgggcagtaagacaaatagcccttagttactgaatctctttgcctcccctggggcaaaaccctgtccttcagtgattttgctagcagaatccccacctcccttcctcttctttcattgggcatacagaaaatttgggatgccttttatgccttgtgggagccagagaactctggataactaaatccatgccctccttcctcctaacccttctatgttgatgattccgcccccacattttcattaagggtcatcttgtgtagcagtctcctcccagaaccccaaatgggagatggatcaaagatgcctgtttttttagctttttcttccatctgcctagcatgtcttttcccttttggaactctatcctggagagaggagatgagaacagacttgtgtcactgctgcttccttcccactgttctcttctcctgtcatgaagacaccagaagtctaggccgggtagactttccatttcctcttccactttcctttgggcatgatggcaggtgtgatactgggaagggggaatctgcttgctgataaggaaatgtgtgttgggagatattttaaaaaatataatccttggctgggtgcggtggctcatgcctgtaatcccagcactttgggaggccgaggtgggcagatcacctgaggtcaggagttcaagaccagcctggccaacatggtgaaaccccatctctgctaaaaatacaaaaaaattagccaggtgtggtggcatgtgcctgtagtcccagctactggggaggctgaggtactagaatcgcttgaacctgagtggtggaggttgcagtgagcccagatcgtgccactgcactccagcctgggtgacagagtgagactccatctccataaaaaaataaaaaataaaaaaataaaaaaataaaataaaatattatccttgttaaacaggttaaagggaaaaagaatattttagggtaaaggtgggggtgccagtttagatgggaattagggaaggtttctctgaggacataacacttgaacaatttcaaggctgttttgtagtattgacaaaatttaatactaggatcaagattgcttgtgcacaaagccaaaagatgggctctcttatgccctcttcttcccatactgcagttagtacattctgttttctgcagtggtaactctttctggcctaattgctcagtttctcatactagtctctgtaacacatttattctgcttatcactatagagtcctagtatgtagaggctgacaaaaacctgaggcaatatttcttcaagcaagctaccggtttcagaaccatctggaacacttaaaattgctcctctcgaacccactccagtgtcataattactaacagtttcatttggaatctgatactgttgaatttatcatattacttgaggacgagcagtttgttattgttatctttttagccacacagcattgtaaattctaagtaaatgcttgataaattgatttattaggaagctaggagagaggcatttcaagtggtttaaaaagttttgctatttgggggtgacatcagcaaaagcggcacagtaaagaagtgtaaaattttacccttccataagagcgacagaagaactggcaacacctgtcagaatcaactttttcagaactctagaaattaaccaaagacttgaaaaaaagtgtgaagagtgctcattcacaaaaaatggctgaatcttagtaagaatagtgagcttacccaagccccattccctgttccatgtgtcagctggggctgaaataacagcctgtgtttctgtactggagggagcagaacagacctcattgtaagtatttgttttgccttcttaggtggatccctggatgaatgacttcaaaaccttgtctctatttctcctgactcagaactgccctacttctgagatcggggaggacagtagttatcaagaaacatttacagacaaataatttagtcattgcttcctgaatcaagaaataacaatgggggcaaacagtagactaactaaagagcctaggagcagagattgggaatgagatgtctatgagagctttgaaaagcttcacatattcccaagaatgtagaaggccacatgcttggcaaggactgtatgcatgcccagggaagacttctacctctcgctgatcttgaggctctgtgaaagcaggaagtgaagcctaaggcagagttagaagctacctggctaagtagtgaaggtgtatcccaaacctacccagagcccttctgcaaagacagacaggttttttggttccaagcatttaaggcagtctgttcagttgttagctggccattaagctaacagaatagagactccagtgactgcacataacaaggaatacagattttacagaattagttttgataagtcttgaaacaaacaactacaacaataagcagcaacaaaaaattctggagaggggagagaatctgattcccagagttgccacattataagatttaaaatgtctagtgtttaacaaaaaagtgtaagatatgaaacacaacaagaaaaaaagccatgaatagaaattgtccctgaggaagcccagacgttagaatttctagacaaacactttatattagctatttaaaataattcttcaagagctaaagaaaaccatatcttaaacaaaacaaaacaaaacaaaaaacccaaaaacctaactgaaagtttgagaacagtgtctcaccaattgagaatatcaacaaaaagatagaaattatgaactaaaccagatagacaagcatggtaactgaaatgaaaaatttgcttctagggcccatcaggagatttgaacaggaagaagaaagaaatttgaaggtagttctattgactttatctaatttgaagaacagaaaaggaaaaaagtaattaggaaatataaatagagcctaaagagacctgtgggataccatcaagtgtaccaacatacacatgacaggaatctcagaaggagaggagagatggtggggcagaaggatatttgaagaaataatgggccaggtgcagtggctcatgcctgtaatcccagaactttgggagaccaaaacaggcaggtctcttgagcccaagagtttgagaccagcctgcgcaacagcgtgaaaccctgtctctacaaaaaatacaaaaattaaccatacgtgatgacatgtgcctgtagtcccagctactcaggaggctgaggttggaggatcacttaagcccaggaggccatggctgcagtgagctgtgattgcactactgcactgcagactggacgacagtgtggaaccctgtctcaaaaaaaaaaaaaagaaaaaagaaaaaaagggaaagggaagtgaaatagtggctaaaaccccaaatttgatggaaaagcatgcatttatgcatacaagaagctcagtaaactccaagcaggataaaaccagagattcacagctagacacatcataatcaaactgttgaaagccaaagatagaatctttaaagcggcaagagaaaagcagctcatcatgtacagggtaacctcagtaagatgaacagcagacttctcaccagtaactatggtgcccagaaggcaatgggttgatgtactcacatccctgaaaggaaaaagcccagcaaaaactaccatatctggcaaaactccccttgagaaatgaaagagaaagaagatattcctcataaaccaaaactgtgagaattgtagctagcagacctgcctacaacaaatgctaaggggaattcttccagctgaaatcaagatgcactagatggtaactcaaatctgcatgaaagaataaagaacatgggtcaagttaactacatcggttaacttagcactggcccaagctggttcccagaaaaaggagaccgtccaataatcaactgccagaggacaggaaggatgaaaccatatttttctctcctcttcactttcaggagccctgcacatttcccatatttcagtatataatttttgagtaaattagcaaggtgagatcttttcaccagtctaattctactaaaaaaaaaaaaaagtaggcttagtattattagtccatagggaatgcagtttaaaaccacagtgagatacccctctatattcaccagaatggttaatattaaatgaatggacattacagagtaatggcaaggataatgttggtaggagttaaactagtataaccatttggggaaactatatattatggctacttagcaaaacatgcctagcttataaccctacaaatccactcctacatatattcacaacataaagaagttatacactttaaaaattacactaaaagacttacagaagaatatttatagcagcactattcatagtaatagctgaaagctagaaatggatccaagtacctatcaacagggggatgtataaataaaatacattatattcatgcaattagatattactcagcaataaaaagaagcaaaccagtgatacatacaacatggttgaagctcagaaatatactaagtgtacacagccagctgcaaataagtatatactgtaggtttccatttatatgaagttcaaaagtagctaaaaccaatcttttgtgatagtagttagaatagtggttattctagggggctgactgggaggcaacacaaaagagactgttgaggggctagaaatgatcactgtcctatctaggtggtggttacatggctgtatatataaaattttgagttacacacttcagacagtgttgctgttaagatctgtgtatactccatattatgaaagataatttttaggatcttaaaaaaaatcttgattgctctgtcagtgttattgaaatcaaggatgtataatattatcaagttcaatcatcctaaaaggaaattcaattatagtttcatttttgtaactgttaaaagcattaagatataaacatgttaaacaattctcctttgagacataaacataaaaacaggtctactgatgagtctgttgattaccctattgcattttagccaatgtttaaatatttggtcatgtatgttattcttgaagtgcagaatgtgcttagggtaattattagcaacatttaaccaaattggttctgttatttcacgctggaggaccagagcaggatgagtcagtaaggggacttttgagaaatgaaatgtcagtgtttttgcaaccatttgtaggccataaaaaaaaaaaatcagatttgttcttacaaagaatgcaggactggccaaacaccaagatgttgctacacagagagaataaaacaaccagagacaaaaccacagcagaactgctttcatccccaaattgcagaataagtactgagatatgaccgagaaacaggggagagaaagggtaaacagtggaggaaagagatttttttgaccttatgctaactattaatctgaagctagaaatgctgattttatctgaaaaattagagctttccacagttattcatttattcaacaaatatttgttaaacttccattatgtacctagaatcatcctgggcgcataagatggagcagcagacaaaacaaaaattcctgcccttatggaacatatattgggggagggggtgtggcagaaatgcatacacatattgtacatgtagcaatgaggttagattagatggctactttttctctttctttccttctttccttcctttccttcctttccttccttcctttcgtcctttttttttgacagggtttccatctatcacccaggctggagtgcagtggtacagtcttggctcactgcaacctcctcctctcgggctgaagtgattctcctacctcagcctcccaagtagctgggattacaggcatgtgccaccacgcccagctaatttttatatttttagtagagatgaggttttgccatgttgcccaggctggtcttgaactcctgacctcaagtgatccacccacctcagcctctcaaagtgctgggattacaggtgtgagccactgcacccggccaaggtggctactttttaaaatatgccatagtttagccttcaactatatatgccttatggaacctccagtttaatgctgctgttgatacccctcttagattttctaatgagaccttcctcagcactttaataatgaaatctactatatgactcaaggttgatgtgtcttactcagtggcaaagaacagaataagaaatagatccaaacatatcggaatttaagacagtggaatgatatcttacagaaaggagtcagggtattgggtcctaaaatcaacacagatcaaagctgaaattaataaaatagagaaaaatagaataggataaataaaaaccaaaatcaattctttgggatggtcagtagaaatgtaaaccctttgcaatattgatgaaaataaaagtgaatatgtatcataaaggatgaggaaagagaaataatcacaactgtaaacgatttttttttttttgagacagaatcttactctgttgcccaggctggagtgcctggctcactgcaacctctgcctctcaggttcaattgattctcctgccttagcctcctgagtagctgggattacaggcacgcgccaccacgcctagctaatttttgtatttttagtagagacaggatttcaccatgttggccaggctgaactcctgacttcaggtgatccgcctgccttggcctcccaaagtgctgaggttacagggcgtgagccaccacgcccggcctataaaagacatttttaaaaaatgataggagaatacaagaaagtacatttgtaatacatttgaaagtctagaaacagtggctgatttttgaagatagatggagagcttcagtaggttgattagcaccaaagagattaaacggtgattaagagatatcatttaaaaaggaagagatgatacacaactgaattatttctaatcagtggagaacagatgagtccgatgctatttaagctattttagtagatggaaaactccccattcattttccaaagctatgatttaatgtcagaacccaatagaaattacataaaagaaaactttagattagttttcttatgcatgcagatgctaaaaccataaataaaataccagtaaatagaattcagcagtgtagcaaaaactgatcagctattatgaccaaatagtttttatttcagcaacaaaagaatagttcactactagaaaaatctgtcaacagaatgtactacatcaataaattaaaggagaaaaccatatgatcatatcattcagtgctgaaaaggctctgggtacaattcagttgtcattcataataaaagctcttaagaaggaacaggaaaaacactacctagatatagtaaagactgcactcaacatgtttttactaagcatccattatatgcccagtaatattccagcagttaacagacaaaacatttagagccatctcattttttaaaaaagaaggagttgaatgtttagtttgtcagatggtaataagcgctttgaaataagaaataaagcagggaataggaggttgccaagagctgggatgtaggaattgtcagggaaggactcattggtaaggtgatatttgagtagagaactgtaggagagcaagtcaacaaagcaggcaaaaattccagccatcatgtatcctacggtctcatggtgggggagggggcaatacaaaaaacatgataaaaacatatagcatattagaaggttatagtggaaaaaaggaaaaacagaggaaagtaaaggggaccagggcccagaggattttgaaggtcagattataaagttagtagtctcattgagaaggtgatatctgagcaaagtctcaaaggaggtgagggagttagccaagtagatattacaggaaggagtgctccaggcagagagaagagtcacagtaaagtagctatcaagagaccacgcctggcctagtcaaggacctacaaagatgtcaataggactggagtagagtgaacaagggagtgtgtgaaggtcaggttattttatgtgggaccttgtagaccactggaaggactattttaaaaattaccttaatgaatttttataaggcaaacactcttataactattacccatgttaagaaatagaaccatatcagtcagtccagaagctttttcatgtaccctatcccaaactaagtcccctcctcttctcccaaactatccactattttggcacctttagaaatcacttactctgcttctttatacttttattacccaaatgtgcatttagacattgtagcttattcttactcattaaaaataatttgacaagtcttctcttttaatcgacagatttccaagtgatccattcctttctttaccatacactattttttgaagaacccaagctatttagcctgtaaagttattcacaatctgaattttgctgattggaaaattgtgcagttttgcaatcgaactgctgattatccagcatgttcttctgaattctctacttcctgtaaattgatcgctgagcccagaggcttaatcacactcaaggtcttatttggtgaggctatatacattatgtgtggttgtcatttttcttgtgattttagcagccattgatcctcagtgcctagattcatcaatttgttgactattgtaaagtgctgatattctaattctgatctcttttctacatcttacttggaacaattttatgaagagacatatccttgcctctatattttttggttgcccagggttacagcttttcatatacaaaaagcataataaatacttgattcttttgcttttttggggccagttttcaagataatggtttggttccttttcatcttcccaagagaccaattttatatgtttctatctgttgcaattagcatttttattgagttcaaattgttccttctctggccactagatgcttctacacattgcctcctgagtacttttgctgtgacctcagttgtgtctgatagcttccttgctacctggtatgataacatctggtgtgacaagatagtacatgctcagctgagcttagtgatcagctgggactacaggtgcccgccgccacgcccggctaatttttgtatttttagtagagacggggtttcaccctgttagccaggatcatcttgatctcctgatctcgtgatctgcccgcctcagcttcccagagtgctgggattacaggcgtgagccaccgtgcctggcttgtttattttatatcagtgcaagttggtaccctttgacctacatctccccatttcctcccatttctgcccctggtaaccaccatcctactctgctttgatgtgttttacttttttagattctgcatataagtgagatcatacagtatttgtctttctgtgtctaatttatttcacttagcataatgtcctccaggtttatccatgttgttacaaatggcagtgtctcctttttaaaggctgcataatatttcattgtgagtatatattaatccatatatatgtatatatccatatccatatcgtatatgtatcaccatttctttagccattcatccctacattttaggatttttttttttcattttaggacattttcaaaggattgtaaaaattctaaaaagagaatacgcaacagattattctttggattatagagcctaaactatttgctgtctagtcttttacagaaaaaatttgctgacatacactctagtagattcttcagaaagtgtctgtgggaacaatattctctgagtttgtaactttgataacagctgctctgtgccttttatacttttacaagtcatttttcctggatgtaagattcttggcttatttttcttccatatgtatattaaatagattgttcaatttcttctgggggaaaaaagtattgatattctacaagaaaagaaaattagaagccagtatttctggtgaatatagatgcaaaaatcctcaacaaaatattaggaaacaaaattcatcagcacatttataaggatcattcaccataatcaaatgggacttatatttgggatacaaaggtgattcaaaataatgcaaattaataaatgcgatataccacatttacagaatgaaggacaaaaatcgtatgatcacctcaatagatgcagaaaaggcatttgacaaaattcagcatcttttcatgataaaaactctcaaccaaattagatacagaaggaaggtatgtcaacacaataaagactatcataagcccacagctgacatcatcctcagtggtgaaaagttgaaagcttttcctgcaagatcaggaacaagacagaatacccactctcaccccaattctttttttttttttttttctgagacatggtttcactctgttgcccaggttggaaggcagtagtgcaatcacagctcactgcacctcctcctccgggctcaagcaatccttccacctcagcctcccaagtagctgggactacaggcacataccctcatgcctggctaatttttgtatattttatagagttggggttttgccatgttgcccaggctagtcttaaactcctaggctcaagcagtccactcaccttgccctcctaaagtgctgggattacgggtgtgagccactgtgcttggccttactctcaccacttctgttcagtacagtactggagtcctagccagagcaattaagcaagagacagaaataaaaggcatccacatcagaaaggaagaaactaaattgtctctgtttgctgatgacatgatcttacatatagaaagtcctaaagactccaccaaaaattgttagaactagttaatgaattcagtaaaatttcaagatacaaagtcaacattcaaaaatcagtagtgtttctatacactaacaatgaactgtccaaaaaagaaatgatgaaaacaatctcattcacaatagctaccaaaaaaaagacttatgaataaatttaaaatttaatcaaggaggtgaaagacttgtacactaagaactataaaacactgatgaaagaaactgaacacactaataaatggaaacatatcctgtattcgtggattggaatattgtttaaatggccacactacctaaaatgatctatagatttcaatacaatccctatcaaaatttcaatgacattttcacagaaatagaaaaagcacttgtaaaatttatgtagaactacaaaaagccccaaatagtcaaagcaatcttgatagaaaagaacaaagctggatgcatcacagtatttgacttcaaaatatactgtaaagctatagtaatcagaatagcatggtactggcataaaaacagacatataaacgaatggaactgaatagagcgcccccagaaataaacccacatatttatggtcagttgatcttaagggtgccaagaatacacaatagggaaaagacagtctcttaaataatgttgggaaaactggatatccacatgagaagaatgaagttagactcttacctcacatcatatacaacaaccaactcaaaatggatcaaagttttatcttggaaaaaaaaaaattttttttttcttttgagacagggtctcactctgtcacccaggctggagtgcagtggtgtgatcttggctcactgcaacctccgccttctgggttcaagcgattctctcacctgagccttcctagtagctgggactgcaggcatgtgccaccatgcccaactaatttttgttgttgttttcttttttctttcttttcttttttttttctttggtagagacggggtttcaccatgttggccaggctggtcttgaactcctgaccttaagagacccaccttccagctgggcacggtggctgacgcctgtaatcccagcactttgggaggccgaggtgggtggatcacaaggtcaggagatcgagaccatcctggctaacacggtgaaaccccatttctactaaaaatacaaaaaattagtcaggtgtggtggtgggtgcctgtaatcccagctactcaggctgaggcaggagaatggcgtgaacccgggaggtggagcttgaagtgagcgttgagatcgcgtcactgcactccagcctgggcgacagagtgagactccgtctgaaaaaaaaaaaaagatccactcggcctctcaaagtgctgggattacaggcatgagccacctgtacctggcctcaaaatggattaaaggtttaaatgtaaaacctgaaactgtataactatcagaagaagacataagggaaaagctctgtgacattggtctgggcaatgaatttttggatttgacctcaaaagcactggcaacaaaaacaaaaatggtcatatgggattatgtcaaacaaaaaagctctgcacagtaaaggaaactatcaacagagtgaagagacaacctatagaatgggttgatatatttgcaaaccatatatctgatatggagttaatatccaaaatatataaggaactcaattcggcaagaaaacaaatctaaaaaaatgggcaaagaacctgatagacatttatcaaaagaagacatacaaatggccaacagttatatgaaaaaaatgcttagcatcgctaatcatcagagaaatgcaaattaaaactacagtgtacctcatacctgttagaatggctattataaaaaagataggccaggtgcagtggctcacacctgtaatccctgcactttgggaggccgaggtgggtggatcacgaggtcaggaggtcgagaccatgctggctaacacggtgaaaccccatctctactaaaaatacaaaaaattagccaggtgtggtggcgggtgcctgtagtcccagctacttgggaggctgaggcaggagaatggcgtgaacccgggaggcagagcttgcagtaagccaagattgagccactgcactccagcctgggtgacagagcgagactccgtctcaaagaaaaaataaaaaaaaataaaaaaagataacaagtgttggcaaagatgtggagaaaagggagacctatacactgttggtgagactgtaacttggtacagccgttatggaaaacaacatggaggttcctcaaaaaattgaaaatagagctaccatatgatccagcaatcccactaccaggtatgtacccaaaggaattgaaatcagaatgtggtagatatacctgcactcacatgttcattacagcactattcacaatagccaagatatcaacccaagcatccattcacagatgaatggataaaaagaaaatgcggcatacatacacaatggaatactatttagcctttaaaaggaggaaatcttgtcatttgcaacatcgttaataaacctgtagaacattattgtaaatgaaataagccaggcatggaaagacaaatacttgggatcttatttctatgtagaacctaaaaaagtcaaattcatagaagcaagagtagaatggtggttaccagggcctggaggttagaggagtggggattagagatgttggattaaaggatataaaatttcatttagacaggaaaaataagttcaagagatgtatactgtggtgactatagttaataacagtgtattctatacttgaaaattgctgagactagattttaaatgttctcatgacaaaaaagtgattatgtgaggtaatgcacatgttaattagcttgattgagccatttcaccatgtatacatattttaaaacatgttatatattcagttttcatcagtttaaaaaacttaatttaaaaaaaaaaagttttgatgttgaaaagtctgatctaattttcttctcctataggtaatttggatacctatactttgcctagatactcaaatattttttctttaaagtgcaataattttaatatgttttgttggtcatcatatagcagatattctcagatataccatgtgttctgtcaatatatagattaaaaaaactttttaaaaataatgttttcttaaattttggtttttagtatttgctgtgttccctttgattctcttcttcaaagactcctatttttcattaaagactttttttgcctgttaatatttttcactttcttttgaattgttttatttcttcttaaattttaaaaacatttcatatatatatatatatgtatttttttgaggcagagcctcactttgtctcccaggctggagtgcagtggtgtgatctcggctcattgcaacctctgcctcctgggttcaagtgattctcctgcgtcagcctctcaagtagctgcgagtacaggcatgtgccatcatgcctggctaatatcttctattttcaattagtttaaattggaaagcttttaaatctttgaaggcattctatttcacttataatttcttttaagattctcttgtatttattaactcttgtcttccttctagtttagtttatttttgtaatgatttttccttccatttctaaattcctgagctctatcaccttatttctaatatgatttatgtatcattttctcagtgtcttttagcttgttttaaaatagtaagttacaattttaatgttttgtgggcatgtctttttttctctataggaatgttcttcttcttctctgttttcttttaacaactctttatggtatttgaccaaatacttttttgtcactcatttttactgaaaaacagttttctcaagcttttgggaggaggaatagttcaagctgtctttattaatttcatagctctccatctcctgttttttggttttgttctggtaaagcgttaaataatatggtggcttgctttctgagacttcctgactccatagcctcccctcgcttgtatcggggccttctctttcctttgtctctgtcaccattgtaattagcccaattctgattctcctcccagaagtttctaattgcgatgtcctgtcctggaaaggagctttggctggttggtttcaagttcatgtttcccatctttctctggcccctttgagaacctaccagtggcccttatagtcactttttggtttgatgaaacccttcccaatttcaactggtgttctcaaatagatctgctctgatttttagagtttggtttatggctgctgtggtgtttcccattctcagttttcagatgcgttgttgcttctttttctttcaccacattaacattcattccatgaggggattgtggttactgttggttgtctccacgaacttgtattttggagtttgtgagctactttgtcatctagttttgttgtccatggtgttttagttttgttattggattactttgcatgtttttagggaatgatttggtgagatgaaaactattcagaatagttttttctatttggatgatctcatcaaatcatcccctaaatctatacaaatcaggaaatctattcaaataggaaaaactattctgtgattactcagattccctctcatttccagtgcctagtcactctgagtgactagggagtcattgcaggattttgagcaatggagtgacatgacctgactggtgttttaaaggctctgtctggtgatagactgagaatagaccatagaaatgtagaggaagaagtagggggacctattagaagaatgttgcagaaataggctgggtggatcacttgaggtcaggagtttgagaccagcctggccaacatggcgaaaccctgtctctactaaaaatacaaaaattagctgggtgtggtagtgggtgcctgtaatcccagctactcaggaggctgaggctggagaattgcttgagcccatgaggtggacgttgcagtgtgctgagattgtgccactgcactccagcctgggcaacaagaatgtgactccatctcaaaaaaaaaaaaaaaaaaaaaaaaaaaaattgcagaaatccaggtgagagatgtttgcttggacttggggagcagcagtggagttaatgagaagtggccagatttgcatatattttgaggtatagttgataagatttcctgatggatttgatgtgaagtatgagagaatgtagttgaaaaataactctggttttgtcctgagcaactgtaagaatggagttgcttttaactgagattagaaggctgaggctgccgtgcgggtaaggtagactttaggggtgacataaagagctcagtttggactatgttgagcttgagatagttattagacttctgagtgaagatactcttcgtgattctgcgagtcccatgacagcatgaggtaaaaaaagaaagacattgggccgggcgcagtggctcacgcctgtaatcccagcactttgggaggtcgaggtgggcggatcacgaggtcaggagattgagaccatcctagctaacacggtgaaaccccatttctactaaatatacaaaaaagtagctgggcttggtggcgggcgcctgtagtcccagctactgggaggctgaggcaggagaatggcgtgaacctgggaggcggagcttgcagggagccgagatcgcaccactgcactccagcccactgcactccagcctgggtggcagaacgagattccgtctcaaaaaaaaaaaaagtttatcatagaaaattggaaaatatggataagttaggtaagaaaataaaaatcatgctgcattgtaaacattctgatatgattctaaacatacatataacatgcatttagaacacatcgcttttttctttccaacttttaggttcagggagtacatgcacaggtttgctaccggtaaattgtctgtcacgggggtttggtgtacagattgtttcatcacccaggtaataagcatagtactctatgggtagtttttcgatcctcaccttcctcccaccctcgacccttaagtaggcccaagcgtctgttgttcccctttgtatctatgtgtgctcagtgcttagctagcacttataagtgagaacatgcagtatttggttttctgttcatgtattaattcgcttaggataatggcctccaactccatccatgttgctgcaaaggacactatttcatttttttatagctgtgtagtattccatggtgtatatctaccacattttcatcatccagtccactgttgtgggcatttaggttggttccatgtcttagctattgtgaacagtgttgcgatgaacatacagttacatgtgtctttatagtagaacgatttatattcctgtgggtatatatccagtaagggggttactgggtctaatggtagttctgagttctttgagaaatcttcgaactgctgtccacagtggctaaactaatttacattcccaccagcagatataagcatactcttttctttgttttgttttgttttaaaactaaagcttattctggccaatttactctactattttctaataacagctcatagatcagaaacggtctttgttttaaactttcctatccatatgaaacacaatgatgttggggtaagaggggccttttctctaaatgaaaatacaatacttattctgtataattctagagggcccagagatgtggaaataatgtatttgtaagaattatattaaacaatctttatttgataaatagtaccttacaatcctaatgctatctatcaagcttcagtaagagcaatttcagcatcaagtaatgaacagtagctaaactgacaagagatcaatcaaaagggctttaaatggagcagcaccagctgatgtgctgctaaggctctgggcattcaggactctcctatggggaaaacggaatcaaaccagcaggtgctctggacctaagccttcacatcgtgacctgcctccctcctgggggtgtggtggcccacagtccccctggcatttctcggcccttgtgggctgcagacggaaatcctggcaccaaaggacagcttgggaaaggctgaaacttgacctcacagtcagctggcttctgcctattgtggtcattttctttccagagcacctagagcactcgcacagtggacgtggaagccacccagcattcttgggctgttttctcatagaagaggaccttcctctaagcattggaagcgtctttctccaattcctgggccagatcttgggccatcttcttgtaggtcatgggtctgacacacatggttcaagttttcgtggctattgtgaatgggattgtgtttttgatttagctctcagctcggatattgttggtgtatggaaatgctatttttgtacaatgattttgtatcctgaaactttactgaagttgtttatcagatctagaagcttttgggcagagactgtggggttttctaggtataaagtcatatcgtctgcaaatatggaagatagttgacttccactcttcctggatgcctttatttttcttactactctatctaggacttccagtactgtgttgagtaggagtggtgagagagggcatcctggtcttattctggttctcaatgggaatacttccagtatggtatgcttccagcagcacatcaactggtgctgctccctttaaagcacttttgattgatttcttgttagtttagctattgttcattacttgatgctgaaattgctcttattgaagtttgatagatagcattagaattgtaaggtactatttatcaaataaagattgtttaatataattcttacaaatacataatttccacatctgtgggccctccagaacatttcagcatgttctggatgttggctgtgggtttgtcatagatatcacttattgttttgaggtatgttccttcgatgcctagcttgttgagagtttttaacatgaagggatgctgaattttattgaaagcattttctgtgtctatcgagatgatcatgtagtttttgtctttagttctgtttatgtgatgaatcacatttattggtttgtgtatgttgaacccaccttgcatcccagggataaagcctacttgattgtggtggattagcttttgatgtgcttctagtctctgtttcctagtatttttgttgaggatttttgcatctgtgttcatcagggatattggcctgaagttttctttttttgttgtatctctgataggttttggtgtcagaatgatgctgacctcatagaataagttggcaaggagtccctcttcctgaatttttgggaatagtttcagtaggtttggtacaaggtcttctttatacatctgatagagtttggttatgaatccctcctgtctagggctttttctggttggtaggttttttagtactaattcaatttaggaactcattattggtctgtagaacacattttcacaaagttgaatttctattgtatatacattttaaaatcttctttcacaagacatgacctgagcattttctaatagtgaaagtctttgaaaacatggtttttaatggtatttcattacatgttttactgtaataaacctaaccacttggattatgtactctttcactcattcctttttgcatatctgttccatcccctatgctttaatatggaggatttggtttcttgtagtagttgctgggtatcataattcagacctgtggtttggcagtcagcctggctgtagtgtttaactgagtctcgtggaagatccatgcttaaaatgaatgtcgtggagaattgtattcacctcagtcattcaagactttggcatagaccccattccttgaggaggagttgccgccactgtgactgccacagacggaaggaagcctgggcagttgggactggggagaacttgctgagtcacagatatcttgtctcagtgtgcatgggccgtgtgtattgaaatgtaccagtctgtgaggcactatgttttgaggtctcagtaagctaaaggggtgtagaatggtatctagttcataccgtagtatgctttagatctaagtgttggttaattctgtaaggactgaaggaataggggagatttaatgagctccttgcagtctgcaggttattatcgagaaaagaaaattaggctctcagttccaggcccatttccctctaatcactgtgtccttttgaacaaaagttggcaaactttttctgtaaagggccagatatttttagctttgcaggccatatgatttctgttgtaagcattgagctcttctgttatagagcaaaagcagccataggcagtacaggaacaaatggccatggttatgttctagtaaaactttatttacataacaggcagcaggccagattggagcaatagttgtcaactcctgctttgaaaatgttttggaaactgtgtctccgtctgttagtggtcattatcctcagtctcttaggatcagagtttttcttagattacaaaactggatcatacagacctgacttccaggtctgcgttctctccactacactttgctgcctcttagaaaaacataagctaaataactagaacccatggaaagagggaaaagtgaagcccagagagctgatgcgggactaagaggcaactctgagagtttcaatgtggaatgtttgtgtggctccccaaccagaccgtgacctccttgaagattgggactgcatcgtatcttgttctcattttctattttattttaatgatctatcctttgggttgaacgaatgtgtttcttgaacccgataagtgcaacactgagtaaacacttgtttcttttctcccttccatcctcccaacttagtagcttcaatacattcttagctctcctcacttgctattctctaaccataccacgtggctgggcacggtggctcatgcctgtagtcccagcactttgggaagccgaggtgggcagatcacctgaggtcaggagttcaagaccagcctggccaatgtggcaaaaccccactaaaaatacaaaaattaactgggtatggtggtggcctgtaatccccagctactcaggaggctgaggcaggagaatcgcttgaacccaggaggcagaggttatagtgtgctgagattgcgtcactgcactccagcctgggtgacagagcaagagtccgtctcaaaaaacaaaaacaaaaaaaaccccaggttatctccatgaatgtgaatattgatgtggtccttctgtcaggaagacatcacctgagaccacacacagaaagcctatttttccttaggatacagtcctacatcagggttgacaaagtttttttgtaagggttagatagtaaatattttagattttgcaagccatatggtctcttcctcagctactcaactctgccgttgtactacaagagcagccatagacaatctatacatgaatgagtgtggctgtgttccagtaaactttacttatggatattgatactcagatttcacatgattttcatgtgtaatgaaatgtgattatttttatttaaaacattaaaaatgtaaaagccattttttgcttgcaggccagacaaaaacaggcagtgtgagtcaatttaatttaatgtgtgactcatagatgctaacccttgccttagctgcttagtaacttgccctagtcatgtgttaccccatgaaaagaatggcctacttctgtcatattgtctctaacctctgtcatttcatttatgatgctatgtattatgtgtacctttgtctctcttgctggattctgagtatcttgagaggtaggccatggcctagtcagtcatctttgtatccttaatatcaaacccacatagtgggtatttaagaagtgactgttgaatttgaattttatgcttgatatatataaaatgtcatttctgctgatcttaaagagaaacacttgactgatatgcataggtttcccatgttcttccccttgagaggccatagttaactgcatttgctgctagcggctcttgtaaactcagtggttatacagcaaagcctttgcaaagtcttttattttagagctctttttcagacaagaaatgattatactttttcttcaaatcatttattcaatcataatgataaatatggctttcactattctgatgaagcagagctaccatcagtgtgaaataataatagccgttgtttagtgagcatctactacattccagtcaattcagattttttctctagatttttggtgaccttctgattactattaatttacattttttttattgttctctacatgtcaaacaaaacaaagcaacaatatcaaaaacccacatgctttttcttcatactgtctatattattgaatgacagacaaacatctgtccttcaagtcaaatattaattaatcatagactcctttctctttttcttcaccccgccttatctaattggccactgtcttagcttttttttttttttttttttttaaagatggagtcttaccctgttgcctagtctggagtgcagtggtgtgatctcggttcaccgcaacctccatctcctgggttcaagcaattctcctgcctcagcctcccaagtagctgggattacagacatgcaccaccacacctggctaatttttgtatttttagtagagatgggatttcgccatgttggccaggatggtctcgaactcctgacctcaaataatccacccactttggtctcccagtgtcttagcagttttaaaaattatctttggaatttgtctcatctctatttctaattcatttaatctaattgaagccttaatcatttcttttcttccaacatgttgagcatctgttctgattttcctgaccccacttgcctcattctccaattattcttcccatagttatcagcactgaatgctaataataatactttgttcatatcagttgttattaaaactcttcacttattccttattatcttcaaggtaagcccagcttcccagtcatgacatacaagactctatgtgtgaccccaatacttaacacagatgtgtttcagaattcagaattttttggattttagaaaagtaatacagtttatgcaatacatatataacatcctctgctcattcctgaacactgatgggagtgaatggcaggtgcttttaataattacgctgaggtaaattatgctaggtgtaaactggacctgtcctgggcaaacgaggatgttctttacacagtttaagaatgtcaagcaaagaacattagggatgaagcaatacagggagaatagatagagtgaagggagcagtgggttaagtggagtcctggagaaatatttgaaaagggagaaaggaatgtggctcctgaggtaggagggaaacctggagcaggtagccccacagaagcccagggaagaggcattgtttttctattattttggaagcagatcccctttaggagactcctcatcagataatgattattcactaagaggttatattcttaattaaaagggcctttaccttttcttagaatactatgtttgaataactttttatgtattacgatataaaagtctcttttaagcatttctgttttatagtcatttggccaaaatctaattcagatccagcttaaatccaaatgtcatttgatgctacattttatcctgaggttgctagttatttagtcaaatatagtgagtataatcactacaggcttagagtaaatttccatgtcaagaggtagaacacatttattctgtaatattgaatcctgtaatattgaaaatcaaaaacagcccttttttttcttctgtagaaaataagatttttaaggaaggcagcaggaaaatagaacaagtgaatattttacgttcttagtggtttatggttggcagttttcccccaacattttgttacgaaaagttaaaatgtacagaagaattgaaagacttatacccaccagctagattgtgccattaacatgttgctgtatttactttatcactgtccatctctctgaccatctatttgtccctctttccatccatcagtctgtcttttttttggtaagcatttcaagtaagttgactgacaatttttctaagcagctgtatctttattttgttactgtttttttcctggatgttgtaattacagtgtcaagacatttaataatgcacatgtttcagctaacccttttcccaatttctagaaatctgagattgccaataatccctgtcaatcttaaattattttttaattctggtaaatagtgtcaaacctgattagtgccctctttctcaattgttttgtaatccagacaactgttagtcattaaaacataatttatagtggttttaaagcatgattttctaaaaaattttaaataaatatttattcatattatgttgttttcagagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggtaagtgagattttttaaagcaactgagaaaactagattttgaatttgggatctgaatacgtttttttcttattttatttcttgctatttaatgatcagaaaaatatattttttttttttttcatttatttttattttattttattttattttttttattatactctaagttttagggtacatgtgcacattgtgcaggttagttacatatgtatacatgtgccatgctggtgcgctgcacccactaatgtgtcatctagcattaggtatatctcccaatactatccctcccccctcccccaaccccaccacagtccccagagtgtgatattccccttcctgtgtccatgtgatctcattgttcaattcccacctatgagtgagaatatgcggtgtttggttttttgttcttgcaatagtttactgagaatgatggtttccagtttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctacctggtgtgagatgatatctcatagtggttttgatttgcatttctctgatggccagtgatgatgagcatttcttcatggttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggatgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcagtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctggattacatttattgatttgtgtatattgaaccagccttgcatcccagggatgaagcccacctgatcatggtggataagctttttgatgtgctgctggattcagtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatattgacagtggggtgttaaagtcttccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaccttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaatacactgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccgtgggcgtaggaccctctgagccaggtgtgggatatagtctcgtggtgcgccgtttcttaagccagtctgaaaagcgcaatatttgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctcccccagaaaaatattttgaattagaaaaatttgggcctagtggcctggcacgctggctcatgcctgtaatcccagcactttgggaggtcgaggcgggtggatcacaaggtcaggagatcgagaccatcctggctaacacggtgaaaccccttctctactaaatacacaaaaaattagccaggcgtggtggtgggcgcctgtagtcccagctacttgggaggctgtggcaggagaatggcatgaacccgggaggcagagcttgcagtgagtagagatcacgccactgcactccagcctggatgacagagcgagactccatctcaaaaaaaaaaaagaaaaacttgggcccagcatagggctgacacctgtagtttcagcactttggaaggccgagatgcgagtgagcccaggatttcaagactagcctgggcaacatagtgagacccccatctctacaaagaatataaaaattatccaggcatggtggcacatgactctagtcccagctacttgggaggctgaggtgggaggattgattgagcctgagaggtcaaggctgcagtgagctgagagtatgccactgtactgtagcctgggtgacagagcaagaccccgtctcaaaataagaaaaaagaatgaagaaaaattatatttgtagaatgctttcttatcagcagtcttccactgcattttaaggataactggctcgttggggatagttcttagggtattttgctcagtttctaggaatgatactcactgttgggagatttattctcagccaattactgcagatctgcataaacaccataattattagtgaccttacttctgatttctttctttctgtaaatctaatagccactttacttttaaacctttgtttagatgaggcataatttttggatacctaaaagctaaacattggttacactagaaaaattattaaacactagccttctgattaagagaaagttgctattaaagtgacattacagtttttattttaataagttatgctcacgtctttacaatatattatttcagaaagtgctgaaaattcagagctagattatatagcctaccagttgagtctatttcaaatcagatcttatacattcttttctttattgcagtaagatatatttaacataaaatttaccactctgacactttttaaagtgcacaattcagtggcattaaatacattcacattgttgtgcaactgtcaccaccgtccatctccagaacattttttgtcttcccaaactgaaattctgtacccatactcttcattgcctggtccctgtcaactgcagttttttgtgtcacttgtatatattcttttttgaaactacatttcaaataagacaaccatgctagcataagttcactgataggctatttgattccaaggtgaaaattccttggctttgtctgatattctcttgtttatatcagtgtccttccctccctacaaccatataaccgtatcatgtttttattctgtcttttgataactttaattgacaaatttatgccacatttatttcatgagattaatttctatgtgaattcctttctcttaggtattacttttatttccccttttcaattcattattagcagctatatgggaagagctgccttcttgtaaaccatcacatatgagggcaaattaaaaaaaacaataatcgctatcctctttacactttttatatatatataaatatttccattataaaaatataagctcattatatgaaacttacaaaattcaaaggataagagaataaaaatcacctgtaatgttcccacctagacacatacacatattattcttttttattttcttatttatttacacatattattcttaatattttgatgtattttctctcctctgcattatgttaaacaaaggtaagattacgtatatcatcttacctttatatacacagttttgtatccagtccttttaatattcacgagcattttcccattgtgtgcatgctttttaaacataatttttatagttataaaccttcatagaagccaccttaaattctttctgaagcacagtagtaaatgaatgaataaatcaacaaacaaaatacatttccctggtagatgttctacaattgattttaccattttgttgtttaccgttttctctttgacaaattgtgctgcagtgaacatctttgcagatactcaattttaggattttttttttaaggtaggatcaataaaaatagaactaaaccagggtaaagtatctgagatttttaaaaggtgtttgatatctattgatactaaaaaacctttgggctggccacagtggctcacgcctgtaatcccagcattttgggaggctgaggtgggtggatcacttgagctcaggagttcaagaccagcctggacaatgtggcaaaaccccatctctacaaaaaatacaaaagttagccaggtgtggtggcacatgcctctggtttcagctgcttgggaggctgaggtgagaggattgcttgagcccagaattttgaggttacagtgagctgagattgtgccactgcactccagcctgggtgatggagcgagatcctgtctcaagaaaacaaaaacaaaaaacaaacaaacaaaaaacctttgaactgccagcataattgaggtaatttattttagatttttgttggttttaatagatttcattgattaatgtaattgaacattttccagttattagctatatgtatatattcttttatgaactaagtttttactttatttatttgagacagagtcttgctctgttggcacaatcttggcttactgcaacctgtgtctcctgggttcaagtgatgattctcttgcctcaggtgggattataggcacatgctaccacgcctggctaattttttttaattttttatttttagtaaagttagggtttcgttgtgttggcctggctgatctcaaactcctgacctcaagtgatctacctgccttggcctcccaaagtgctaggattacatgagccactctttaaagttttatatgtattaaagttttgtgagctctttgtaattggtaattcatagctatctcctttgcacaatagtgaaagggttttttattaccaagatacatgtacaatgctattttgagggttcttaggcagtagacattatagttttcctacatgcaaattggcttggctagattatcctttgctttcttgagtggtgggttgggaagaatgctatggtttgaatccatgtgactaaagaatctatttcatacacacttgtggtttttgaaaggatttcaaaatacccactgaaattaaaaaacacccacccttcccccccccctcccccaccgtctctgcctatctttaaagtgacagataattttgaggaagaaaagatgaagtgtgaactatagtggtgtttttgggccttttgtggtaatgcatacaaactgacagtcttgtcttgtgagggtaggtttcataagacctttttgcaaactaaatcctgtgtatcttcaaagcttttttgcctgtaataagtcagatgctaatgtatccagcactgatgatcatgaggtttttgtaaagcagtgcttgaaaagagattgttgaccgttagctatgatatgagatgggccccagagaaagaggtggctggcgaaggtgttttccttagttatggggtgagagtgggagaaaaataacattttgactgagaatataggatttatatctctaagcctaaaaatactgggttggtttttttttttttttttttttggtacaattctgggtagtctgcaagtaatattgagtcagcacattttagggacatattacccaatattgaatggataatcatgcttcatggttactgtgactcacatagtaaattggtaatgaaacgttaacatattttataccctgtcccaccatagtctctaatcctaaaattatagtatatttcagtaaatggtgctgtctaggttacatcgtcagccttcttgcatagattcttaaccttttagacttaggaacttatttgagaatttgatgaatcctgtggatccccacctcagaaatacagacacatgaatacacagatttcactcacaatttcagtggatacatagatataccagaagtccatcagattaaggactcctattagccacaatttcagtggatgcatgtgtgccagaagcctgacagattaaggactcctattttatagtctccttgctcaagctcatccactcatagggctttcattacagcctatttgctgattatcataaatctgtatttcctagtgggtctctttcctgagccctaggttcattatttccaactgtcttctgtatgtgtccaccgaaatgctctcaaggacctcaaattcaaagtccaaaattgaatttattttctaaacttgttccctgagaggcagaagctaggtggaattgttcattaaactgagcaggaatccaccttgagagtggggatgatgctgtgctcatctatacttgcggtacctatgagccagagagcagatttgaggaacagagtcctcagggcacatggctcaaaccccaaaacaattcaagaacctggttgctaaagttagagagctgaaaagcagatccaatttatgaatggaatatttagttggaaacctgagtagatagtactgaggaagagcaagtgatcaaatggaaaagcatgtaccaaggtgcagaacccacagtaacagacaagaagaaacatgaaaatgaagtcagctgggggacaggggttagattaaatccctaaaccaaacaacaaaaagctgcagcagcagttggaattgatattcttacattaaaggtaaagcctggaatgaatgcatacttgtgttttctggttcctatactcagcaaaaactgcttgttcctgtttttttctatctccatacatagcatgcttattcacccagttacccaaattaggtctcctcacttaaaattcatgaatgactccactgttactacaggatagagtctagacttcttagaatgacatttacttttctagtatttgggtattttctcattatctttttgttgttgatttctaatgtgaccattatggtcagagaacactcattatggtttgtttcagtcctttgaaatatattgaatattgttttatggccagtatatggtcttatgtgatcagttgaaaaaatatgtattctgtgattgttgcagagttctgtaaatatcagtgaggtcaagaaattttatagtgttgttacagtctaaatcttatttgattttttggtctgctttattaatgttgggaaaattatgaatttttcaaattttccttacatttctagcaattttgtttcatgtatttaggatctatattattgggaacacacccatttagaccttcttgaagaagtaactcttttgtaattatgaaatatttctctttatctctgctgttaccctctgaaagtctactttatctgatatgaatatagccacaacagtgtttttatgtatactatatacatggtatattttcccgattcttttacttttaatctgtgtctttatatagctggctttgtttgttaatccagttttatagtctctgccttttaaatggagagttaatccacttacatttaatgtaattattcatctgattggatttaaaactaccatcttgctatttgttttttatttggatcatctatttttgtttctttgtttctcttttcctgccttcttttggattaatcttttttggtattccattttatatattatctcctctttttagctatacctcttctttttgttttgtttttgcttatagtggttactgtaagacatgggctgcacattttttatattgtaaaaatccagatagtaggccgggtgcagtggctcacacctgtaatcccagcactttgggaggctgaggcaggtggatcacaaggtcaggagatcgagaccatcctggctaacatggtgaaacccccgtctctactaaaaatacaaaaagaattagctgggcttggttgtgggcacctgtagtcccagctacttgggaggctgaggcaggagaatggcatgaacctgggaggtggagcttgcagtgagctgtgatcactccactgcactccagcctgggcaacagagcgagacaccgtctcaaaaaaaaaaaaaaatccagatagtaaatatattatgctttgtgggccacagttgggctctttgttctttacttgaagatccagattttcatctggcatcatttctctttagcctgatgcacttcctttagcagttcttatagtaaagacatgttgactactaatgctcttaggtttttttttttttttttaatttgaaaatgtgtttgttttttttttaatttgagaatattttgctggacatagagttctaggctattggtcgttttgtattttttttaactttcaacattaaaaagatactattttattggcttcccatgtttttgatgaaagtcagctgacattcttatgaatgtaattttttttctttgactgctataagatttttccctatttttggttttcagcagtttgattataatataccaaattcgtagctccgttctactgccatctcctgtgtgggcctcagttttgattagtttttattagcctacctttgaattcattgatcccttctttttctgtgtccagtctgctgttaaacccatctggtgacttcttcatttcagatcatttatttttcagttctagaatttccctttctctgctggaattctttgctctttacccattctgttgatcttttcctctaaattatttaacatattcataataacttttaaagtcttcatccacggatctctccctgttgactttgtttctttattatgggttataggcacaccttggagagactgtgggtttggttccagaccaccaaaataaagtgaatatcccaataaagcaagtcacacataatttggtttcccagtacatataaaagttatacactacattgtagtctgttcagtctgtagtagcattgtgtcaaaagaaaacacaatgcatatgccttaatttaaaatactttattgctaaaaaaaaaatgctagcaatcatccaagccttcagcaagtcataatcattttgctggtggagactcttacctccatgttgatgactgctagaccattcagggtggtggttgctaaagattggggtgactatagcaatttgttttgttatgtaatattctatatcctttgctgtcttttcaacaatattcacagcatcttcaccaggagtagattccatctcaagaaccactttctctgctcattcttaagaagcaactcattcattcaagttcaatcataagattgtagcaattcaaccacatcttcaggctcacttctagttatagttcttttgctatttctaccacatctgcagttccttcctccactgaagtcttgaacctctcaatgtcatctgtctgattcttccaaattcctgttaacattgaaattttgacctcctcccatgaattacgaatgttcttaatggcatctaaaatgatgaaccctttccagaaggtttgcagttgactttgtgcaaatccatcagaggagttggtatctatggcagctatagtcttaagaaatgtatttcttaaataataatcttgacagggccaggtgcagtgtcttaaacctgtaatcccagcactttgggaggccaaggtggatggatcacctgaggtcaggagttcaagaccagcctggccaacatggcgaaactccatctctactaaaaatacaaaaattagctgggtgtggtggcgcatgtgtgtaatcccagccactcaagaggctgaggcaagagaatcgcttgaaccggggagggagaggttgcagtgagccaagattatgccactgcactccagcctgggtgacagagcgagactccatctcaaaaaaaaaaacaaaaaacaaaaccaacttgacagtagaaattactccttgatccatggactacagaatggatactgtgttagcaagcatgaaaacagcattcatctccttgtatatctctatcagaactcatgggtgacaaggtgcattgtcaacgagcaatagtattttgtgagaaatcttttttcctaagcaataggtctcaacagtgggctgaaaattgcatttttatgttatggagatagcttctttccttaatcttcataaacaaacaacctctactagcctccaacttttcctctcacagcctttataaaattgaagagaattagggccttgctctggattaggctttggcttaagggaatgtcatggctggctttatctgtctagtccactaaaacttttgccatgtctacagtaagactctcactttcttaccacttgtgtgttcattggagtagcacttgaatttacttcaagaacttttcctttgtattcacaacttgactatttgatggaagaggcctggctttcagcttatcttggctttcaacataccttcctcactaagcttgattgtttctagcttctgacttaaagtgagagatatgcgactattcctttcatttggacacttagagcccattgttggattattaatcggccttttttcaatatcaatgtgtcacaggaacagggaggcccaaggagagggagagagatgggggaacaaacagccagttggtgtagcagtcagaacatacacaacattgattaagttaattatgttatatgggcttaggatcgtggcaccccaaaacaattacatggtaacatcaaagatctctgatcgcacatcaccgtaacagatacaataatgaagaagcttcaaatattgcaagaattaccacagtgtcataaagagacatgaagggagtgcatgttgttggaaaaatgtcaccaacagacttgctcaccacaggattaccacacaccttcaatttgtaaaaaacacaacatctgcaaagcacaatgaaatgaggtatgcctgtactcatttgcttcttcacatgtcttagaagttttaactgcatactggaccttttgtataacagaggggtagagaatgaactaggtaatactttttgttttatttttgttaaagagagcagttctttcctccagcaggtagctaaggtgatcactcaaatttgacagtgaatcaagctgagctggggctgagcagtagctttaattgatttcagtttgcctctggattcaaatgagattaaggaaatttgacttttagcccaaccttagctttctatatcatttagacgaggggttcatttctttgattttagcaagattgcagctgggaggcagttgggttgaagattaaattaatttactttacctctggattgcaactatagcagggccctggaacccaagcaccacacagcattgggagatctctttctgtctctcactgtgctcccaccagcacttactaagattctcttgtagtattacatgtaattgtcaggtcaagagatttgtttttacacttgggactctttcagattctaattaatcataccagtccacagtctcactaaaagtttggcttgtttcagcaaaatctttccacctatgggagacctccttttctgcccacttgtacccagacaggcaattgattcaaggtagctagaaacaggcttttgtttctctgtgaagaactcatccttctccagaaattggctcagttagacttcttggcattcatttactgctttttcatggctttacagaaaagtatgaagtttagtttatctggtgttttcttgttttgatgagagcagtggtcttttgggatcagctgcattcaaaccaggttggaatgctttagaatgatggcattaagattctttgccttctgctttcaaccttccttttcaacctcatctctttttattcttttaaccacaccacagtgcctccctttcattcccacagcacattgtatacctccatacctttgttccttctgccttgattgtccttcttctcatcttacaactttgtcctttaaaactcaactcacatgacacctcttctgtgccacagatcctcctgctacaatgtacctacctttacttgtgtactttcacattatattgtgatgatttatattatatgctgctgcttttaaactaaggacatgccagacatgccttcatctgaaaatgttaatatagttcaaagtgttgctatagtctttgtttagttaaagtaacaactttctggtctgaaaaaaaaaagactatgcatcccttcaacagaataagatagttttaaaagtaatgatatgggagcatctcttaagatatggtcagtgttatgttttaccatttgtatttagaaaaacagctgtgtgtgtatgtatgtatgtatgtatgtattaatttattttgaaacggagtctcattctgtcacccaggctggagttcagtggtgcgatctctgctcactgcaacccccgcctcctgggttcaagcaattctcccacctcagcccctagagtagctggtgttacaggtgcatgccaccatgcctggctaatttttatatttttagtagtgacagggtttcaccaagttgcccaggctggtctgaagctgctgacctcaggcgatctgctcaccttggcctctcaaagtgctgggattacaggcgtgagtcactgcacctggcttgtatatgtagttttttaaaaaaataaataagtaaagacttttcaaggacaaagatatcatttgcattttgtagcctgagtgccagtaatacttgacaattacttgatgctcaataaaatgattcttattagcaaaataaaccttacacgtagaaaaagaatatgccaggaaccaagaaaagggatattcagatatgaggctcttggagttacggctcagctcacaaggattctgccgtaggtgagaaatgctccattacccagaggcaaagccccagaggttgtggcagcactttatgactatgtatcagtctgggctcagtcagggaaacattgagccactgttaagtgttataggagtgaggggtttaatatagtaattaaggcctgtgcaaatatgggaggactagagaagtgaaggtctgcacgttttttattgtatactggacacgttgtttacaataggagtagggaatgagctggatacagctacagttggaagaccagaggaataggcactgatgactgaaacctgcagctctagagagggcagagaagtgctaggaaactgcctctcgctgccaaagtaggactcagtgtgggatcccaaggaaaggtctgtgaagactgccacggggataaagtggagctttaggagaggccagtggagcgactgcatctgactgccctgacctcttaaaaataatggcttctacttcatttccaccttctaaaactcacagaagcctctgacccagaaccacacagggaaaggaattctgggagacttaattttctgtcctagacaacagtggtggtggtgccagttgaccatccagcataggccattcctttgccagcctggcttacatacacacctacttaaaccatatttaactgccagataaagctaaatgctctgcttaacatgttgtaactatcgcttagcaaactgaaaacatgctaagcactccctcaaagaggagatgctgtatttcatattgtgctttgtacatttctggctgatatgaatgtattccactagctgagtcacatcccctctttgatatcctaaaacttacatatactgagatacagagttagccatttcctttttttttttttcttggcaaggtcttgttctgtcacccaggctgcagtgcagtggcgccatcatagctcactgcatccagaatctcctgggcccaagcgatccgcctgccttagcttcttgactataggtgtgcaccaccacacctagctaaattttttttatttttaactttttgtagagacaagaggtatcactgtgttgcccaggctgctcttgaactcctggcctcaagcaatcctgttgccttagcctctcaacgtgttaggattataggcatgaaccaccgtgcccagccagagtcaatacaccttatattagagagtattattagacagggaaaagtggaaaaaagaattcgttaatatattcagtatatattcatatcaaagcaaagaagaatatctgccaaactattgtagttctcattttctgtacctttcatgtgatcatggcaggtatctgtcatttctttcttcctctagccattccatgttcctttggtcctcagtagtcacctcagatggtctttgttctttgcctggtggggtggcctaaaccttcattctggggtgtatgtaccaataaatggccatattgttttgctctaatatcccgttaactttccataataaacaagtgtaatagaaaatcctaggttccaggcaatttctttccttcttccattgagtatttttttcccattgtgtattttaaacttggttcttccttgataatcgggatcaatcagcctagctattatagtacctgccttacttgtctttggctaagtggcatgaggagcaagaagtgctgagttaacagtctcagctctctgttcagtggaaataatgttgtgtctcccccaaagaagcacttctcccttgaggattaagacctgtaaactgggagagcccacagctgctgcgagttttcttttggggaaggattttgataatatttagtgaatatagggctatttcgattttcttgttcttgtatcaattttgataaattgtattttttaaagtaatttggccatttcacttaagttgtcaaatttgttggcaggaagctgcagtattttcttagagtccttctaatctttgtcaaattgatagtgataacttttctattcctcatgtgatgaccccttgattccgcctctgtccacacctgttagtgattccctccacctgaatgtggacaggacctgtgacttgcttggaacgaatagaatacaacaaaggcgatgggagatatgtgattgcatgattatattatataagattacagcactggactggctggagtgtgcacgtctctctctctctctctctggacataaagactgttatcttgtatagactctgggttcctttataatactcttgtgaatgcatttacttttgttttagcaggcaatcaactcaggtaggctggattatacattgttttgccttttgcaggcagtgattcaaatcccaattcagttatcaaagcaaagcctttgctaaactggtttgggtttgtcctgtgcatgtgtgattcagaggttaaggtgagacccgtgtaggtgcatacataaaagtggagagctccttcacctgctgtttctgctccaggagtttgctctgactccctgtctttctttggctcctttccctgcttgctctgaccagaaagaaaacaattcctatcagagttttagccacctacgtgtgctgcttagtgactgaagctgtcccaccctcaaggaaaaacttgatgagaaaaaaataaacaaacagaaaactcaccctgtaaggtcacttctccaactttttacttccctccacaatctgcctgcttttatttactttccagatcctcatatagttttttgttttgttttgttttgctgtgttttgagatggagtttcactcttggtgcccaggctggagtgcagtggcacaatcttgtctcactgaaacctccccctcccgggttgaagcgactcttttgcctcagcctcctgagtagcttgggattacgggcagccgccaccatgcacggctaatttttggtatttttagtagagacagggtttcaccatgttggccaggctggtcttgaactcctgacctcaggtgtcccacccacttcagcctccccacagtgctgggattacaggtgtgagccaccgcgcctggcccaaggtagttattttttaaaagtttgctcaaactttatagttgtaattagagggaggaacaactttatgggatgtaggtggcttaacctcaccataatggaaccaaaactccacttcattcactttttttttttagatggagtctcgctctgtctgcagtgatgagatctcggctcactgcaaggtccgcctcccgggttcatgccattctcctgcctcagcctcctgagtagctgggactacaggcgtctgccaccacgcccggctagtttttttgtatttttagtagagacggggtttcaccgtgttagccaggatggtctcgatctcttgacttcgtgatccgcccgcctcggcctcccaaagtgctgggattacaggtgtgagccactgcgcccggcccacttcattcactttaaaatgaagtacttgaccagaagcagtactgtttagaatgccattatggtgaataagatattttgtaagggaaaggatgctggtttttgacagaaatgttgtgggcagagaaggaaatcttcattgagtaaaagcagtgtcctttttagatggaagcggtccagtgtgatcatcctgctacagatggctgcccagaccccctgggagcagcgctttattggggcaccattgttggcctctcctgttggcaggttggacacttagccatgattgttgccaggtcagccttgacaggtggaagcctgtgtcactgagcacatgcatgaccttcattcctgttgctctcacagtaggatatgaactttgttcattagcgttctgagcaagggaaacagtggctgataaaataatgagtcattttgtccacttggttattgagagcctcctctgctgagattatacattggtcatcatttacatgggacacaaataccctcacactttgtcctgtttgagaatagtttattgacatagctcttttctatatcttaccacaagtttcccaaccttattctaagtttctgaatttccagtcaaaccatctgctgctgaccacaaatcagtgtggattcgtatttatagccatcactcctttgacacaaaatgtgcagtcatgtacactgcttcgagtgtatgatgagcagcctaagcgacttgggcaacttggtagccagtggtaaagtgttcagtccttactaaatcctagtagcaagcaagggctctttctcaaaagggagagtaatgatctccagaagttagcatagctttgctctaaaatcctagggttctatactgtgatttacctctagggcctgccatacctccacacatcactcatgaagtatcatcctgtatcttaagtttttgttggcgatactaatctctgcagttcctctaggaatgcagtattacttttggtgtaatattttggtagagagaggcagctctaatgtaacccctgaggtatggctttagtatgctacccatctctgttagtcctagggacaccatcaccaatcagccaccaccagagatctctacagctcacaccattctcttttcctactctacctctgcgtgtgcttataaagtatagccatgtgcccattgtttctgtcatgaagcgtcaccagttggctgctgtgactcagagatcttttcatccttcccttgggttcagggaatctatttctctgacagcctttcccattgttatttctagcctgcagcgaacaagcactaaagagctttttagggatgttgttgcccccttcaccaatgtatttctcaaaggcttggtaaaggagtgagttctctagacattcctgggatgtagttaggagatcagtgaacagatcagtcatacgtattaaatacaccccagtattccttattttctaaccttttgaataaattttattttgagactgagttttgctcctgttgcccaagctggagtgcaatggcactgtctcagctcattgcaacctctgccttccgggttcaagcacttctcctgctcagtctcctcagtagctgggattacaggtgcccgacaccatgcccagctaatttttgtatttttagtagagacagggtttcaccatgttggtcaggctggtcttggaactcctgacctcaggtgatccacccaccttggcctcccaaagtgctgggattacaggcatgagccactgcacctggcttgaacaacttttatttacagtataccaaggaggttctggcatctaagcttcatttaatgtaagccactgatggatccaggttttggccaaccaggtgaggaaattgttagagttattccctgattactcaagccaatatactgcatccaaaatatctggttaatgtactcatatattgataaatttgaccaagtccaacgttacattccttcttgtctggtctaacattcttaggattcattgctacacacttcctaggtttctgcaagtacaaatgggcaaaatctagcacaatgaccctagccctctgagggtcacagcaggttggttcaggagtaggaacctgacccaacacaggcaaataaaggtctttccctgggactgtgaaatggtaccaagggaagaaaggtggtttctctctggtagggagggccactggatataaggcacaggaactgttgctggaagcgttagacactgctgactgcttgttcctttttccctgttagtaaagactattcctttaaaaaaccaaaaaaggtagataaaaatgccagatattcattttcccatatactcttgtgggtggaatgaccacttgaccatttttttgtagccagtgatacataaggagatttttttttaacagggaaaaaaagagcttacaaattttatgtgcacatgtgtgcatgggagttatacaattcttttaaaaaaaaaactcaaatggctagatgattgacacttttgtaccaccctgagatacagaaagaataggggcttggatcatggccaaacaagttatggtggcaaaacaggttatgggaggaagagaagaccacctttgcctggctagcaaaggtagtcttgaactctcacaggcagcagccctcagaaagaatggatagtagccagtgataaatgtttctagcagacctttaaaggtgttagactctcagttaatcattcttaggtctggataaggagatgtttgctagggattttctgggagagatttagctttctgagaaaataaagaattgtgtgaaaagagcttactctttccttcctgcttttgaacattgctgtgaaagaacattatgcttagccctgctgcagccactttgtgatcctaagagaagttatcatcaataacacactgaaggtgacagaaggaagattagggcagaggcttcccttgatttctgggcttaggactgtccatccacctcatgtctggacttcttgttatgtgtttgacatacttgtactcagttattctattaccgtgtgttcactgcaaatggggtcgtgttcctcagtgtgtaagggaataaagccaacccatcgagagaagcagagccaaagaggtcaagggagtgtctggcaggggttgaggtcctggttctggttgcccatgaagatcatttccagctctgcccttgccacagttccaggaaacatttccctttttgactgtattacttgaattgggtttctgggctgtagtaggaatattccaactaataccatactgggtaaatttgaagtatgataaattttaagctacttctcactttatttcttgtgcctaaatttgaagagtatttatttatttatttatttatttatttatttatgagacagggtctcgctctgttgcccagagtgctctggaatgcagtggcacgatcatagcttactgcagccttgacttcttgggctcaggtgatcctcccaccttggcctcccaaagttctgggattataggcatataggcatgagccactttgtctggcctaaattttagttaaagaaattcttatctcattctttcagaattttcataggccttcaaagcaacaaccatggagttaaattcatttcctcaacttggcaggattttttttttcccctattgaagtattttgtcttttttttgtgtgtgtgtgacagggtttcactcttcgctctgttgcccaggctggagtgcagtggcatgatgatagctcactgtagccttaaactcccctgggctcaagccatcctcccacctcagctccctgagtagctgagaccataggcatgcaccactatgcccaactaattattgtattttttgtagagacaagatgtcaccatattacccaggctggcctcaaactcctgagctcaagtgattcacctggcccggcctcccaaagtgctgggattacaggagtgagccactgtgcccagccattttgttttattttgaaagaaggctgaattgattcctgcaggcattctgtaaagaatatataaggaagttcaaagtagcacattttaccatctctcagaatacctcagtctttcttctgatgcatcactttaaggcttcgattattaaacaagcaattactaaacagttgctttttggaatactaccttctagtgcttcaggagatgcaaagatctggcttgtatccaggaagaaaatacaggtaattggattggagagagaagacatgccatagaagaaaatgaaataataataagatgggagaagaatttttactgtgttttaaagggttaaaaactgttggaaacctaaaaatttgtccacaggacgaggctgaaagtctgagactaccccacaggaatagccttgtcaaggcctgattgtgccctttgactcatccttcaaagtcaaacctttctcatcttctctcccagctttggcactgtcattccataagtgtatcccaataatttgtgttttctgccagaaatccttttggggctaatgagtttcatgcacttgtatttgctgtgtaaagtaggttttcctatacttgtacttaccagattaaatgtcaaaggatccagctctttgttggttttgtgtacaagcacaaattgcacttgctcatgccattcagaatttcgtacattttagttgtcttttacaactgtaatcccatctgaaggtctatgggaaattcagttccttaagaaataggttcccctcatccttctctttctgccttcattagtgagagtactttttgagagcaagagaacatttgcagtgaagaggtttagttggatagctatttatacagttttccttggaattttaaagaatgaaataatttctctttatgtcagcaaatgcctattctgaacattcagaatgactgttctgaacagtaatgtttaactcttaaaaaacatggtatttataaatgagaatataataaatcagtattagaagtcattttttaccccatgctctaattcaggagaaaataggagatacttataggttaacttggtgtctgattaccagtgcctgatataatttctccaattccctttttaaaaatctattaaaatatcgttaatttaaaaaatccctttaaaatgaagatatgaaaagctctatgctaaagaatagggaaattttccactaagtcgatcattgattgtattgtggcttttccttaaacccaaagattacccaaagattactgtagaagtgacactacgaaaaatcaaattaatgatagggagagtatacattagatgctcttccagaatgtacagcaaaagaacagagatgaagattgatagatgagagaaaatgatacctatgaaagaaaaaaatagagatttaactggtgactaatagatgtctgcaaaggagacaacagaagtggaacaaaagcatggatcaaatgtgtcattgtggaagactttccagggttgaaaatgacctgaagaataaaagagctcactgtattctaaagaacattatgaaaacgtgtctgtacctagacatattttgctggttttcttttgattttaaggatcctgaaaaaaaaaaaaaaatcctgcatatatcaaggcacaaaaaaatgagctttcaacaaagaaacaaaaatgatgctggtagccaggcgcggtggctcatgcctgtaatcccagcactttgggtggccaaggtgggcagatcacaaggttaggagtttgagaccagcctggccaacatggtgaaaccctgaatctactgaaaatacaaaaaattagctgggtgtggtggcatgtgcctataatcccagctactcgggaggctgaggcaggagaatcatttgaactcgggaggcggaggttgcagtgagccaagatcatgccataactctccagcttgggtgacagggcgagacttgatctcaaaaaaaataaaataataaaataaaataaacaaattatgctggctacaaaattttcttttgcaaatactaaatgttggaaaatgatggagcagtgggcagtgatccttagcttatgtggtctttgaactccctgcagtaatatttggacctctatgtcttgatgcaagttgattttcctgggaatagaatctatatcgttcctcatattttccaggatttcatgaaacaaagagttaagaactacagtagtggagcaatattcatggtgctttttctttttcttttgaaataattaaaaacttacagaaaggctgtaagaataatacagagaaatcctgtgtattctttcccaaattcatgtgtttgtcttctctctctttctctctccttataaaatatttcaatgttgttagttatctcaaaatggactttgtagtttttttttcctcccctaccagtacaggtttcagtctaagatcacatcatatatatagttttatattgttttagttttctttatctgtaacagtttctcagatgctctctgtcttccatgatactgatatttttttgaagaatgctggcaggttattttacagtgttcctcattctgggtttgtctgatgtttcctcttgattattattcgggttatgcatatgaggccacaatactaggtaaattgtgtggtttcattctcaaggtatccacatctgaaggcgtatgatgttcatctgtcacaccgttgatgttaatttcgatctcatggtaaatgtgttttttcggtgtctccactctatggttacttttttatccctttcaattaaaaaacaatcagtggtcgggcactgtggctcatgcctatgatcccaacactttgggaggcagaggcaggaggatcgcttaagcccaggaactcaagaccagcctgggcaacatagggagaccccatctctactggactggtggcatgtgcctcttgtcccagctgcaggaggctgaggtgggaggattgtctgagcccaggatgtcaagcctgcagtgagctgagattgcaccactgcactccagcctgagtgacagagtgagaccctgtctcaaaaataaataaattaattaaaaataaaaacgatcaatgtggaaaaaacttgaagactgtgcaaatagccatatgttgcttaacgatgggaatacattgtgaaaaatgtgttattaggtgattctgtcattgtgcaaacaccatagggtgtacttacataaatttagatggtatagcctgctacatagctaggctatatggtttagcctattgttcttaggctacaaaactgtacagcttgttactgtactgaatattgtaggcagttgtaacactatgataagtattatataaacatatctaaacataggaagatacagtaaaaatacagaattataatcttatgggaccactgtcataagtgtggtttattactgaccaaaatgtcattatgtggcacatggctgtatcttgcttttcatcaggctttacactctagatgagcatccattgattattcttacccacaccaatggtacagttatgatagttggaaaatgctgcttttttccaactccactactccctccatttcatggtattctaatgaatgatcattgtcacaaaattcaacacctaattgtatctgttatgataatgaaaagaaacaaatgacccattcaaaacagttcagttgaaaagagtttatcaaaggaatgacttaacacggtgtggccacagtaagggaatcaacaaggaatggtgaagcacccagtaactagcaacagtgggaagccattgccacccttagacctgcggaggcaaagggagggcacatggttatcaggctcgtgaaactggaattcatagaggaggaaccacctacaggtgctgtgtctctagagaaaaacagccactgtcagcacagaggcaaggttgagacaaagctgggggaatcagctgagttcttcctgctgctgctctgacctgttagtagtgctcacggttgcccagtcataagccaaaggacaagaaagcctgggtgatgcaatctggagagcttgacctcctggggcacagaaggtgttgcggggttgtgggaatggtagtataaccagcacactagctaagattttattaatgtgacaagacaagaaaaagatctctgatgcgcaagaactgaatggagagttcagatcatgttcttagatgggaagattgaatagtataaatatcttggttcttgccacatgaatttgtctacttaattccaacagtctaatggaattacggagggagtaggggtgatggtggggtaacattgttaaaatgattctaagttcaatcaggcaagaataacaagaaaaaaaaattcgggccaggtgcggtagcacacgcctgtaatcccagcactttgggaggccaaagcaggcagatcacctgaggtctggagttcgagaccagcctgaccaacatggagaaaccctgcctctactaaaaatacaaaattagccaggcatggtagcacatgcctgtaatcccagctactcgggaggctgaggcaggagaatcgcttgaactcaggatgcggaggttgcggtgagccaaattcatgccattgcactccagcctgggcaacaagagtgaaactccatctcaaaaaaaaaaaaaaaattctgatttcactgcgtaattttaaaaataatattttaattttgttttgaactaaatattttaaaattatttgtgttcataaattatttagaattgtttttaagggttttctaagttacatttttgttactcctttctgacttaaatataatatagttaaagaatattatctaaatgatactaattctgtaaaatgttgttgaagcttaatgatctaagacgggtcagtttttgtgaatcttactgtgtgtgtgttcctgagaaggatgtgtattcactaattaatgggtgctgggttttattggtaggccagaagtcaaacttgacagttatgtagcccttaattcatgctaatgttttgtatcattggtctgtaaataactgaaagagctgtgttgaaatcttccactttgtggatagatttgttcatttctctctaaagttgtcaaattttgctttattttgaggctattttttgagagcttacaaatttagattcattagcattttctagcaaattgaacattttattgtaacatacggactatcactaaaaatgctttttgtcttacagagtagaattgctaaataaaatacaggatgctcaattaaatttgaatttcagataaatgttgagtacttttttagtataagtatgttctacatattgcaaaaattattcatttttcacaggaacagaaaaccagataccacgtgttctcacttataagggggcactaaatgatgagaacacatggacacatggcggagaacaagacactggggtgtactggagggtggagggtggaggagggagaggatcaggaaacataactaatgggtactaggcttaatacctgggtgatgaaataatctgtacagcaaacccccatgacatgagtttacctatagaacaaaactgtacatgttcccctgaacttaaaataaaagttaacaaaaaaagtctggcatggaaagacataaacatgcgtggagctggttgtctctgatcttgcaccacttgtgataaagttgtttgtagtatttaatgaatgtgttcaaaaatctgtatctttagttatatgtacttcttggtcctaatattactgatttgtgctacctatacagttttggtggggggtttgcttatttgggggataaccttactactggtttgtctctcttattagtcttttcaagtaatactttctttggctgtattctgttgctccttttctagcttgtttaattgaacatttaattaaatattcatcattccttttgaaaaaattgttgtttatctgacattcaaatttaactaggcatcctatgttttgtttgtttttgctaaatttgggagcctatttaaaaactattttgtttgatactaatatagctatccccaatattttttggttataatttccctagtatatcgtttttataaatttcattctttgagtctttgtgttttaatgttttttttttaatatcctatagtcagaattgttagtctaatcttacctatgttgtttttctaggaagtgtagggcttttttattgggattgcagacctattgtcccttttttaaaactatattttcaaatgctttttatttttcccacttgttttgtgcttttgtggactgttttctttttgcatgattttaaaaaaattccatgttctcttactattattttagacattacacatatttattattttgttaacctttaaatattactgtcaggccaggcacggtggctcatgcctgtaatcccatcactttgggaggccaaagcgggtggatcacctgaggtcaggtgttccagaccagcctggccaacatggcgaaaccccgtctctactaaaaatataaaaattagccaggcggggtggcaggcgcctataatcacagctactgagaaggctgagtcaggagaatcgcttgaacctggaggcagaggttacagcgagccgagatcatgccattgtactcgagcctcggcgacagagcaagactctttctcaaaaataaataaataaataaatatatattactgttcaaactctacttgataaagttatttaatatttttaaatccccacacaaacatcctaactctgataactacccttttaatgcttatgctattactgttgaatatttaagttctttttttaacactatatgttagacatcatcattactgttactttatatggacagtattatgtttatgtatatgtttaccatttcccatgctcacaattacttcttgcatctaagatcatctttctcagattggtttccttttttttcccccaagtacattcttcagaatttttttttttttttagacgaagtctcactctgttgtcaggctggagtgcagtggcacgatctcagctcactgcaacctccccctcctgggttcaagggattctcctgcctcagcctcccgagtagctcctactacaggtgcccgccaccacgcctggccaatttttgcatttttagtagagatggggtttcaccatgttgcccaggctggtctcgatctcctgaccatgtgactcgccgccttggcctctcaaagtgctgggagtataggcgtgagccaccacgcccagcctagaagtttttttggtaaaggtaaattgatggtagactcagactttgcatatttgggaatatttttacttcactctaattcttgaaatgttgttttgttgaatagactaggtttatagtaatcttccatcagcactttgaagatattttaacattttctgggccctagttttgcaattgagaagttactatcagcgtagttgctatttctttgtgggtgactttactctctgatttttaaggtcttctttatataactgtattttccaattttactacaatatagctaactgtggcttttctcatttatttgttttgttttgtatatttatatgatttcctgtattttatcagttctataaaattctcgaccatttttctttgaatatttcttcttctccgttctctccattttgtcctttgaactccagttatttgaatattaaaatgttgcattctgtcctccagatagtttaacaactctttcatgttttctgccttcttacctctatctgctagataatttctttagatcaattgtctgattcactcattctttcttcatctgtttcatttgctctttaacgtgtccagtatattttaattaaaaatatatatgttgggttatttttagcctgcctgctactttaaaaaaatactcttttgttccttttaaaacatcaaaagttgatctgaagtgtttcagcagttgaactcctaggtcttcattgtcagcctgctgtacttgttttcttcaagaagatagatatctctaaatgttgtcatatccttttttgttattgaatcaaagtagctgaatttgatagaagttcagtgttgcattgtccagatacacagttttgaggtttgaaagcttgaataagtgccagtggacttcatgcaaatgctttatatatttttcacctaatatattttgaatttcaacaagtaacacattctcttaaatactgacttgataggcaagtgagcatagcaagcttcatcttttagtgaaagtccattgatcctgtttcgtaattggatgaagagtgtccaaactattgccagtagctttctgttttcccatcatttttcaacccagaaatatttatttttctttccagggaggcattagcagtaccctggaagctcccctcctacccctccaaattattccctcctcctctttacttttctccaaagataatctctgtcctgaatcaaaaatcgtccccgcttcctggtagcacccgatctggaagaaacccaaaatcacctaaccaaaacctgaatcatataatagtcttttctaatactcttttactgagacattccacaattcccaattatatgtgttattccttgctgaaatgaataatgaacccaacatgtgcaactacagctatgttcctggtaacctttggctgggaggattgacaatattcatttgtgtctggtttctttctttctttttttctttttcttttttttttttttttttttgagacggagtcttgctctgtcccccaggctggagtgcagtggcacaatctcggctcactgcaagctccacctcccgggttcactccattctcctgcctcagcctcccgagttgctgggactacaggcgcccgccaccatgcctggctaattttttgtatttttagtagaggcggggtttcaccatgttagccaggatggtctcgatctcctgaccttgtgatctgcccgcctcggcctcccaaagtgctgggattacaggcgtgagccaccgcgcccagcctggtttctttctttttaacattttgtaagattcatgtttttgcatgtagtcatagttttttttgtgtgtgtgatggaatttcactcttgttgcccaggctggagtgcaatggagtgatctcgtctcaccacaacctccgcctcccaggttcaagcgattctcctgcctcagcctcccgagtagctggtattacagacatgtgccaccacgcccggctaattttgcatttttagtagagatggggcttcaccatgttggtcaggctggtctcaaactcctgacctcaggtgatctgcccgcctcagcctcccaaagtgctgggattacagttgtgagccaccgtgcccggccttgttcatttttgttatttaatattatgctataattacataactatttggaactttttgactctgttttaatgttgatacacagtatctttgtacatatcatttggtgaacatgaataatgcatttttgttgggagtatgcctgggagttatattgggagttcccaagaccactcatagtaatcagaagttatgattatgattatagttgattacagcaaaaggatatgaagtaaaagtcaagaaagggaaaaggcacatgggcaaagtctggaaggaaccagctgctcactttccaatgtgccctctcagtggagtcagacaggacatgtttcatttccccagcaacatgtgtgacaacacacacaaaatgtttccaatcaaggaagctcacctgagcttttgtgtccagagtttttattaggggtcagtcatgacataggcatttggtattacctgcacaactgacttcagggtcaggctccagatccccagagaaaaagcaggtgtcaaccataaatcacattgttagcataaactatctggttaaaccagtacagcatggcccaaggcctcagacacatgaaacatttcttatcagacataagattctatgataggaggcagccaatagccagtcctgaaaacaggcctgtcttgggaatgtgcaaccaggcctgctgagttaataaacttttccagcagagattgaaaaggatgggtcaaaggatatctgtaggtacaaatttgagagatagtgccaaagagtttttcaaagtgattatacctgtttactctctaaccagcagatgtgtaagaacttcagttcttctactttgccaataccttgtacagtttaatcttctaaaattgtaattttcttcctcgtgtctattgatatctcattttggtttacatttttatttccttagtaactgagactgagcaccttttcatatgtcattgaccagtagcctatgttgtgaagtgccagttcaggttctttgcctggttttcttttgaatcatttgcttttttctcattgatttttaggaattatttacatgttttgatatgtacacttcatgtgtgtttcaaataacttctcccatctatctgccttgccttttctctctcttaaggctgtcttttgaaaaatagaagttaattttaatgtctaattttgtgatctttttctttactgcttttggcataccatttaataaatcttttttccaattcaagtccttggatatatcctcctatgttatctaatgaaaagtttattgctttacctttctcttttagatctgtaacctgcctggaattgatttcttttcattgtggtaagaaacacatgacataaaatactctcttaaagatttacaactgtacatctcagtagtgttaaacatatttacagtgttgtaaaacagattcagaaactttttatcttgaaaaacggaaaactttatactcattaaacaataactctccattcttcttctccccactcccctccttgctgctcctggcagtccctattttacttttgtctcgatttaagtacctcatgtggcatcaaatagtatttgtctctttgtgactggcttgtttgagttagcataatgtcctcaagtttcatccatgttacaggatgtgacaggacttcctttttaaggctgcatagtatttcattgtatgtctgtaccacattttgttcatccattcatctgttgatcaatttgggttgcttccatttcttggctattgtgaatagtgctgcagtgaacatgatgtgcagatatctctttgagttcttgctttcagttattttgtgtatactcagaagtggaattgctgaattatatgggagttctattttttattttttcaggaagctgccgtactgttactccatagcagctgcactattttacatcccttccagtagtgcacaaaggttccagtggtgcacaaaggttccagttttccacagctcaccaacacttgttattttttttatttttttattttttatttttttaaatagtagccattctaatggatatgaatggtaactcattatggttttgatttgcatttctctgatgattagtgatgttgagcatcttttcatatgcttgttgtctatttatgtatcatctttgggaagaaatactttgttcatttttaattggattttttgattttttgctgtgaattgtagaagttctttatgtaattctgaatattaaccccatagcagatacatgacttgcaaaattgtgtttctttagagttgatttctttaactttattttgattctttaattgggccatctatccagaccaggctggtctcggactcctgagctcaggcaatcaacccgtatcagccttccaaagtgctgggattacaggcgtgagccaccctgcctggccgctgtggatttttaaataaacgtcctttatcatgttaaagaagctttcttctgttcttagtttactaagtgttttgttatgaagtgatgttgagttttgcccagtgtttttttctgtgtgtattgagatgatgtgtttttctttatattttattattatgtattacactggatgattatcttacattgaaccaccctagcattcctgagataaatccaaattgggctgcatcgaaactaaaaacttttgtattacaaatgttatgaagaaagtgaaaagacaacccacagatgctatctagagattggtatccagattatataaagaattcttgcaagtcaaataataaaaatttacatcacccaattagtagtttaagtcagccagagttggttcctcttgaatcacccaatttgtggtgaattgaaactataatcagatactacttcacacccaccgggatgcttataataaaaaatacatgggaaatagtacagtagttcctcaaaaaattatagaattaccatttgatccagcagttccacttctgtgtatatatacaaaagaggtcaaagcagggatacagatatttgtgcaccagtgttcatagcagcactattcacaacagtcagaaggtggaaacaacctaaatgtccatctacagatgaatgggtaaacaaaatgtggtaaagatggatcaatagatcacaaaggaatattattcagccttaaaaaggaatgaaattctgatacatgctacaataaggatgaaacttcaagacactgtgctgggtgaaataagccagacacaaaaggacaaatgttgtataatttgacttatggggtacatagaataggtcaattcatagagatagaaagtagaatggaggttatcaggggtggggtatgatttcattcctgtaaagttcagagttactcttattggaggaaaggatacattatgactagaaggagggacaaggaaggccactgggtcatcttctatttctcaatctgtgtttactccatagaatttgattgagctgtttagctgtggtttgcacattttcctttacgtataaactttttacatatatacttttattaaaatctacttaaaatggggaaaaaaaagatatctagatttcagcttttaaatgctggtgcaatgatagccattttcggctgggtgcagtggctcacacctgtaatcccagcactttgggaggctgaggcagctggatcacctgaggtcaggagttcaagaccagcctggctaacatggtgaaactttgtctctactaaaaattagccaaacctggtggtgggttcctgtaatcccagctactcgggaggctgaggaaggagaattgcttgaactcgggaggcagaggttttgcagtgatccaagactgtgccactgcactccagcctgggtgacagagtaagactctgtctcaaaaaaaaaaaaaaaaaaaaaaaaaaaaaacaagacaaaacactcatatctgaaatgtggtttacatagaatgttcttccaggcaaaaaaaacaagattaaaattactggttttgaaaatgtattctgttctttcttatatcaaagtcttgatgttggtggctagagagaacttcttaggttttctacctgtattagtccgttttcatactgctataaagaactgcccaagacggggtaatttataaaggaaagaggtttaattgactcatagttcagcatggctggggaggcctcaggaaacttaaaatcatagtagaaggtcaagaggaagcaaggcactttcttcacaagtcacaaaggagaagtgctaagtgaaggatgaagagccccatataaaaccatcacatctcgtgagaactcactcactatcacgaggacagcatgggggaacctctgccgtgattcagtgacttccacctggtctctcccttgacacgtggggattatggggattataattcaagaggagatttggatggggacacaaagcctaaccatatcactaccatttttcttttctttttttttcatgcctggattttttcgttgttccctcatgaacattttaaagtgtaattaagcaaaagagaatactatacaatggtttttaacaatttttttaagtttcccccctccccccaagacagggtttcccaatgttgcctaggctggtctcgaactcctggcctcaagtgattctcccacctcaccctcctaagtagctgggactacagacatgtgccactgtgcccagctgcctatacagtgtttttattttattttatttttttaagatggagtcttgctttgtcacccaggctggagtgcagtggcattatcttggcttaccgcaacctgtgcctcccggattcaaatgattctcctgcctaagcctcccaagtagctgggattacaggcacccgcctccatgcctggctaatttttgtatttttagtagagacagggtttcaccatgttggccaggctggtctcgaactcctgagctcgtgatctgcccgccttggcctcccaaattgctggggttacaggcgtgagccaccatgcctggcctttaatttttttaaaaagtaaaacttctttaattttcttctcgcaagaattgaatagaatgatagaatgaatgccagtattttataatgttgtatccagcaggttgcaatcagggaggctccaacagagtcactttttctgtctttttatgttcaatctatgctgtaaattggtttcagaaacttctgtgagtctatcaactgtaaaaatggagatgactatgaaaggatcttacgcttttattcttctttgatccacatgtctgtttgttcctccatctagaatataaagatgattaagactctacctgtctcctttaagtccagtgaagaagatagatttacaattaatggtaattcagtataactgccgtaagaacagggcattcagaatgccctgtgagctcagagatggcgctactgtattctcatgtttaaaggataagtaaaagttccccagtttgagaaaagaggggaaaaggactccagtgaaaggaaattgatgaaattactgttgactttacttgtatatattaactgtctttcagtgtctctgaaaacttgatttgggactatttcctttgaacagaaataatagcattcctgcctgataaatgtcctgtggtcaaataatatgatttcctaatcattctgcacactaaacttccccccaccaggaaatcaatgccttaatgctaaatttcctctgtactactttctgtaagagtaagaggttcctatttcacagtcacgacacattcccaactcaattcacattccaatccatcttgtccaacttcattgaaagttgatacactgaaccatttcctttacttaaaagaaatagaattcttcctaaattctatctactgttggaatagaaagaatatcatgcttctagactgactaattttttttcttcttgatataagtattgacaacatttattcatttgtttctaggcagcacaagactgttgaactttcctagaactgagtctgagatttgcaaagctgccaaaatattttgaaacaaatgaaaatatgtaaacatgaatgttatcagctgttttacagtatttgtgttttagagataatgagcatctggtggaccacaggagcccagggggatttcaaactccagattcctttttgtgtaatcatatctggctggagttatttgttttctctgcatgtgaaactatcaagtcataattcttcaaaggggaatgtttattgcattatttaaaaataataaattatattactaaataaataacagcaggccaggcataaaccaatgatgaaagtttgtcagaaactaaggcttctgattaattctgtgctctggactataattggaaggaaggattatattagagtttacaatgagtttacagaaagaaaggagagggataaattatatttagttcacagtaaatctgaattcagaacccctggttgtaagactagtcttttaacctttagagttaaaaaatgtatatgtacagctgggtgcagtggttcacgcctgtaatcctagcactttgggaggccaaggtgggtggatcgcttgaacccaggagtttgagaccaggatgggcaaaatggcaaaaccctgactctataaaaaatacaaaaattagctaggtgtggtggcaggtgcccatagtcctagctactcaggaggctgaggtgggaggatcccttgagtctgggaggtcaaagctgcagtgagccgtgattgtgctactgtactccagcctgggtgacagagaaagaccctgtcttaaaaaaaaaaaaaagtgcgtgtgtgtgtgtgtatgtacgttgaagaaaactatgagaaaaagcaaaaatgtagagtccataatgcataatgttgtgttaagcacatagtttagtcattggtacatatttctggagatggtctaaagatctattttttaaaaactgattttagttaaatcagaggttagcaaatcacagcctgcaggccaaatctggcctatcatacattttgtttgtctctttgttgtgtttttggtgtttttttttctttcttttttttttcctttccttttttttttttttttttttttttttttgagacagagtcttgctctgttacccagaccaggctggagtgcattggtgcgatctcagctcactgcaacctctgtctcccaggttcaagcaattctcctgcctcagcctcctgagtagctgggattataggtgtgcaccaccatgcccagctaatttttgtatttttagtagagatggggttttaccatgttgcccaggctggtctcaaactcctgagctcaggcaatcttctcgccccagcctcccaaagtgctgggattacagacgtgagccaccgcgcctggccctatcatacattttggtaaataaagttttattagaacatactatgctcaatcatttatatgttttgtgtggctgcatttgccctgcagcagtagagctgagtagttggaacagagactgtggttcatacaacctaaaatatttaccctggcctttgttacagaataggttgctaacctctgagtttctcagttttagcccattcacaaatgaaatagtttttttttgttgttttttttgagacagcctcactctgtcgcccaggctggagtgcagtggcatgatcttggctcactgcaacctctgcctcttgggttcaagcaattctcttgcctaaacctcctgagaagttgggactataggcacatgccacaacgcctggctaatttttgtatttttagtagagaccaggtttcgccatgttgaccaggctggtcttgaactcctggcatcaagtgatctgcctgtcttggcctcccaaagtgctgggatcccagcctctctctctctctttctcactctctctctctcccgctctctctctctctctctctctctctctatatatatatatatatatatttttttttttttttttttttttgagacagggtctcattctgtcacccaggctggagtgcagtggcataatcacagctcactgcagcctcaaccccacgggctcaagcaattctcctgcctcagcctcccaagtagctgggattacaggtgcgcacaaccacgcccagctaatacttgtatttttttgtagagacgaggcttctccatgttgtccaggctgttctcgagctcctggaactcaagcaatctgcctcaggcaggaatcctgaaattctgggattataggtgtgagccacttctcctggcccacaaatgacatattccttataatctactacagtgagctttgcatggttaatatatttgttgtgttgaaactatcttcctgattttttccaattttttatagagaaacctggaaagaatagtaccataaatacctatataccctaacagagaattattgttaaaattttgccatatttgctttatcttctctgtgcatatgtatactcacatggctttttttttattggtattagttgaaagttgcagatattatgcttcctcagcgcatatccctaagaataaaagcattttcctcgacaactgattatgttaaaatttgaagacgtgtatgaggtttttgtttgtgagggctatatgactggcgtttctccagtatatgacactttgttcatccctatgttcctctttataaactgcagaaattctaaatataatgcattagttgtctattgcttgcaagtagtagactgaatgatggctccataaagatgtccacttccattagataaagaaaatgtgtacatatacaccatgaaatattgcacagccataacaaagagcgaaatcatgttctttgcagcagtttggatggcgcttgaggccattatcctaagtgaattaatgcagaaacagaaaaccaagtacctcatgttctcacttgtaagtgagaggtaaacactgggtacaaatggacataaagatggggacagtagacactgggaatacaagagggcagaagagggaaggaaaaataagggttgaaaaactacctattgggtactgtgctcactacctgggtgacaggttcaatcatatcccaaacttcagcatcacacactatacccctgtaacaaacctgcacatgtaccccctgaatctaaataaaagttggaaaaacaaatcaacccagatggccatttcctaatccctggggtctgtgaatatgttaccttatctggcaaaaggaactttacagatggaattaaggaattttagatgaggagattaccgatcatctggtgggcctaaagtaatcaccagggtcctcataaaggagaggcaagggagttgaaggtagagaaggggctctgaagatgggaagcagaataagtgtaggaaatgtgagcttgccacactgctagtgttgaagatggtgaggctaagaattttcacatccactttcaaaaccattgtgtcctggctccttttaaaccatctttccctcaatttctctgtcctcttacatcttattgtaaacaccaagaagaaacctggcagttaactttgcttggaaatctttttagctagaccatctaattcattcggcacattttctaccttccacatcactgtaaaattgggttgctaaactttccacaactacctaacagagatcccttgcctccagtttctactcagatgttcctcacattccttaaaactcacagtccacctcctaacaatctaaaatctaccaactatcaattcctggcaatttaggctttactgctcctctcctgaaaggccttaaagtattagaactgggccctattattagaacctatttcccagttctaatattcctcccacatttttggtatgtgtgacaatggaactttactcctgataccaaaatctgtatgatttatatatgaagcataacaaattattctaaaacgtattaatggcttaaatcaacaaacgtgttgtctcataggttctgtggttcaggaatccaggcaaagctacctagatgcttctagctcaggatctttcatgaagttgcagtcaagctgtcagctgggctgcagtcatccaaggctcagctgggagaggatctgccttcaagctctctcatgtgactgttggcaggcctcaggttttcactggctgttggctggagatgccagttatttgccacatgagcctctgtctacggcagttgacaacatgcagctggcctacctcagagcaagcaaccaagcaagagagcaagatagagtgctcaagacaaaagataacagactttttgtaacttaatctcagaagtaacatcccatcacttttgccaaattctggttgttagaagccagtcactagatctgtcccacacttgaagagggttaaacaaggtcatgttcttcataagattaatccaagtacagaattggcttaataacatttctgacgatttttcctataacttgtaaaaccttggctatctgaaacccttgggaagtgaatcatccttaaaagctaagtttctggatagatttttaccatgaagggaccaaatcttaataatttggagtagaatcacttctgcatttgatcacatatttcttgccttttaaaataaattactgatcattatttgaaattttatttcatcaaaagaaaattagcaattgtgtgttataaaaagaaggtgtctgtcttctccttatgtagggtatagaactgttcatctctttactaaaaacttaaggcttctgtctgccttttataatttctgtttctttctttgtttcatttgttacctcttagttatcagtacttgcccattgccttcctgtttactgtatctagtaagttgctgcaaaagtaattgtgatttttgtattaaaacaaatggcattagattctcataggagcacgaacacttttgtgaactgtgcatgtgaggcatctcggttgttcttgccttatgagactctaatgcctgatgatctttcactgtctccgatcacccccagatgagaccctctagttgcaggaaaacaagctcagggcttctactgattctgcaatatagtgagttgtgtaataatttcactatatattatgatgtaataataacagaaataaagtgcacagtaaacgtaatgtgcttgaatcatccggaaaccatcccctctgctggtccatggaaagattgtttttcacaaaaccggcccaaagttggggactactgctatagagaattggatctgcggtctacaagtaatgttaatgacatttattttaagttgcactgagacttttgtttacatcttttttttttttttgagatgagagtctcgtttgtgttgctcaggctggagtgcaaggcacaatctcagctcactgcaacgtccgtctcctgagttcaagcgattctcctgcctcagcctcccgagtagctgggattacaggtgcccgccaccaagcccagctaattttttgtatttttaatagagatggggtttcaccatactggttggccaggctggtcttgaactcctgacctcaggtgatccacccgcctcggcctcccaaagtgctaggattacaggcatgagccaacatgcctggcctgtttacatcttaattatgaattgttactatagtcagccctttgtatctgtggtttccacatccatagattcaactaaccatggactgaaaatatgtgggggggaaatgatgcttacatctgtactgaacgtgacggactttgtcattatttcctaaaaaatacaggataactatttacatagcatttgcattgtattaggtgttataagcagtctagagatgatttaaagtatacaggaggatatgtgtatgttacgtgcaaatactacaccattttatataaggcacttgagcacctgtggattttgttattcacaggggatcctggaaacaatcccctgtggataccaagagatgactgtataggggaggccgtggtgacagatgaagtggcactgggcttagtaagggtaagaaagctaagagtggcctgaggacagatgacaaacatgacatattgctcactttagccaatgctcagaatctcttaggtttttgaaacttcacaagcaatttaggcaaactctcctttcttctctatctctgtattctatgtaatcccacagttgaaggctgttcttatagtggaattaattatacctcactccaaaaacttgaccctgatttccgtctacaaacccaaagcagcaaatacaatttacttttatatttgaattattttctttgtaatggtgtctgttgacagccaaagcctcttgtatggaaacataccaccactgccacaagtaaaagctataaagcagtgttaaatactgtatatagagctcacatttgtatatgcatttcttttaggtcttatgtagtgtgtgtactgtggaagatcgagaaagtgcgttaggttgttagacaaaagacccagaaggcctgctagagatgccacaggtggaactaagaaagcaatctctgtgtcactcaggctttgagaaacttccttcagaatcataaaacattagaactgggaaggttaaaaaatctttagtctttttttcccagctccagtctcttgtgaataattaacagtaaagttaaagattatgggaattacgtgcctccttttttcccttgcacaacatagaatttgttttctaatagtagtttatttgttagctttgcattcccataagtgatggtttccagccttggcaaacccttgcagcctccagccacaagtcccctggacctcagagaatgtatatactgtatgtgcaccctaataacatatttccttaaaactagtactactggatcctctaactttagtacatgtctttcatgtccaacttttcagaggccgccaaactagcaaccctaaactcatttgtcactatcaaaacataatatacgaatatggaaagctaatataaaaatggtaagggactgagccatttggaaggtaacttaatgtaagtgcctgaaaaacagggatacaaaaaagcaaagggacaagaagcaagccagttcaccctgaaccctacaaatgtttgggaattagaaacatcaagtattacaaattaggggaaacggatgaagtctgatactaaaaatagggaggttgacagtctgtgtaggaacagttagacttccagatccttatctctataccccacctccccctctgcagaagagatagattcccttagggaggaagaaaactagagaaaataaagacactagggggagagtgtgatgtcagcaagatagtggaataaaagatacctggcatcactcttcccacaaaaatgcaactagaaattattcaggctgggcgcggtggctcactcctgtaatcccagcatgttgggaggccgaaacgtgtggatcacttgaggtcaggagttcgagaccagcctggccaacatggtgaaacgccgtctctactaaaaatacaaacattagctgggcatggtggtgggtgcctgtaatcccagctactcaggaggctgagacaggagaattgcttgaactcgggagttggaggttgcagtgagccaagatcatgccactgcactccagcctgggtgaaagagcgagactccatctcaaaaaaaaaaaaaaaagtattcaaagacaagaatatcaacctgagttcaccagaacttggggaagaagtggagaaacctcctgggccaacaaaattttttgtaaaataagtggtcatttcagactgtgccaccccttccccccaagctggcataacaccactcagggagaattttcctagccctgcagtttccaaggtgagaggaaggaattggaggtgtgtattcagtctcctcactggtctgggaatcttcccagggagcccactcccgtcccatcagggagagccaggagagctgaactatctggggtaaagtggggacaaagagcagggcactgattgtagcaactagtatatggatcttgcagctactctgtactctaattagccgagacaccctattgacaaggatggccagtgtcttagtgccactggggtgtaatcagtgggaaggcctgaatccctggtcggattttccacaaaacttagtgctcacatggaaccttcccgtggcccagaaacagctataagattgggattaagctgggcatggcagctcatttctgtaatcccactttgggaggccaagttgggtggataatttgagcccaggagttcaagaccagcctgggcaacatagcaaaatcccacttctaccacaaaaacaaaagttagctgcatgtggtggtacgtgcctgtaatcccagctacttcagaggctgaagcaaagagtcgcttgagcctgggagacagaggttacagtgagccaagatcgcaccactgaacgccagcctgggcaacagagcaaaactgtgtctcaaaaaaaaaaaaaagttgggattaacttccagtgtacacttaagcacttaagactttcacagactgggaaatgatgacaggatagcaatatagttggagaacaatgtttacctttcggtggtcactataagtcttcctgtctgtgaaacaatgtcagggcaagttagtttagttttagtgcagtgttttgaacggcagggcaagttagttctgttttagtgcaatgttttgaatggcagggcaagttagtttagttttagtgcagtgtttcagttctgatgctcactgtaagtcttccccagaatgggaagaaacaataggccagtacttaagctctcatactaagtaaaggcccgaaatcaccaaagaacacctgcaaaacctagaagaaatggctgtgtcctcaaatgtgcaagcatcaacataaacaagcaatgattatgaaaacttagggaaatatgacaccaccaaaagaaaccaacaaagctccaccagtggactcagaagaattgaagatctatgaaatgtcagacagagaattcagaataagcctctttaaaaagttcagtgaatctgccaggcatggtggcttacgcctgtaatcccagcactttgggaggccgaggtgggcagatcacgaggtcaggggatcgagaccatcctggctaacatggtgaaaccccatttctactaaaaatacaaaaaataagcagggcctggtggtgggcacctgtagtcccagctactcgggaggctgaggcaggagaatggtgtgaacccaggaggcggagcttgcagtgagctgagattgtgccactgcactccagcctgggagacagagcaagactccgcctcaaaaaaaaaaaaaatgttcagggaatcacaagaaaatagagatagaaaattaaatgaaatttagaaagcaatccatgtatgtagtgagaaatttgacaaagaaatagaaacaagaaaacaaatagaaatcctatctataaacaatacagtaactgaactggaataactcattggaaagctttagcagcagacttaatcaaataaaagaattggtgagcttcaggacagaacatatgaaattacccattcagaggagcaagaataaaaaagggtaaagaagacctacaagaattgtggaataccatcaagcagactaacctctgcataataggaattcctgaagatgaggaagaaaagggtgtagaaagcatacttaagcaaatcatggctgaaaaagtcccaaatctagagaaagatgacactgtctaggtacaggaagctcagtgatcagcaattaaaatcaacccaaagaagagatacctatggcacataacaatctggttaacaaaaatcaaagacaaagaaagattactcaaggcagcaagagaaaagaaatgtgtcccattcaacataccccaatagagctttcagcagatatcccagcagaaaccctgtaggccagcaaagagtggaatggtatatttagagtgctgaaggaaaagaaaaaaactgccaagcaagaatactgtacccagcaaagttaccctttataaacacaaaggcaagataaagatttttccagacaaacaaaagttgagggaattcatcaacaccagacctgtcttacaaaaaatgctaaagggagctgttcagtcagaaagtgaaggatgctaatgggtaaaaagaaagcatctaatggcattaaactcaccggcaaaagaaagaaaactcactggtaaaagaagacttctgaaaaattcagaatattgtaatactgcaaatgggatgagtaaaccacttatattttaagtatgaagactaaaagacaaattttttttttttttttttttttttttaagacagagcctcgctctgtcactcaagctggagagtgcagtggtgcaatctcagctcactgcaacctgcacctcctgggttgaagtgattctcatgcctcagcctccgagtaactgggattacagatatgtgccaacacacctggcttatttttgtatttttagtagagacagtatttcacaatgttggccaggctggtctcgaactcctgacctcaggtgatccgcccatctcggcctcctgaagtgctgggattacaggcttgagccaccatgtccggccgacaaaactattaaaaacagtaactacaacggttatttaggagacagacaattgtttaagcaataaaaagattaaatcaaaacatcaaaaagtcaaaatggcaatggcggtgttaaagtatagagtttttgttacttttctttgcaaagttaagtgattatcagtttaaaataacctattataagatttttttgtaagcctcacagtaaccataaagcaaaaacctataatagatacactaaaaataaatagcacaaaatcaaagcacgctgctagagaaaatcacttaccatagaggaagacagtaagagaggaaaataggaagaaagaatctacaaagcaaccaaaaacaaggaacagtatggcagtagtaaacccttacctgtcagtaataactttgaatataaatggattaaattcttcaattaagagtggcagaatggattaaaaaacaagacccatccatatgctggctacaagaaactcacttcatctgtaaagataagcacagactgaaagtgaaggtatggaaaaagataatttatgcaaatggaaaccaaaaaagagcaagagagcctatagttttatcacataaaataaacttaaatcaagatggttaaaaaaaagacaaggccattatataacgacaaaggggtcagtacagcaagaggatataacaatggtaaatatatatacacccaacaccagagcacccaaatatataaagcaaatattaatagacctaaagagagagatagactgcaatacagtaatactagggaacatccacactttcaatgtgaacagatcatccagacagaaaagaaacaaagaaacgtagacattaaactgtactctggaccaaatggacctaacagatatttacagaacattccatccaacagttgcagaatacacatttttctcaacagcacatggaatattctccaggattgatcatacattaggtcacaaaacaagttttaacaaatttttaaaattgaaattatatttatcttgtcacagtggaataaaactagaaatctataatcagaggaacattggaaacagtacaaattaatggaaattaaacaacaaatggaccaatgaagaaattttaaagtaaattttaaaatttcttgagacaaatgaaaatggaaacaaaataccaaaacctatgggatacagcaaaagcggttctaagagggaagtgtatagcaataaacgtctatatcaaaaaagtaaaaagacttcaaataacctaacgatacacctcaaggaactagaaaagcaaaaccaaacaaacccccaattttttgttctttttttctccgtgaaaaaaggcatctaaaaaacaaaccaatgttaatagaaagaaataataaaagagcagaagtaaatgaaaccaagactaaaagaatacaaagatcaatgaaatgaaaatgtttttttgaataggtaatcaaaattggcaaacctttcagaagactaagtgttggggggtggtgggtggggggagagaagacccaaataagcaaaaccagaggtgaaaaatgggacattgtaagtgataccaccgatatacaaaaagatcattagagactactatgaacaactatacaccaaaaaattgcaaagcctagaaggaatgtgtaaattctctgacacatacaacctaccaagattgaatcaggaagaaacaaaagacctcaacaaaccaataatgagtaatgagattgaagccatataaaaaaagtctctcaaccaagaaaagcccaggacctgttgcttcactgctaaattctgccagacatttaaagaactaataccaatcctactcaaactcctcaaaacaaaaatttttttggaagagaagggattacttcccaactcattctacaagggcaacattaccctgataccaaaaccagacaggatgcaacaagaaaatgacaggccaacatccctgatgaacacagatgcaaaaatcctcaacaaaatactaacaaaccaagtgcaacaatacattaaaaagatcatcctgggatacgaagaggggaagaacagacttacttgagggtggggggttggaggaaggagaggatcagaaaaaatacctattcggtactatgcttattacctgagtgatgaaataatctgtacaccaagcctctgtgacacacagtttacccacataacaaaccagcacatgtacccctcaacctaaaaaaaaaaaaaaaaaaaatcatcatgataaagtggaaatccgagggatgcaaggatgattcagcatacccaaatcaataaacatagtacattacattaatacaatcaagaccaaaaaccatatgatgatttcaatagatgctcaaaaagcattcagtagaattcagcatcccttcttgataaaaattctcaacaaacggtatagaaggaacatacttcggtgaggtgtagtggctcatgcctgtaatcccagcaatttgggaggctgaggtgagtggatcccttgaagtcaggagtttgagaccagcctggcccacatggtgaaaccccatctctactaaaaatacaaagcctgggtgatagagcgagactttatctcaaaaaagaaaaaaaaaagaaggaacatatctcaaaccatatatgacaaacccacagctaacgtcatgttcaacagtgaaaagctgaataatgaataatttttctctaagattaggaacagacaaggatgcccactctaaccacttctgttcaacttagtacttgaggtcctagcccaagcaattaggcaagagaaagaaataaagggtacccaaattggaaaggaagaaaccacattatctttatttgcagataacatgatcctgtatttagaaaaacctgaagactcctccaaaaactgctagaactgataaacaaattcacttaagtttcatgatacaaaatcaacataacaaaaatctgtagcatttctatacatcaacagcaagcaatctgaaaaagaaatcagaaaagcaatcccatttacatagctacaaaaaaaataaaatacctaggcatgaacttaaccaaataagtgaagaatctctgtgatgaaaactgtaaaagactgatgacagaaattgaagaggacatatagaaaatgaaaagatacttcatactcatggattagaagaattaatattgttatggagttcgagaccagcctggccaacatagtgaaaccccatctctactaaaaatagaaaaattagccaggcctggttgtgggtgcctataatcccagctactcaggaggctgaggcaggagaatcacttgaacctgggaggcagagggtgcaccaagccgagatcatgccactgcactccagcctgggtgacagagtgagactccgtctcaaaagtcagtattacccaaagtaatctacagagtcagtataatctctatcaaaataccaatgacatttttcacagaaatagaaaaaacctaaaatttgtgtggaatgacaaaagaccttgaatacctaaagctatcctgagcagaaagaacaaagttggagacatctcactgcctgactttgaataccacaaagctatggtaaccaaaacaccatggttctatatatatgtgcacacattttatacacacataggtatataaaacacctacaaatttttgttttttgagacagagtctcgctctgttgcccaggctggagtgcagtggcatgatcttggctcactgcaacctccgcctcctgggttcaagcaattctctgcctcagcctcccaagtagctgggattgcaggcacccatcacaaatgcctggctaatgtttttgtatttttggtagagatgggttatcaccatcttggtcaggctggtcttgaactcctgacctcatgatccacctgcctcggcctcccaaagtgctgggattccaggtgtgagccaccgcactcagcctagacctacaaaattatacttggagaatcctgacaaaaaggctggctgagaaagcacacccataattatactcaactctcatatagagaactccatttaactttgtagtgcttcatagccaagacttgccagaaattggcagaacatctctaacataagagagaccaaaagaaagaaaaatgtacctcggagataacaaaaacaatgtaataagcaaaagaaatcataaatgaactgtaattaatattcttgtagaggtgaggtgaaggaacaagaataaattgctattttctaaaacattcagaaagcttgggaactaaaaataggagagctgaaatttaaaatcagtgattggataaagttgagaaaatatcttagtaaaacaaaaagaaaaaacaagagatgacttagagagaaaagataagaaacttagaagcaaaattcaagttgtctgatgtttaactgactggaattccagaaaaagagaatagagaaaacgaacagcaggatgttatcaaaatgacaatataagagtagatggacatgtatctgtttccaataccactgagtgaggaaaataagccacagtaccatgaaactgtagaacaccaaggacaaagagaagctgcaaaaactgaaaaatcaactcttcaatcagaaaattgaggcttcagggcaaaccattctcccaaaaactggagggaatggtgcatactgagaatcacagattacctccagaaacctcaccagattctcagggtaaagagaaaaatctcctcaagctttaggtagggagaaggggaaatcatcatcttgaaataagccgtagcactccttagcaatggtttgctctcaaagtaaactgtttaatcaagcctaattgacatgtgctttaccagagcctaacagacctggaggaagatgtgttagtccatcttgcattgctaaaaaagaatacctgagactggtaatttataaagaagaggggtttatttggctcacatttctgcagactgtacaagaagcatggcaccagcatctatctgcttagcttctggtgaggcctcaggaagctttcccttatggtggaacacaaaggggaacaggcacagcacatggagagagagagagcaagagagagaggggagggaggtgccagactcttgaacaaccagatctcgcaccaggtcttgcgtgaactatagttatagagtaagaactcactcacaagtgcagggacaacatcaagccattcatgagggatctggccccatgacccaaacacttcccactaggccccaccttcaacactgggaatcacatttcagcatgagttggaggggaaaaatacccaaagtgtatcagaagggaaacacccaactgcagccctctctagccttcctgtcttacctaattggggagaagggaacctgagaagcacttgtgaaagtcacggcccaggcacacaggctcactaaaagactgagaactaattatgtgattataagacactccccccaccacacacacctcaccaccacaccaatcagtctcctgtgtaatgatagtggattactgctaaatgaactaattttcagaccctattctattttaataaggagtctttagggaaacgaagaaatgatagatacaaaaacaaggatgtgattgtaacaacgtgggtacagctggaggccattatcctaagtgaattaatgctgaaacaaaaaaccaaaaactacatgttccgaactcataagtgggagctagacattgggtattcatggacataaagatgggaacagtagacactgggtactgcaagagacaggagagagggaggggagaaagggttgaaaagctgcctattgggtactatgctcacgacctgggtagcaggatcagttgtaccccagacgtcagcatcacacaaaatacccttgtaacctgcacgtgtacccctgaatctaaaataaaaattgatttaaaaaaggacactaaaggaaatgtaacctatacagctacacaaaacagtaaacacagcccaactcttagccagagaaacataaagcctcaaacaagaggactttttaccgcagtttcttctacccagtatatcatgtctgctttcaacaaaaacttacaagacatgctaaaaggcaaaaatcaaagttgcatgaggcataacaagaatcagaaccattgccagactcatttatggcagcgatttttggaataatcagactggaaattttaaataagtatgattaatatactaaaggctctaatggaaaaagtgaacaacatgcaagaaaggtgggtaacataagcagacaatagaaactctaagaaagaacccaaaagaaatactagaaataagcaatactataacagaaatgaagaatgcccttggacttattgatagagtggaaaggacaatagataacctgggaaagattcaatgagcttgaagatatgtcagtagaaagttccaaaacttaaactgcaaagagaaaaaagaataaatgacagaacatggcggggcctggtggctcacactgtatctccacacttcaggaggcccaggtgggaagatcacttgagaccaagagttgagggccagcctaggcaacagagagagatctgttgactccacaaaaaataaaaaggaaaagaataggatatccaaaaactgtgggacagttacaaaattatatatatttaagtccttgctttggctgaacctaacactaaaattggaacaataccaagaagattgcacaacatggccctgtgcaaggatgatatgtaaggtcatgaagcatagaaaaaacatttctaattgttttttttagatggagtctcactctttcacctgagctgtagtgcagtggcatgatcttggctcactgcaacctctgctgcccagattcaagcgattctcctgcctcagcctccagagtagctgggattacaggtgtctaccactgcgcctggctaatttttgtaattttagtggagatggggtttcaccatcttggccaagctggtcttgaactcctgacctcgtgatccacctgccttggcctcccaaagtgctgggattacaggtgtgaggcacctcacccagccaacatttctaatttttttttttttttttttttagacatagtctcactctgtcgcccaggctggagtacagtggtgcaatctcggctcactgcaagctccgcctcctgggttcatgccattcttctgcctcagcctccctagtagctgggactacaggtgcctgccaacacatccagctaattttttatactttttagtagagacggggtttcaccatgttagccgggatggtctcgatctcctgaccttgtgatccgcccgcctcggcctcccaaagtgctgggattacaggcgtgagccaccgcgcctggccaattttttaaaaaattaaaaaaaatatgtgtatgtaaaattgtgtacacacgatgggaataacagaggaaaagagagaaaggaatagaagaaccatttgaagtaataatgactattttcaaaactaaagacagatgccaaaccacaaatccagtttagaaagttaagaaaacaagcaagatcaataccaaatgccaggtgcggtggctcacacctgtaatcccagcattttgggaggccgaggtgggcagatcacttgaggtcaggagttcaagaccagcctggccaacatggtgaaaccctgtctctactaaaaatagaaaaattaggcctggtggcaggtgcctgtaatcccagctactcaagagactgaggcaggagaattgcttgaacctgggaggcagaggttgcagtgagctgggcaccactgcactccagcttgggcaaaagagtgagactccatctccaaaaaaaaaaaaaaaaaaaaaaaaagataaatacaagaaagtctgtacccaggcacctaggcatatcataatcaaattgcagaaaatcaaagataacatcctgaaaaaacctagaggaaaaaaaacacctatggagagtggagtgaaatatctctatatttattatgtctttattatgtttttaattatgtttttcatttatttttgtggttacctggtaggtgtatatatttatggggtacatgagatattttgatgcgggtatacaatatgtaataatcacatcaggatgaatgaggtatctgtcacctcaagcatttatcattttcttgtattacaaaccatctagttatactctagttgtttttaaataaatagttaattattgactgtagtcgccgtgttgtgctatcaaatactagattttattccttctatctaataatatttttgtaccctataattatcccctcccccacccacctacccactacccttcccagcctttggtaaccattgttctactctctatttccatgagttcaactgtcttaatttttagctcccacaaataagtgagaacatgtaaagtttgtctttctatacctggcttattttacttaacataatgacccccacttccatccatgttgttgcagatgacagggtcattcttttctatggctgaatagtacatatatatatatatatataatatttcctttatccatttatctgttgatggacacttagattgatcccaaatcttggctattgtgaatagtgctgcagcaaacgtgagaatgcagatatctccttgatttactgatttcccttcttttgggtatattcctagtagtgggattgctagatcatatggtagttccatttttagttttttgaggaacctccatactgttctccatggtggttgtactaatttatattcccaccaacagtgtaccagggttcccttttctccacatcctcaccagcattcgttattgcctgtcttttggataaaagccattttaactgggatgagatgatatctcattgtagttttgatttgcatctccctgatggtcatgacgtaatattgagtaccttttcatatacctgcttgccatttgtatgtctactttgtagtaatgtctattctgatcttttgcccattttttattgtattattcgattttttattgacttgtttgagctctttattctggttattagtttcttgtcaaatggatagtttgcaaatattttcttccatttgggggattgtcacttccctttgttgattgtatcctttgctgcatagaagtttttacacttggcatgatcccatttgtccatttttgctttgggtgcctgtctttgtggggtattactcaagaaatctttgctcagtgcaatgtcctggagagttttccaaatgttttcttttagcagcttcatagtttgaggttttagatttaagtatttaattcattttgatttgatttttgtatatggcaagagataggggtctagtttctttctttcttctttttttcctttgcttttcttttttttttttttttttttttttttgagacagggtctcactctgtctcccaggctggagtacagtggtgtgatcacaactcattgcaacctccacctcccaggttcaagtaattctaatgcctcagcctcctgagtagctgggatttcaggtatatgccaccatgcctggctaatttttgtattttgagtagagacggggtttcaccatgttgcccgggctggtctcaaacttctggcctcaagtgatccactggccttgacttactaaagtgctgggattataggtgtgagccaccatgtccagcaagtatctagtttcattctactacatatggatatccagttttcccagcaccatttattgaagagactgttctttccccaatgtatgttcttggcacatttgttggtaatgagttctctgtagatgtgtggatatgtttctgggttatctgttcttttccatcaatctgtgtgtctatttttatgccagtaccatgctgttttggttactataactctgtagtataattcgaattcaggtaatgttactccaccagtattattctttttgctcaggatagctttggttattctggatctttcatggttccaggtaaactttagaattgttttttctatttctgagtagaagaattttattttattcatagctattgtaaatgggattactttcttgacttctttttcagattgttcactgttggcacataaaaatgctactgatttttgtatgttggttttgtcttcttcaactttctgaatttattagttctaatagtttttttggtggagtcttttggtttttccaaatataaggttatattatctataaacaaggataatttgacttctttctttctagtttggatgccctttctttctattttcttattgctgtaagacttacagaatgaaatatttaaagtattgaaagaaaaaccccaccaacctatggtaactccatgtttccagttggtagttgcttaggcaaaacaccttggagtcattcttgattctccttgtccctcacatcccacatcctatctgttaggatatcgagatgtaataagaaaaaaaaaattgtaatcctccccttcttaccacctctatttctatctccttggtccaagccatcattatctcttctctggattattgctatagactccatactacagtctaaacagagcaactagaatgattaaagtccaatctagtactactacagaagcttcccatttcactacctgtctatgaattacttaatttctctgtgtctcagttgcttcatctgttaaaagagaataatacctcctcaggagattgtgtgattgatgaggaggcacttacttaataccaacctgatgcacagaaaatagtaaagtttagcgattttttttattattttaatttccaatttgcccttcaaatcagaagcttagttttgtcttattcttcagtgcttgaggtgggagggtttgtagaaacatttggcttctgaatacctagctcattgctgtcaagcagaatcctccatcttttagtgcctgaaaatattcagatgtccagaaacattaaccaaaggaaattccatttctagctctgctgtttgtataggcaatgtagtgggtcagttttctgcactgtgtagaaattgctttgtcagtggaaaatgttattttcgtcggttttacagttcctaacttttgaggcatttgttccctggaggatactaaaagaaggaaatcttcagacagctgcccactgaatttttgcgtgagcctttatttgatattttacccagaccccttttggttttttattacagtaacatcgcatacctaggttttttttttcttcttcatataagccttacctatctggaactgtcagtactaggaaggtacttatagtgttgaatgttcccactcatatttcctgttatgccttatgctttttataacaagccaaaaagaggaagaaagatttcaccatagatttgctaaaggcaatgtgggatgcaatgagtgtggtttaatggaagagccctggggtgcggcctctgagccttgctctgccactgacacctgtatgactgcctgggcttgagttaaacgttctgcataaattctagcagaagaggctagctcaaagaggagattcagtgtctgaatgtctgagagagtgtgaaaataagaaaagttggctgggcgccgtggctcacacctgtaatgcagcactttgggaggccgaggcaggcggatcacctgaggtcaggagttcaagaccagcctgaccaacatggagaaaccctgtctctattaaaaattcaaaaaagtagccaggcgtggtggtgcatgcctgtaatcccagctactcaggaagctgaggcaggagaagtgcttgaacctgggaggcagaggttgtggtgagccaagattgcgccattgcactccagcctgggtgacagagcgaaactccgtctcaaaacaacaacaacaacaacaacaaagtcaagtcacttgagacctcaacccactgacaagagaagagggactggggcagacccaacctgaactggttctgtaaagcagccacggcacagaccagagtggactgtgggcctgagcagtgtatgcccctggggcctggaaagtaggggctgggacttcatttcttgaatagagggagaaggaaagacacttgagaatctggtaaaaacaaaaacaacaacaacaaaaaacccaaaacaaataaaacattctagtagcttcagcccctccactgggcatggtgtcttcttgacccacagacaataggcaggcaaagtagatggaagcaagtgctaacatgatacacagctcccagggcttagacacttcccacctcagcaagctggacccatccaagctgtggtgtcagggtagaacaaatgattctttttttcgagatggagtttcgctcttgttgcccagtctggagtgcaatgctgagatcagctcactgcagcctccgcctcccaggtttgagcaattcacctgcctcagcctcctgagtagctgggattacaggcgcctgccaacacgctcagctaattttttgtattttaagtagagatggggtttcaccatgttggccaggctggtctcgaactcctgacctcaggtgatctgcccgccttcgcctcccaaaatgctgggattacaggcatgagctaccgcgcccagccgaacaaatgattcttatatgtagattctttagggagcagctaagccagcccccattgactgggggagatgatggtagctttgagacactcctagcagctgcagttttgttatcctgcaccctgttcactttccagggccatgcacctccacggaaataccttatctataagccttgtgtctctacttcagtttaggtctcctagactgtaacggagaacaaaaaaaaaaaatagaccaagttttaggcattgcaggaaaaaaaagtgtgttcattctctgagcctccgaagtaatgcagctatatttataagtggatcagtaaaaggagaaacttctttaggtttttagacctgggattcagcattgagattttctgtgctctgaaggactatccagtaactgtccttccaataactttccttagtttcttgttacaatcgcgattccggtggttatcaaacttcttcctagtggattgcttttccactcttcattgacattacttgttcccaagtttttttttgctgttgcaaagtgttgaaataaacatctttgtacttaaatgatatatgtgtaacagtaaatttttaacattaaaccactgacttaattcatttattgaattttgttgtagtatatcacacatacagtataccaatcatttatcaataactgatgtgttcacaaaatgaacacatgctcataatcactactgatatcaagacagaaaattaccagcaccctggaagcctctctcagcttctctctctcaatcactaccacctccttcctacccagggcaaacagtatcctgatttctaagatcattgatttgttttacctacttagtagctttaaattttttaaatgaagatgtagtatattattctttggaatctggctccccacctcctcatcattatgttgagattcatctgtgttgttgctaatgtagcagagttcatttttttgttactgtatagtgtatcattatatgcgtagatcacgttttttaatttattctttctcattgcactgttctgcaatgccaccttgccgtaaaccaggcatctgcatctgaggggctgtttctggacctgtcattctgtttcatcgatatatttatctatccttgtgccaaaaccctactgtcttacttatggctatatcattaacttagctaatgtttagagctatgtaatgtagataattgtagctgtataatagtaatgtatcgatatctggtagaataagttcttctactttgttattcttttaaaactaccttgactattcttggccctgtgtatttccatataacttttacaatcaagttgaaattactccctcccctccaaaaaaaaaaaaaaagcatgctagaattttgattgggaattctttgaggagaatggctatctttattatattaaatcttcctgtccctgaaagtggtatgtctgtttatgtgggtctttaatttctctcaatagtgttttatagttttctgtgttaaggttttatatatcttttattgatttactcttacatattcagtgggcttttaaatgtaataaatggtatttatcacaaatttatcataaagattcctaattattgcatgtattagaaacatttttatatattaaagcataggtttttaattataagattttatgagatttacggtttatatcattttaagaatcacttaatattcaaattcaaatcaccatgagaattctgggtaaattgagaaaagtaaagttggattaaatccagggttgtatccttggagaattcaaaaggaaccaggaagagcttgttcctaaactgcgtgagttctgtgttggttgcttgagagagattgcctagggcttgcttcctctctcagctaaagtgattgggatttggcagtcagggtgcttttgtttttagggtaccctgagccctctcctagccagcccacatttgtgagcactcggtaaacacagagcaggagggaattacagtgaatggggatttccctcagtgctgcccactggctgctcttgaactgacaggcttctttctcattctaaactcaccagcagtggagcagtaaacccggccacggtcaggcatggcacatgtcctgcaatgatggggactggacctgttgccttaaactcacgcctgctttgtttttccaggtctataagggagaattccaactacctgactttcttaaagaaaaaccacaggtactgtgtctgctttttcctcctgatgtatactagattggctcttgcattgaagtaatatttttaaagagataatgaaattaaaaagacagaaacaagaaaaccaaaaagaaaagaagaaaagggatagtgatatgtgctggggaagaaagatcagcgtctgggacttgttgattttaacaataatttaacacagtcttaatttcagagagctcagtgtctcccaaaaccagggaaatactttattgataaccaaattctgattgcttgaggtcctgcacaagccgcccagtgggtaaagctgctccagcgttccagtgcctaatttgaaataaaaatgttcagcgaccctctctgttcctactctgtgtactgtacatccttgcccctttgacttttctcatttggagcccagatgacttatatatacacatagtcactggcccctgggaaggacagtgagagtttgaaggattaaagccagcatggtggctcatgcctgtaatcccagcaatttgtgagaccgaggttggcagatcacttgaagtcgggagttcaagaccagcatggccaacatggtgaaacctcatctctactgaaaatataaaaattagccgagtattgcagaatttgcctgtaatcccagctacttgggaggctgagggagaatcacatgaaccgggaggtggaggttgctgagccaagattacaccactgcactacagcctgtgtgacagaacaagactgcctcaaaaaaagaaaaaattagctaggcatggtggcgaggcctctggtcccagctacttgggaggctgaggcaggaggatcgcttgagcccatgaggtggaggttgccatgagtttagattgtgccactgcactccagcctgggtgacagagtgagaccctgtctcaaaaataaaaaaaattaagcagattcagagttttccctgtaacgtcttctctcactgacttgcattccaatcctgtttcctgggttggaaagaaacagggagtctcacggctgacatgcctagaggagcccggcatcctgcctctgggcatcactgtcatgcccatatggaagtcagaaaaaatggacactcatggcctgagtgcagccgacttccctttccagcaaggcgatgatgcatgttgcctccaggctgctgctgtcagtgattagcttgtcaataggaagaggagactcagttttgaactcagtttctgaaagcgttccagatagaggttggtgaagcaacagcacctcagagacttgtgtgaagtccagttgcctgatgcaagcctggagtaaatgggctgccctctctgagggaagccatgtctcacaccagagttgaagcctcttccttcctgacccttttctgaaaacacttagccgccagtaattgatacatatgacttgagtgtttcaaagtactttcaaggcatattcttattcacatatatttactattcatccattcattcacttattcaccaattgtttacccagtgtctactatggtgaggaattagagtaagtcctcaggagtcacgggggaaagaaagacctcaaggagctcctgatttatccagaagaatccgaccacctcgtgcagacaaggggacacagagctctgggcccaggctgggcatgatgtcccagaaacctgggcagattcatgaacagactgacaccggctgtggaaattggagccagagaatattccaagaggctgtcttgaaggaatataaaatccaaaagcgcccaggtgcggtggttcacgcctgtaatcccagcactttgggaggcccaggtgggtggattgcctgaggtcaggagttcaagatctgtttagccaacacagtgacaccccgtctctactaaaaatataaaataattagcaagacttggtggtgtgcgcctgtaatcccagcctgggtgacagagcgagagtctgtctcaaaaaaaaaaaaaaaaaaaaaaaaaaaaattccaaaagccggtttgcataacaaatctgaagaagtcaagaaaaggtatttgagactaaaactaaagggacactcctgcttcacaacatacctaaaaatatttccaaatggattgcacacctaaatgtgaaaggcaaaataatgaaagttgttagaggatatagaagagccaggcatgaggctcacgcttgtaatcccagcactttgggaggcaggcagattgcttgagtccaggcattcaaaaccagcctgggaaacatagccaaacctcatctctactaaaaatacaaaaaattagctgggtgtggtgcatgcctgtagtcccagctacttgggaggctgaggtgggaggatcacctgagccccagaggttgaagctgcaatgagccgagatcacaccactgcactgcagcctgggcagtcaatcctgtctcataaaaacgaagaagataatagaggaaccatctttatgaccataagaggacaggatttcttaagccctaaaaagtactgattattaatttaaaggtagataatatgaactacattataattgaggatgtttatgtaataaaaatcatgagagtaaaatagtgagcctaagtaggagaatatatttgaaacaaaggacttatctggagccgagtgcagtgactcacacctgtaatcccagcactttgggaggccaaggcggctggatcacgagggcaggagttttagaccagcctggccaacatagtgaaaccccatctctactaaaaatacaaaaaaaaaaattagctgggcgtgttgggcacctgtaatcccagctacttgggagggtgaggcaggacaatcgcttgaactcaggaggcagaggttgaagtgagctgagaacgtgccactgcactccagcctgggaaagattgcgagactccctctcaaaaaaaaaaacaaaaaacaaacaaacaaaaaactcatctgtggaatatagatcatcatcgtaagggaatttttttttaaattgggcaaaaagcctggacaacatagcaagaccctatctctatcaaaaaattagctgggcagggccaggcgtggtggctcccacctgtaatcccagcactttgggaggctgaggcgggcagatcacttgagattaggagttcaagaccagcctggcaaacatggcaaaactccatctctaaaaacaagtaccaaaaaaaattagctgggtgtggtggcacacacctataatcccagctgctcctgaggctgaggcaggagaattgcttgaactcaggaggcagaggttgcagtgaaccgagattgcgccactgcattccaacctgggtgacagagcaagactccatcaaaaaaaaaaaaaaaaaaaaaaaggctgagcgtggtggcatacttgggaagctgaggcaggatgatctgttaagcccagacagctgtgattgtgccactgcactacagcctgggttacagagggaaaccttgtctattaaaaaaagaaacaatcatgcagaagtgtgcacacagagacacacacacgtagaaaagggcccataaggtcttcagtttaacttctaatgaaaatcagcagaaactcatagaaccttcagattgaataattagctagaatggttcataaaactcggtaaagtgtagtacttaacaatgacagttttataaaggatgcagatcaggaccagccataagatagaagtgggcccaggagggtcctgaatgcagagcttctgtgcctcctccctatgaaagcagggcacgtcaccctcccggcacacccatgtgttcaccaaccgggaagtgccactgaacttccacacccagcatttttattggggtttatttatgcaggcaagattgatcaaatcgttggtcatgtgttagaactcaatctccagccaacctcccctccccagagttgacgtgggctccaagccccagcccctgatcccatggttggtctttgtggtgagcagccccatcctgaatcatctcataacataaatccagatgtgatccaagggcatcagaaataacaaagacactcttgttacccaggaaattccaaggattcggcatttccctcccaggaaccagggggaaaggccagtcagattcttgagcataccacagtagtgcactgagttcatctgaaagtgaacagagcctgcgggccacccctcatgtttcagtggggacggtcacttctcatgctgaccaacttcaaggacattaaaacatcttttctttccttcaacagactgagcaagtggagtagcagaaccaggagcctcttccatacatgaggtgagggttgggggacattgccaggtctttctgtttcccactcgggctcttgcagggggctgggtggccaaggtggagagcacagctctggagtccgtctgccagggttggaatcctgcctcttcactttctgtgtggaagcaagcacattacttcacctctctgtgtcttcatttattcatctatgaaatgaggataatattaacaagagcatggtggtgagaattaatcatcatccaagagcctggctcataataagcgcacaatagtattgttattttcattatgaaccatgaaatatttcagctgaaagggacctggaggccatcaagcccaactccctgtttactgataaggaagctggtcccagagggagcaggtcgtttgtcaggaccatagtccataggcaaggaaacccagaactcaagagtggctgtttacttctggttacctgttcagccagggccccagccacccatccccacctccagtggctttcttcgtgtgctggacttgcagatgtttttgccctactgcaatttttgtttgtttgtttgtttcttggttggtttttcaagtttgcccttgcttgttttaatgtattatggatggcttatgtgagtaacctatattgtctcattggactaagtgctacattgtagacaaggccagccttgccttctcagccctttttctatctgagtatgtggccctcatcaggcacatgtccagggacaccagctcatgagtggcaaagctggtttctcagcccagatctccaggtgcagctgctcagagttcatacccttgtcccagactttcagtctctgcttatccacccaaactttcttaagatcagttttgctccaaatgatgtggcaaagcctttgatcagttgtaacttgaacagccttttcaaaaaatctgatattggctgggcatggtggctcatgcctgtaatcccagcactttgggaggccaaggtgggcagatcacaaggtcaggagttcgagaccagcctggccaacatagtgaaacctcgtctctactaaaaatacaaaaattagctgggtgtggtggcagggacctgtaatcccagctacttgggaggctgaggcaggagaatcacttgaacccaagaggtggatgttacagtaagccgaaatcgtgccattgcactccagcctgggtgacaagagagagacttcgtctcaaaaaaaaaaaattggctgggcgtggtggtgggcacttatagtcccagctactcgggaggctgaaggaagagaattgcttgaagccaggaggcagagaggttgcagtgagccgagattgcagcactgcactctagcctgggtgacagagcgagacttcgtctcaaaaataaataaataaataaataaaaataaaatctgatattgatagtgattttttctcatagtttacttgctgacctttgttttttttttttatataatgtttttatttttactttatataatgatgtattgtgcatactccataccaggcataaaataccaaggattttatttgcatatatataagatgatatatatataacagatacgctaaattatatatacatctatatataaaattgtattcagttctcaaaccactctggcaagctggtagtattcctgttttgctagtgagaaaacaggttgaatgtgacttgcggtgcgttgatggattatagacataagaagcacatggacgctggtccgtcatgtcaaaatcccagatggcagcaagctgctaatattgacaggttctaggattcaggtttcctttttgctgaggagcaaatgctgaatgttagtcttatgccctgtgggtctgcatatttaacagcagttatcaggccttggctaattttgtttatacaaaatgctttcaaacttcataggtaatctccctgcccgccccaccaaacacacacaaggcctcatttctttaccagcgtgttgtaggatggaccgcatcagcagttgcctctgcagcatttcaccctggcttgtgtgtggaggttgggaggggccaacctgtgctgaggaggactcaggagaactggggacacagcaaagcccttaggatggatactatctttcttatcttttgggtccctttggcatttcaataacagtatctgtgttctctggagcttcctttaaagaaccttaggatccatttcttcacgtgaggaggaatcagggtgctgacccctggacacttaaagaaccttaggacccatttcttcacatgaggaggaatcagggtgctgacccctgggacacttaaagaaccttaggacccatttcttcacatgaggaggaatcagggtcttgacccctggacacttaaccttaggacccatttcttcacatgaggaggaatcagggtgctgccccctggacacttaaagaaccttaggacccatttcttcacatgaggaatcagggtgctgccccctggacacttaaagaaccttaggacccatttcttcacatgaggaggaatcagggtgctgccccctggacacttgaagaaccttaggacccatttcttcacataaggaggaatcagggtcttgacccctggacactttaagaaccttaggacccatttcttcacacgaggaatcatggtgctgacccctggacatctggtgcccctgacagtgcccccacagtagcaacaatagcagatgacagtcagttatttagaaatgggcaggagcagccctggttttggccatctgcttgctttgcacccagcagctacttgcatgcatctgaaagcaccagagtgagggtgtgtgtgcctcccaggcagtcttcctgaggcagctgttctcaacatccatcctcctggcccctgatctgcaggaacctccccaaccgcctggcttgtctaggcctgtagctgggaaggaagagacgaagacacagggagaacacaccgggactccacacctgtaaccacattctgtttgttcgccctaggaaagattgctgccttttcagcagaagggaaattcctaggattggctgtcccctgccaagcttggtggagcgtctgcaccttggctgcgccgcctgtgcatttgccagtttcctcccactgagaggatggaggtgtccgcacagctttgggcctcgtgagggatctgcctcctgagcaaagagctcttgatcccgatttcatgcacagccctgcagtaaggagcccagaaggaacatgtgtttcctgttaaaactcctcttgttctcttttcttacattatgacgtttgttttcaaggagagggtttaaaaatgggatcctgtaagcagacttgggcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaagc

SEQ ID NO: 36549 - DNA, 3857 bp, Homo sapiens
gcccgccggtccacgccgcgcaccgctccgagggccagcgccacccgctccgcagccggcaccatgcgcgagatcgtgcacatccaggcgggccagtgcggcaaccagatcggcgccaaggtgggctcaccgccacggaggggcccggggttgggaccgagggtgcgggctggggccggggcgggggctggaggccgcggcggccccgggctggccgggtggcacattccgcggcgaggccgccgggcggggtccgggaggctgcatgacccgccaggatgcccgcagcgccgcagctgtgtgtgcgtttaatcgggggcctttcgatttccctgggacacagcccttctgcgggacgcggttggcattcccctgggtgtatttgtctcagaaacttgggtcgggggtacggtcatatttattgcgctagcttcatgtgaatttaatttgtatatttttctctacggtttgaatgaaaacatgcagtgtcactggactggcagatgtaacagaggcgtccctttgggtcgtacaggcaagggtgttagataaattcccttgctcgggcactgtcttgacatgatgacatacaacgcgatagtcttgctgccagtccccgaggcggcaggtgactgcgctgggtgggggctgcaattaccgaccgctgtgtgggaggcagcagcgggtctggtgcatgggtgggggcgggcgccagtacaaggacgtggtctctttgagaaccgccatgttgcccacccagcctccccgccgcaaattcacaatgcagccagcgccctcacgatggccagctccttccactgccgcccaggtgccctcccaggctcctgctgcccttcgcccagtccctccggtggtcagtgccagcatgtagatcggtggcttaaacctgcactgttgcaggagtgcctgggatctgtgccaagagagcttgatccctggaggcagccacagagtgggtccccctgtccttggcctgccacgacccatcaatcatcccggatgcaatggcattcagccctgcctggggtgacacagcctccctgtaccccttctccacttctctactctccccaccctctccctagaagggcatctgctgtgtcccctcctcctccagggcccctcccagcctttcagtctatccccataatatggccgatgctctgcggattttcaagcccctcagcagcggctgctgcaggaaatagggggtgcagctctttgctctctgtctagcacttactaactgtctgaccacaaaagcccctgttccaaggacatgggaggaggacaaggccatccttagtgacattcaggatgcagagccatggtgtggttcttttttcatttcagttttgggaggtcatcagcgatgagcatgggatcgaccccacaggcagttaccatggagacagtgacttgcagctggagagaatcaacgtgtactacaatgaggctgctggtgagtagcgggatgtgtgtgcccaggaatccttgctttccatgatgtgggagatgaaacgtcccaggaacatgcacgtgacaaaggcatgcttcttgcatattcatttcaaatgccaactgctggaaaaacatgttttatggtttcctaagattcctgcctgtttgccacggctaagcacactcaggacctcctttttcttaaaagcagaaaatctcctgttctccttttgtctcagatgctggaattgaatgctgctgtgagtccctccccaagcacaggcctgagtcagttcttatttcctgcaggtaacaaatatgtacctcgggccatcctggtggatctggagcctggcaccatggactctgtcaggtctggacccttcggccagatcttcagaccagacaacttcgtgttcggtatgtagtcatgatcactgggaactggccaaatgacacaccttcttcctaacagccctgcaaagcacagttcttagtgttcagtgccaaggtgacactgtgtccacggcagccctgagtcctggcctagctccatgcagtccatgggtggtcatggctcacagatcaacgccagcctgcagagggctgctgcagccctcccattgcagagcagcctcagactggaaggaagaaagagcaaggaaaagcttcaagccaggcttcataggctataggcaacttgaaaggacttcaaagagccaggggccaaaagcacaggttatgaccagagctagacagatgctgaggccaccttctctgctggtcacactgccttcaccttgcctgtttaattgtagttgagtataaagagaatgcctcttaaaaatgtatgtatttcagaaccaattaagttttctaaccctatcctcttcctcaatcaatagcctcagatgagctaaacttacttcttactttattatgatccccagtgtttttgaggtcactgacatagaaaaatatttcttcaggtaaaagaagagtattcaaaagagaagaatctgccagtctaagaccagtcctaccttctcctccatagtcaaaatgacagattttgaaattccttatgttttagtgtctaatgttcactttccctctggcaggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtag

SEQ ID NO: 36550 - DNA, 768043 bp, Homo sapiens; identical to SEQ ID NO: 35581
  misc_feature (106202)..(206201): n is a, c, g, or t
  misc_feature (390258)..(490257): n is a, c, g, or t

SEQ ID NO: 36551 - DNA, 14705 bp, Homo sapiens
ggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaagaaacatttgccagccaggctagtgacagaaatggattcgaaatatcagtgtgtgaagctgaatgatggtcacttcatgcctgtcctgggatttggcacctatgcgcctgcagaggtaacaataatatttttagtgttgagagttcaaaggagctagagtaagtggaagctgaccaggttgtcaggcttgtgttcctatgttactctgcatgactcccctttaaacgtcagtctttgttctgcaatgccatcttgtcacagggtcatctactgcttatttgtggcactgttttgtcttctgtttatgtttatttcacagcttgtcagagtctatacaactcagcagaaagaacacggcttgcctgctccctctcttgaagattgattgcaatgggagtggtttctctgtttctttgtatagtcgaacagatatttacttcttccaagaagatacaattcagaggaatttttatggcaaaagttagtggagacggggtggatgaaatctgttgggagagtatcactgttctgatgggcggccttgagcaccacactgtaatactagacctggcctaaagagaatttctcatgtactattctcacctctgggaaaattacctgaaacgataaaatatcctcattttaagaaaaaaaaaatactagaacctaacaaggaaaatttaaattctttttctttgttaatatgggtcaaatttgtatcaaaatattgtaacagaaaaatttcttgtttctctgacaggaaaattaatggaatagattttcttttctagacttagctatttctacactggaagaaaacttgtatctcaagactgtcttgggaatacaatgtgtgtgaatagggactagttacataaaatttgggtttcacatttctgatctatacaatataaggatttacaaagggacattttgaagaccattgacaggagtggtttactttgtaatataaattgacatggagaggaagtaaagatgaggataccactaaagctccagctttggtaagcctttgagtactcatacagcaaagaaatgatcaaggatggtatgaggagagggctgtgagacccagtatctagttccttgtaattctatgggaaaaagaaagcctctgaaatactttccagataggaaaacagtttgctttgtttctgtttttgtcatttaaaagatatactttcaaatctgtatccaaatttgttacgtaagtcaataattgtaaatttcactgcaatcatatgtttcctaaaagagttgccttgaacttatggaactgaaccccattttgctaatcacttactccttgcagtctatttcttatacaaatcaatatccttagagtatacatttttacacctactatttagttctgtcatgccgacagaatggctaatggctgtgtagaaaagacttgacataatagactgctatccatagacaggcctgtttcccatataaacctgctggtatctgataaggtggatttctcactatttcctaactgataagaatggtggctgtaagtaactgcttgtgcaaactgcggagtttctgtgcacctgctttccttttggagacttttggaagttttgtgcctgcgaagcagagtgagtcaatgtaaccagtcccagacaaaatcttagtaatggagtatgtagagagcatctcttgtagacaacagttcacatacattgacaaaatatgattccgggtaaagtcagtgcattctgtgcaatatggtgggagaggaatcacaggagcttacactgtattccttcatatttccttccatgtggctatttcctcgtgttaatttctttttttgtttgtttggtttttgttttgtttttctgagatggagtctcgctttgtcgtccaggctggagtgcagtggtgcgacctcagctcactgcaagctccgcctcctgggttcacgtcattctcctgccccagcctccccagtagctgggactacaggcgcctgccaccatgcccggctaattttttctatttttagtagagatggagttgttaaccaggatggccttgatctcctgatctcatgatccgcccagctcggcctcccaaagtgctgggattacaggtgtgagccgccacgcctggccattccttgtgttaattttaccatactaaaaataattaagattatatctataactataggttgcatcctgttaatttttccaaaaaatgactgaacctgaaattgttttggggacacttccaaactagtggtcaagcagtgatttttctgggactgcagaagttcctgctgtgcccaacctttattactaactgggaaagacccagggagactgggatgggctcatgattctacatacagaactcatccaagaaaggaggaaaagctgatttttgtgaacgtcgctacttgtgcctgaactaactctcaggcacattagtcagaaaatactacctatggttactcccccaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaaggtactgtgcctatgatgagcttgtgtgcacatgtatttattgtgattgtgtggaggtggcagttctatgactggatccatagtatagggtgaattgtgcttatttattacgatttattcacacttactcatgtattaaaactaatatcaaaggcaggaagtgaagatggctttctcatctttgcagtgttccaattcatgccttcaaagtgcctttactttttgagctcagcacagatcaatatggtttaacatagactatagaatcagaaaaaatcctaatcatattatattatttcttacctcctgggtgagtttcttacacttgttatgattctcagtttccattattatgttgatcatagagagagaaagcaatataagcaagctctgtgagtattaaagaataacgcctacattatctcaaattgtgtccagcccaagttgacatattaaaaactctgtttgcttcctcagtttctaaaccacaaagatacttaatcttgcccattgggctgaatagatgaaataattacactactaacatgagttgtaaaacttaccaaagataattcagataatgggtatgcttatgatttgataacaacttttaccttttgagtaatttcactctttcattcaatatatgtactaactatatatccaacatattataaagttcatcatgatatggcagaacaaaaggcatcacaagaagagagagaataattttgcctgtggtcattagttttgaagtagtagaaaatgtctaaatattaggtggagcaaactagtaaaattggctcaagttttcattacacaacttcctttctctaacctctgcagctttggtgcaattcccatcgaccagagttggtccgaccagccttggaaaggtcactgaaaaatcttcaattggattatgttgacctctaccttattcattttccagtgtctgtaaaggtaggcagcttgtgtgatcaaattaatttcacttttgttctcagcataaatattgtttttatggatatttgaactaagcattttcttaggaggacatagggattataacatagaagaagaatcctaaatctaactcctaattcctttctatgggatacattttgaatccatacttccgtgattgcatgtctataagaaaagaaagtgcagaactctcaaagcctctgcctcaaaaacttgaggaaatgatagtcatctccttgaaggcacaaggtcttagttatgattcctgatttcacctcttgggatgttcacagacacagagtttcatgaagctgtggtgtccagaaaacctgctgcacatagggtgcacaatgagtttccatcttcttgcctctttttaaggggcgagaactcagtccgggagtgtcttaaactacagaccttcatgggaaaccttgttgcttctgcttcctctcttttcacactggaggttttatttttgcttagccatgaattcttgggtcattcataacttttgtcttaaggtactgaaaactagtcaggctagttaatgcaaaagggtatattagatatgataatgggaaatcaaagccagggctacattaagaatttgataaaaactctaaaaatatatcctttctccacccttatctctgctttattacaaaaggctttttaagtatttgttccaacctttttcgttggtggcatttatggctttggagcactgtcaggcccatgttcattaccgtgagctcctgtgcatctcctaatttccaaactagccttgaaaacacctccattgaccatgattggttcatggtcctgtgcatggaacatcatatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagaggtatttatttatacatgtaatagttgtaagagattagagggagcctgtcacctgaagacattccttataccttcatatgtagtacactctgtacataccactctctggagcactgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacatgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagtgaggaaaaagaaatgacaggcatacaaaagagagaagtggaggagaagaattgggggtaaggaggactgggatttatttccttgccttttcactaatctctccagtttcccaaggaggaaacagaaatacttactcttgcaatcactatcttcttccccaattttctgttttattttttcccttttaagaaccacggctagctagttttattgtcatatctagacagttgttactttcacagttctgtgtcacatttatcttgatcttccacacctcacaattcctttttcccaggccgtggagaagtgtaaagatgcaggattggccaagtccatcggggtgtccaacttcaaccgcaggcagctggagatgatcctcaacaagccagggctcaagtacaagcctgtctgcaaccaggtgagcaccctcagcctcctctcctttctgttcttcatgcccctctttctgtcctattgccaagtatccattcatttagtcccacttatctttgtaaaagagaagattctagagagcaaagactctgtctcgaagggcatagagggatcttacttgtacccggcttagaaaagtcttagaaaaggtgttgtaactttgatgctgaattgtgtgttatatttatgggaggtcaattcaatcaaggaggccaaggattgtcaattagactcagggaaaggtggacttacccctaagctatgaaagatgaccagagaatggatgggtgaaggtgatttggagggaactgtgcatagatatgaagccgtgaagagatggaatgaacagtacataaggagagagtgagagcaagagaagagaaatactagggattcacatgggcttcggatgtctcagtgcctcttggtgtctctgctttcacacttcttgaccaagggcatagatacactaaaaattatctgcagacaatgaaggtcatccatggtagaaagagaaaataacctgtttatgggagatatctgttcacagtggatgaaatccacactgaggaaggttcagcagaacatggagctgacctatgactgcccccgctcctagttggctgctcttctttggagtctgtcatgcaatcagctgcttaaacacatctattctctatgtgttccttttgtagcctagagataattccatcttttccttgagtcctgactggtgattccaggcctccttgatcaaattgactgtccccaaatgttacacacatttcagcattaaagttactacacttttcccagtaaattacatttttttgttttattttatgttttaaaacttagagtcaatcagtgaagatctacagtggaaatacatatgtataaaattagtgaatttggtataatgatacggtgctgtgataatttaataaaagcattgagaaattaatgtggttttaatactagtagttccccaattttttaatatggccattttcacactttccaaaaatttgataaaaataatactggagacccatgttaccatttatattcaaaattactaacattttgcaatgttatatggagtatatctgcataaatacatataatgtttctagaacctcttcaaggtaaattgtaaagatgacaattgacccctagagacctctcaaagcatgtcacaggaatgaagatattctcccagttccagtgtcattactgtatctaagaacatcatctatagtgccctcatgtcatttggtatccagtccatatttgaatttttccttgcttaatcaaaatatcttttgtagctcttctttttttaaccagaattcaattgtttttatattgttgtattttgatatcagttaacttgtttttcccagttgttgaaggtttctgtaaattagaagttagatgagagtgttttattacattgacttaaacctttggggcaagaaaatatttttatcatgctgtgtttttcaaattgcaccacactagactgcatacaatcacagaatgccccactagtggtgaaggtagttttaaaaacttggttaagctccaacaatgatagactggattaagaaaatgtggcacatatacaccatggaatactatgcagccataaaaaatgatgagttcatatcctttgtagggacatggatgaaactggaaatcatcattgtcagtaaactatcgcaagaacaaaaaaccaaacaccgcatattctcactcataggtgggaattgaacaatgagatcacatggatacaggaaggggaatatcacactctggggactgttgtggggtggggggaggggggagggatagcactgggagatatacctaatgctagatgacgagttagtaggtgcagcgtaccaacatggcacatgtatacatatgtaactaacctgcacaatgtgcacatgtaccctcgaacttaaagtataataaaaaaaaaaaaacttggttaagctaacagtggtcagatctgttgtttttaactcatgttttctctttaacaattactagtaatctgctgggggataattctcaacagaagaagtcatattcccatgacaaattttcacatatgattgagtatacatcagtgatttgaacttttttctactgcatttctgttttcttctttgttatttcttatttgttatttccttggggtttttacataatcatttacaattttaaccacttgtttaactattcttacctgacatttaattaaaaatgatttctcaccaagtaaaaataataaactactattcctctaagtgagggtaaaggtgaacttcttccttcaattagcaatgtactgtgaacgtaattactgtaatgaccaccatcagagtagacaaagattgttgttctttttctcattgtcgcactaattactacagactcacggattcttgtgttatgatttttaatttattttactcattttttaatgctcacatctactcagcatatatatattatatatatatatatataaaatatatatgaaagaagaatgtgatcaaagactcatgagggcaagtgtaaaagacaaaagcacttgtttcatagggaacccactggtgacatttgagatatcaacatacaaatccatcatacaaaaaggaaaagtaatgaaagactgtgaaaattatcagtatttatgtgtgtatgtatattttctagttcatctatatagatatatatcatagatggcatatatgatatatatattatatgtcagatcaattagaaaacatacatatacatgtatgcatttttggtattaattaggaaactagttcttttgtctttcagacctgccctcatgagtctttgaccaaattcttgatttctggcacgatttgatgcccaaggctcaaagaatcttacctcatcccagctctgaaattggccgtgtctcgttctagtggtcggagttattgagaaaccaggatagggttcatggagttgcttgtgctcagaaatagcatttctattttcttaggagagaggggcataaaatttatttttatgaaaaagatcatttttgacaataatattctcagttcaaatttaatgctctacattattcagcttcttttactttggtgattttaatattagtgtaacttttggattatctgatgcttttccatcttgctcgtctgcaggtggaatgtcatccttacttcaaccagagaaaactgctggatttctgcaagtcaaaagacattgttctggttgcctatagtgctctgggatcccaccgagaagaaccatggtaataagagatacaggaagtttacctaaaacaccggtttgataaaaaaaatttaatcagatcatgctgtttcctggagttcactcacagctgacttggggtgagggaagaatttgcatttctgacgagatcccaggtgatgttgaggctgctgttcgggggcctcgcttgagaagctccggtgcagagtggacgccttagtctgtttagggagccgcctaacaaactgtatccccagcctcagggcctcagcctttctgcctttccttccagggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggacagccttgggccagctccatttccctgtatttcctatgcatgaactctttgtgtacgtcataagggtttcttctactctagcacaggagaggcaacagaggtggagagaaataggatgggatcaaaactacagatttgggttagcgttaagtcagtgatatccatatccctctgctggggccatgtccttttctttattttttataatgaagcattgattagatgttctttagtctccaactcatggcggatttttcttcttgtatgtttatgtagtataaattccttatatttattctcttagaattttatctttgcgaagtgcttgtttaactctgcctttttttttttggcgaggtggttgtgtgtctttatttttatgtgtaggagaccatatttataccaataccttaggatataagacaaacccacttaatatagaggcttaatgcaaaagcatttattgagctcaaggttccatggttagaaaattagcctgggctcagcctaaactcagtccattccttctgttcctggctgggctctcatgtgtgttcagggcagtgaggcagctctgcttcaggatgtccctggggcatctgtgtgagcgcccccctctcccatgcagttctttatcctccagccatccagcccagggttcacctcagcacagggcatgaccccaaggcagtgagtggacatgtgcaaagccttttcaggtctaggctcagagctgccaaccattgcttctgggaaattctatcacctaatgcaagttacaggacaggtcagactcaaggggtggggaaaaagacaccacctcttgttggaaggagctggaaattcatataaccaagcaagtggatacagggacatgtgattgttagagggcatgttcctaattaatctatcatttatacgatatgtgtgaaataacatattaatagttatatgtatgaatatgaatatatataaattgatatactatttcatatattcttaagaatacatccaagtctctaaagaattaatatccagaatacatgcatatatatgttttctaattagttatatacagatatatgaaatatcatatatgatatatattataaaacctatgtcacatatatgacatatatcatgtatatgtatatgtgtcactatttgctaaaacattaagtaaaatcagtgtagaaatccataggatactctgaaataatgatacagagaatgagaaagaaagtaaaaaatgacaatgaaacaattgatgaatctaggtaatggcatttactatattattttaaaaatatttttagacattagaaaacccacaaaactaaaaggaaatattatgaaataactgtggaaattatcagtatttatacatatgtgtatgttctctaattcatctagtatatatagatatatgacatatgtgttatataatatatatgttagattaactagaaaccatacatatatatgtatttattctggatattaattctttagagacttaaatgtattcttgaaataacatctcccaaattttacctgtgttgtcatattctctgtggttatgttttcacaaacaaaagtttctatccttcatgtagactaatttttcatgcctctttcttgtggttggtgagtgttgtgtcttatcctatattgggaatatcacaatatattactgtgttatcttacaaaattgttaatattctttccttataaatttggttaattctaatgggattgactttttaaatactgtatgagataaggatccaaatatgcatatctaatttttgaatttttagcaaaatttcccaccaacatttattgaaaagttcatatttgctcacataacttgatttttttacctgtaacatatatgaaatgtccatgagcaattatctggcctctcttccatcttcagttaacttatttacttttctgtactatgatgttaaaaagtaagtttcacttccagtatggtacaaatatttttctaacttcttcatttatttaataatatcttagctattcttgactaatgtgttatttaaaactttgaatcatcttattaacttccacaagcaaataaatgtttagtctcttgttgacattgtaataagcctccagatcaatgtggagagaactaaatgtttgacaatattgagatttccaatgcatgatcataatatgaatttcccacttattaatagccttttaataaatatataattaatttcataactttctctgttactgatgattttaatagtttttgataacttttcatttttgttttatggattttctaatatatagaaatattaaaagaataatgcaacaaatcttcttacctacattcatcaagtgttacattgctgtcattttttactctctttctctcattttctgtattactccttcagtttccctatggatttatacacttatttgattgaatgtattagaaagagtgacatctttttgatatttagagtctcccaaatttacatagtgagagtacccacaccttttgaatgtgaaatcgttagtatttagacaattattggcttgagtgatgttgaaaactaatttttcctattatacctgttcattggagagatagatattcaatgttattcatcaaacctactaaattatgctagacattacaaaatttgcctctagattcttgtgggtcttctaggtacatgaccctatcatgtgggcacaaagtaagctctgtttcttcttcagcttcctctgagatattctcttcatctgcagtgttgtgcagtttcaaaatattttatctgggaatggatttctgcttatttttgactggttttcattgaccacttgggtgtttagagaggtctttcataaattttggaaacgtatcaatcttttaagtattgtctctgcaccctactgtctgatgaacttggttgttcccaattggcaatgatgtaatctaaaaataattaaagttttctattactttgataggtgtttgaattccagttgacttcagaggagatgaaagccatagatggcctaaacagaaatgtgcgatatttgacccttgatatgtaagtaattttggagatggttgtcctaatttattttcagaggaggaacgtaggatgggtgttgagagtgacctccacaccaggggcacagaggccaacgtgagacagaggtgagacaggagctttctggaagtctcctcctggattcactccagagctctgttctctggcagggagagtggcctggggtcagcatgggtcaacctgtgcctctgctctcgtgactccaaggaactttccagagcagccaagatcattgctgaatctgcaccttccatgtaggcctgctgtttgtgctactgtctagtgtacacactgtggatattgcccatgtggtcgcattagatgtttccaaatctgtgcttctatcttgttcttcccaacctgctcaatgtcttaccagatcaaaggcagttccgtcaatcttgtgggccaggttccaattcccacctctttcacatggaattgcttgctggatcctgtcgatttagcatttttaatcatttcaaacctttttcgtgcctgtctttgcatgtttgcccatgagccaaacactgcatttgcctccagaaagtctgtcttagtgaagcgaataggagcacttggccttggtgttctgcaatatggagatctcagtgcagagaatgaagaaatgttaaaatcaaatgcagagtgtagatgcaaaagcaccattgttggagataatttataaccaataacagaagtttactattcctctgtgttctaaggttctaggattcatagaaggtcattcatataatgagggaaaaaagaagttatgtaactgctggcagtagggatttcaacaagtaatagagatgatgagataatgtgtgaaaaaaacaagcacaatggtacatcataagtacccaaaatttggtggatattattagtagtattttattcatttagaggaaaatacaaaatgaaaacggagatgataaaaagaaaaggaaaagtggcaagcattagaaagttttaaaaccaattaatgtttttggggatcatgaaatcaatcactagtgttattttgtagaactcaaatatggtctggagtaaaccacttgcgagcttccaagtgtttgctcttggtgtaatcaaaaaggataggctcaattccctaattaataagttgtaattgtacatgtgagcagtcatttatctgtgtctttacattttgtgttatttctgcctataaaatggtttatacattgtagctctttggatattggaccctatatcaaaaacaacaatttacatttctgaatctaaccaactatgttgcatatgataggcaggtagtaatatgtaaagtaattaagtataattgctaccagtataatcatcacactcaaaattgtttattagtgatgagcatatgtcttgcttattcctcttcaatgtaaggcagtatagttccatttttactgagaatttgaaatagaaaaggtcagtatatctctttgctctgttgacagatgtagagaaatatgtttgaacatttcactttgtgtgttttatgtgttaagttccaggcaggggaatagaattaaattattctttattttgaaaatacagatatgataaagtcacattcattaaacaaagaaacacagattctagagcagtcagaaaatgaacttcttaacatctacactagcggcagcttcctagaaatcactgcactacccgctagtaacggagtcattgccattcagagtgtgcatttttttttctctttccagttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacct

SEQ ID NO: 36552 - DNA, 16367 bp, Homo sapiens
cgaccgcggcggctggtgagtacgcgcctcgcgcgctcggcgttctggggggcaatgtcaccccctctccagtcccctaggggctttgaaaatagagatggtgagaccagaccctatgacccactctcccccactacacgcacatcccctggggcgcggcggggacgtccacgaagggactcaaagagccagggaggtggcgggccgaggcggaggccaggaagggaagaggaaagaaaaattagcaggtgctggggaaggcaacctgtggtgttaagtgtgaagggagggaagtcagccgaacggtagtggaggaacctaaggtgggtctggggtaaaattgaggggagctggggcggggtcgccaggcttttggttttaaaggagaaccacccatggcatcgacatccgtctgtctgaatattagattagagtttatgttaattatagataatgatatttaagaactaatttcctggaaaacaagccaaccaaacaataaaaggtacatttaagtgcctttttaaagggctggattaaaagcacgtaaggacttaaaaacaatgcttccttttcttgtcacaaccaccctatgagatcatagcattcccattttacagatgacgaaagtcaggctcagagaagtgaagggacgcgtccaaccaagattgtacaactagtgacaggcagattcaggtttacaccagatctgactccagaagggctttgcttaatcaggcaatcttgtggacccaagtctgaaggaagatttgccaactactgtgaaatatcaactgctggtttcagtattatgagcttctatttcttcttttttcccctcagagattgtttcaatctgttttaaggaaattaagaggcctgctgcacttgtgcgtcttccccccacctccacttaaattagttacaggatataatttggaagacatttttttttatggtctcaggtcttagatttatttatttattaattattattattataccttaagttttagggtacatgtgcacaatgtgcaggttagttacatatgtatatatgtgccatgctggtgcgctgcacccactaacccatcatctagcattaggtatatctcccaatgccatccctcccccttccccccaccccacaacagtccccagagtgtgatgttccccttcctgtgtccatgtgttctcattgttcaattcccacctatgagtgagaatatgcagtgtttggttttttgttcttgcgatagtttactgagaatggatttccaatttcatccatgtccctacaaaggacatgaactcatcattttttatggctgcatagtattccatggtgtatatgtgccacattttcttaatccagtctatcattgttggacatttggcttggttccaagtctttgctattgtgaataatgctgcaatgaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtgtcctgactttttaatgattgccattctaactggtgtgagatgatatctcattgtggttttgatttgcacttctctgatggccagtgatggtgagcattttttcatgtgttttttggctgcataaatgtcttcttttgagaagtgtctgttcatgtccttcgcccactttttgatggggttgtttttttcttgtaaatttgtttgaattcattgtagattctggatattagccctttttcagatgagtagattgtgaaaattttctcccattttgtaggttgcctgttcactctgatggtagtttcttttgctgtgcagaagctctttagtttaattagatcccatttgtcaattttggcttttgttgccgttgcttttggtgttttagacatgaagtccttgcccatgcctatgtcctgaatggtaatgcctaggttttcttctagggtttttatggttttaggtctaacgtttaagtctttaatccatcttgaattgattgttgtataaggtgtaaggaagggatccagtttcagctttctacatatggctagccagttttcccagcaccatttatgaaatagggaatactttccccattgcttgtttttctcaggtttatcaaagattagatagttgtagatatgcggcgttatttctgagggctctgttctgttccattgatctatatctctgttttggtaccagtaccatgctgttttggttactgtggacttgtagtatcgtttgaagtcaggtagtgtgatgcctccagctttgttcttttggctaaggattgacttggcgatgcgggctcttttttggttccatatgaactttaaagtagttttttccaattctgtgaagaaagtcattggtagcttgatggggatggcattgaatctataaataccttgggcattatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtttgtctgttgttgatgtataagaatgcttgtgatttttgcacattgattttgtatcctgagactttgctgaagttgcttatcagcttaaggagattctgggctgagacaatggggttttctagatatacaatcatgtcgtctgcaaacagggacaatttgacttaatttggaagaaattttgatgaaaggacaaggagtaatggagggaggtattttactatgtagaaagtaagataagtgtaagtgttttgaagctgctagaaaactttgtgtatgctagaaatttctgtgtattttacaaaattggagaataatttagaatcctacgatttttaagactaaggaatttttaaggagtatatttttttccttagactataagaaagcaactgataataatctaaagataactgccttatttatagtcatagaataaagtttttaaaggtgtatgagagtttcattgtattacagagcagatggcgtgctaatagtgacaaatatctttcaccatatcctgtaatggtttatactctcttggcttcacatgggctaggaatgccagtgagagttgactgcattccatccagggaagaacgtcttcccagagaaattagaaggtagtttgtcccctgaattgaagactaactcatacttccatttgttgtagggatatttggttgcagtccagagaggtctgctttttttcttctctttgacatctttttggtgtgaaaaattacagaatttctctcaatgttttatactgtaacagtttcattccctgcaaactttattttcattccttggaaactgcttgagaacttctcattgttggtttgtctgtagcttaacactccctattagaatgagacagaatgtggcagacatggatccggcactgctaataaaaggtgttctatcaggaagagttctgttaatagtttggagattattatcagacttgttaacttgctattactggacttgtaaacttattgaggacatgaaattagtaagaacacagtgaagcaactgattgctttctgagcccggctaatcactggactttagcttcatcataagcaaagtcatatgcaaggtcatcatatgcgaagagatgagactaaattattcctaatgtattttatagtttcacaataatattctgcctatcatagtacagtcttgttttttttcccaacatctttgtaactagaatgataaagggaaactaattttgagggcctattctgtaacctttacacatcctcattttacacacaaggaaacagaagccaagaaaagttggatctacccaagatcacccatctactaattgtgagttcaggttctgggacccttctgacttcagtctatagtctttccactttgtctgtactacttatcctgagaacaaggactgggacgcttggatcccagcagtgtgctgagggattactgagccacaggattaacagcatgtgttcctggagcatccttttaactcaagatttgaggaagaagcattttgatttgtgttttgtgggagaggacggacacaggtttttggtctgttttgcacatgggaagtggtataaaactttcacattaaaacactcaagtgtgtattttggagtataaaattcacttttttgaggtaaaatgagatcaaaaatgtttcctgttttgtggcaggacatttcagattacaatttcacttccctctgctcttttttaaaaaataatattttattgagatataaatcacacaccattcaattcactcattttaagagtactgctttatggagctgtgcaactgtcatcacaatcaatttgaaaacattttcataaccccaaaaataaactttatacttactggcatttattacccatttcccccccaacccctggccctagatagttactatagttacttttagtctctatagatttgcctgttctagacattttatctaaatggaatcatataataagtgattttttgtgactgcgttcttacatttagcgtatttatccaggttataaaatgtgttagcacttccttcctttttgtgtcaaataatatttcattatatggatatattacattttatttatccattcataagttagtgcacattgagatgtttccacttgattcttacaaataatgctgctgtgaacatttgtgtacaagtttttgtgtggacatatgttttcatttctcttgagcacatacctaatagtagaattgctgggttatatggtagccctatgtttaaccctttgaagactgccagaatattttccaaagtggctgtaccatttcacatttccagtagcagtttataaaggtttcaatttctctatcaacacttgttgttatctattttatttactcatccttcggggtgtgaaatggtaccttattgtgggtttgattgcatttctctgatgactaatgctgttgagcatcttttcatgtgctaatttgtcatttgtgtcttctttggagaaatatctttttcagctcatgctcattttttgactggattatctgacttttattattgagttgtagcaattctttatatagtctagatacaaatctcttcagatatatgatttgcaaatattttcttccattctctgggttgtcttttcactttcttgatggtatcctttgaggcacgagactttttaattttgaagtccagtttatttctcttttttggtcacttgtgctcttggtgtggtatctaagaaggctctgttgaacccagggttacaaaaatgtactcccacatttactcctacattttcttttaagagttttacagttttagctattaatctaggtctgtgatctactttgaatgagtttttgtgtatggtatgaggcagggcttcaatttcttttgcatgtggatatccagttgtccctctaccatttgttgaattgtcttggcacccctctgctcttagaggtaaatctactggaaaatttttggacatactgtgatattccatttgtagtaatttctctaacaccttagcttttaaaataatacattatggtgtatgaatctcaaacacactgttacaaatatgtactcataaatttatgagtatttttccccgtgagaagatactgtgccacctatttgctgatttaagtctattctgttatttggtgttgtagaacaaaattgattaaagtgtaaagcctgtctttctttttccagttggcagcctgatttattattttggttctttatgctcctgttttgattattatatatttgaaaagtataagttctttgtcccctaatacatggcacatacatatacttttgtgttatggaattagtgatagtagatatttgttgaatgattttttacaaaatgacccaggtgtctgctgagttaaccttcatatgtaggaactaattttaggatattctggaagtgcaaactaacactgaagagctattataggccaccaagatgaacgatgattatactttacatgttgttgtaatacatttcagaaagaccatggcaatgaagtatggtgaatggaaattcaagttggcagttatttctgtatttatttcacagtaatttgcatgcaagttggacctggatattggaggggcttcaatgtgagactgaggcatttgggctttttgtataggcaggggggccttttgaatatattttaaattaagggaacatgaacagagctgtgcccagagagactgagtaggcagcaggtgtgaggtaagaaagtggaaggtggttgaggtagaaaggtgaattaagagacaaaagtgctctggacaagaggtattgaggactaaaaaatatagcagtagtagagatggatgagtgggtagctgttaaaaatgcttgtttcaaatgcaggtttctggcctctactgtggactgactgaatcagaatctcctagttatagtgacttgacagctgcacttttaacaagctcccttcagtgattcttttgtctgatatgctgtattagatgatacgaagatagaattgactagactggcaactgatcatatactcaggggatctctttgttactgagagaatggcgaagctgttttaaagggttgggaactaaggaagggggaaaagatttggaggtatagagaatgcattccatctgacacatatcagattggatttggcagcagaacagctgtgcagtgggataggattggttgggaatataaaatagttacacagggaaagagccagagcagtaaatagtgtttttcaaaaattaagtttatgagtatgttttccctgtgagaagatactgtgccgccgtatttgctgatttaaaagtctactctgtgattggaaagaaatatttggatatggggaactatacccagagagaaaccagggaatctactcaatccaagctttcatggagacctgcatgcccttgacacaagttctaaaattgtagcaacccacatgatactgtcatctgattgaacccagttaaaactctctgagggaggagttaagtcatacataaacactgtgttgagggcataaaatattgaatgaacgggtaagtaccattgtctagattcttgatagctgaaattgctgtgctatgactagggctgtgtctgtggaaatacccatatgcctcctctaccactcattaggtttgttactctgtcttttggagaggtggttttgttactctgcattagttttggttattagggagcaccaggaacaaatgttccatgcaccacattcagaaggcaacctgtctccgattaaaatagtagagattttgtagaccccaagatcctcataaatcagattctgtgcctttggtcttcctaattttaagtcagtttttcagaggatcacagcctctgtcagtatttgaccacaagtacgcagatcctccaggtggcatgtttgaaagaaagagagaaagtgtttccagtctacttgagagaatacacaataaatgactcctgaacttcataatcatattagttaacttgctgctcttcatacctgggacctcaacatgcatacccgttaccatgttcagggtcttcttagtctgaaataatgcattcacttgttgcattctaactgcaatcccagatctttgtaactttcactaaaagttactcttaactaatcttcattagttctttgacttcaccagaacctctagttgaaaaacttctctacttcttacttacatctgtcagtttcagcttagatgctgcagccccaatttcagctgctctttagttagcatcttcagcttcctttgtcttccttcagtttctggcagaatctcaaatccaggtaggatcagctgcctgttttgttcatgcctgtgccaggtttactgagttgctagagaaaaccagtcaactgtgtcactatgaaaattcatgacagctgtcaacattgactccagttctactgtttactcacactttctcccatcttccacattaactatttcagacattctttctgttcctcaaacctctgaaccttttaccattctactccctgtcaataattgaccctacctccggcaactctcttcacctccagccctcaaatctgtcagctcccctacctttgctccttctctcctgttacaatggaagaggcatcctgtccatctgaagtgaatcattttacctcactcacatgtcctattttcttagagaccaaagaagatagagagcaaaggcagggagatttattagggaaaagctgtttttgtcatcagtgaattgatttaaagaaagaacaaaaaatcagagatagctttaagcctagggtattagtgaaaatagttgttgatagctaaaaggaagtttaagagggatgtggtaataaaactcatttcaatagctattggatttcttcataagttactggagcatccatgtccatgtaggctttgcatgtttgttaatcaacttcatgtgactattggggcacatacagactgatgggggcttttttctcaatagcatttatttcttattcccccttttttatagcaatattttcaacaagaactggcaataaaccaatatggtagaatttccaccaattatttctgtgggttaaagaaactataaagtacaatttattaaactggaaaaataatcatcatctctggagcctctgaaagcttggcattaacgttatgttttacaaaagaatcattttagtgtctgcatctatttttattaagcctttcgaagaatttctaatgtggcaaatgagctgacagcctagaaggagtattgatgtggagtataaaaatggcccatatgaaggatagagtagggcatatatataaataggaaattggacaagacaattttttttccaattttagcttttagttatttttaaataaatggtattatttaagttaatataggtaaagctggcatataaatgttggttctctcctcctgtgggctaaaattctaaaacttaacccaaatgaaatagaattactacttatgagttgtgtttttacattttaggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataagtaagtaaacattcaactgagggatactattattcgaatggggcaattgattgaggggggtgggttgtataaaagaatgaagctctagctttttgtagtttagaaccatatactcagagtgggattatatgtttttttcctcttgtttacaagttgagagcagttggcctatggtttagttatatggcttatggtttagtttcaaagtgagtatttctttgcttttgatatatctaattatttgcactagaaaaaggaaatttttatccttaaacatcttagattttagtgtgtgatatttagtggtgaggtactttcttctactgatcatagaagtagtagttagtagtaacatgtaattagtttatgtttacttaggaagatacacctgaaaaatgtcccctatctgtaaaagtccaccatggtaatccacaaagtgaaacagatttgttaatgtttgagaaaggtgtgtgtttgtgtgtatcagtccccaacactctcacattattattgctctgtttttttaagaagtgatttaatagatgacattatctataatttacttccaattattctagttagacatattttttccttatcaatcataacttgtttcctttgctgtttctttttttttctcagatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaatgtaagtatttagttgagatatttctgttgtatcctaggaacaaatcataccttgtgatactgttgtgttaagagggtacttcgatttaaagaagttcacacagaataattagttcaattttcaaccagataattcccaggtcttcatttaatagcaatttacagtaatcacaatttcacctttaaattagaaagtaaatttaagagtgaaggcaaagtcctactttctttccaaaactgcaattactgtcagtaattttcaagattcattctcttgatttatacaaaatagagaagtaaagaaacagtaaaaggggagagattagctaatccttgttcttttgtgtgttaaaaaaaatttgtctgagtaaccctaagtcttccccagtaacaaaatcatttacctgaatgctacagctatttagaacactgggcaagaaccagaaagtaaccaaacaaatccaccaagtgaacaaaatagatacatcaaaatctctcctaaaaaatatataggggagaaaatgtataggggtgagttacaggcttgcctcaaactgaagcttatttatccatatttcatattcaattcaaatgctttttttaaaatctaattttgtggtctatggtaggggtcagcaaacttttttagtaaagggccaaatagaaaatagtttaggctttgtgggccagctggtctctgtctcagctactctactctgcctttattgtgtaaaagtagccatagacaacctgtaaagaaattgaagtggtgtgcttcggtgaaactctgtttacaaaaaggatggagggctaaccttcgctatgggctgtagtttacagttccctgatatatagcaatttagaagtatcaggcaagcataggacagactcagaatcaatgaagtttgtatattatttacatcaatgttatgttgcatatttgttgttgacaaccgaaagtatagaaaagcataggaaagagaacaaaaactatccataatccctcagtatggatttataggcaaatgttaattgtggacatttctccccatccaatcttttttcatatatatattcttttctaatatatatctatattatatatattatatgtaatataattatatgtaatatatataatatatataatgtatattatatattatatataatatataattacatataattataatatatattttctacatatatatgtagaatatattatatattatatatagaaaaatatatatttttttctaatatatgtgtgtgtgttttaatattattgaaatctttatatattctgctttttgtcatattggttatttttatgatgaaatatttcaaacataccaccaaagaataatataacaaatatcagtatactcatcacccagtcacccgtacttaatatgaaagtgggagcttattaaatacaacgggtgtacgttaaatggcaacatttgttaaaataaagctaaaaattgggaatttattattggagttgtattagggactatcatatgcttttctttaagtctaacttttactgggatagagtcaccagattagacaacacattcaacgcaagatccctcctgtaacaattgagataggttaggctgcagattttctttttctccatttgttggccttactcacttctgttcttcccagttacacagaaccctcagcctgaccactgtctttataactggtactgcttgcagtgagcttttgcaaacagtgctgagattgacaagtgaagtaattggtactcgggctgaaagataagtacatcaggttgacaagtggtggtaaagtctgagggtatgaccagttgggaaaaggggcatatgtgtgtgtttgtgtgtgtatgtgagagagagagagagagagggaaatatggaacatagctgagttgaagaaatagaaatttttatttctagtccctttctgaaagaattgaatgtttatatactagaagcaagttattttgtcctaaaaagtctgatcttattgactgatgttgttttgttctttttcagtaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattctactttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatttaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgcttt

SEQ ID NO: 36553 - DNA, 7502 bp, Homo sapiens
gtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggtaagagtctggatcccagcccgaggcttgggtggtgaggaaggggtcagaatgccacctctgcctggctctctgctgtgtccgctaatgcagggcagagggggagtgagaagcccatccatcaggtggctcctcacatgcccaccttcccacggggccttttccaggaccccctgaacacatatgttccttgggtcacctagggggtccgctcccacatgccccagggaagctgccctgaggggagcgggccaggccttcctgccagctgccctctgtatcctagccccagagcctcagggagaacttttgtccccttctagggctcccttgaccccatccagtaatccataattctgacaccactccagctctgttccctccagccctccagccagacacagatcagaggccggagtgaatggggccaggagtatagaactgcaatccccaagaggggcaggctcatcaatggcttattctctacttaaccccaagctggcctgcccgtcttctcctggaggggtggggtggaagccagtgttcagatcacccacagggcccgggctggctatgcgcacacagcatgccaatctggggactgagacaggcccagaaagggacacacatgattgtgtacattcagaggctccccgggaccccaccaccatgaggattgactgctctgtggttttccattctgcgcgtctccccatcttgaaaagtctttatctgctcctgctacacaggaaagcgtgggggatagggagggtggcgatgccaaagcccttgctctcactgatccccaagggttctgcatctttggagccttcttcagcccctctggtagcccctgggccctcctccagggcatgtatctttggtccttggacccagagggggttgtacctacaggaactggtgtgcctacgtggtgacccggacagtgagctgtgtccttgaggatggagtggagacatatgtcaagtaccagccttgtgcctggggccagccccagtgtccccaaagcatcatgtgagtcccagggccgggcaacgggcccttggtgggaactgggcgagggcagatggtgggtggctgactcagggagtctgtatgaagcagggagcaagggcaggacaggggctagggtcacagccattttgaggagatactgagacaacagtttggctggtgggagactgagggcaaacctgcctcacgcgccagccccagatgccttctctgggatggctcaggctcaagcagaggagttcaaggttccagcacagggcaagggaaggaagagcagggatttaacccttggccaaaaagctgacagctgtcagctaagcaaggccacatgttggacagtaagagggacccagcctgagggacaggccatgcccaccagcagctgcccacccctgaggacagggaccagggtcactgaccgtacagggaggaataaagaggcctccttctgcctctgccaggtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccagcctgcccgccccaacctctctggctccagtgcaggcagccccctcagtggactggggggagaaggtgagtgtgggagctgctgcgagggtggcaagttccaaatggtgatccaatgcaatgggaaatgtggggccaggctgctgggggagtcccccgtgctctatgccagagagaagagaggggcagaagggttagtgagatcgcagagattccctgcccgtgtgtgtgtgtgtgtgtgtgtgtgtgtgtgtgtgtgtgtatttgtgtgtctgtgtgagagagagggagagagcacgcaaaagatggagagactgagaaaaagaaggccaaaaaagagaaggtgctcgcacacgccccatgtggccaagatccttcaaacagctgcaggagaaaggggcattcctttgagaagcttggtccgtggggacagacagttgagactacaaatcctagcatgcattgcacctgactacagatcccagacccctccgtggcctctggagaccgcaggtcccagcatgcagcagttcctgtggcttgccttccctcctgcgtgctgcacaccggatgtgctgtttccctgccccgagatagccttactataattatgcaaacaggaactcctggccaactctcaccgtccacagagcctcttctttgtccccgtggtgttgcagggaagtgtcacccagtggtagctactgttgtggcatccagagtgcctccctacactcccatttcgcccctcttgacagccccatgacagaagagtgtcattatcctttcgcagaagaggaaagagtttccaagaagttaagaggcactctgggcaggtggaaaggacatggacctgggggctggatagatggtctgggtttgaaacttagcactgccatttattaaacctgtgatccatggccaggcacctaatatctctggtccagtttcccagcctatatgatgggaagagttcatggtatctccccaggggagttattgaagaacagagccatggttcatatttggcctagaggcattcagtgaatggagtttctttttttttctcttgccaaaatcacccaaaggagaggcagagccagcctgggcatctgacccttgctggagctggggtgagcaggggccttgagctctggggtccagcccctctgccttctgccttcccctctcctcaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactggtgaggggacaaaaggcatgaggggacccctttcaagccccttatttttcttctccctcccccagcccagcttccaactcatctgctttctccttgcttttcccaacatgaattgcagccccagccagtattccaggtgttatagtttgcctgcaagagatgatgcaaggtcctagctcccgccctccctctggctgctcactaggcctgtgggtggagagaggatgttgctctgccagccagggatccagcatatgcagcaagggaccccatggccccctcagcctgcaaagctccacctgttccatccatcttctccctgttcatgaagccaccacccaccttccttacccattggaaactccttttatggccctccttcaactcaattttgtcactgtagggcctgcaggagaggctgggcccccagggcctcctgggctgcagggacccccaggccctgctggacctccaggatcaccaggcaaggacgggcaagagggccccatcgggccaccaggtatgtgcactgagacccttgctgcagtcagggttgccactgccccctccaaccctgacccccgctggcagccccaggcttgacattccactctgaacttgacaaggggaattgggtactacctgaccgataagggaaaatcagaggaaagtgaggaggaactgtgatagtcactgtgtttggttaatgggtattaggaggctaatggataatgttggccccactgcagtactggagactaaagctgagtctattatagctgtctggggtgtgaaaggctgggatggcccagcagttgaacagaatggaccctacctattcctgtttttcttgataccccaattcctgctttgaagtccacgtagcaccgagcacaacaggagagcctcagcagatgtttgctgagtgacttagtgagagctgctttatttctcactgctccctttcctcttctcacaggtcctcaaggtgaacagggtgagtgcctttcatttgattctggagggagaagtgactaggggttggaggatagaggtcctcgggcagccctgggctggggatccagcaggggaagggggctggcactctgccctgagcatcccctttaacatccacccttcccactcaggagtggagggggcaccagcagcccctgtgccccaagtggcattttcagctgctctgagtttgccccggtctgaaccaggcacggtccccttcgacagagtcctgctcaatgatggaggctattatgatccagagacaggtagtcctgggaggggctgggttgaacggttggagaaatgggtgaggtgtgcagtgatatcttcccattcttgccttttccgacagtgtgaatcttcattctctgatttggggagaccccggctctttcttcatttattcattctcaggcagtggggagaagaagtagtcattcattcattcagcagatctttactggggcctgctcctgcccaggcactgttttaagtgctgggaatgcatagtgaacaaagcccccagttccctgccgctcacattccagtgaggtgaaaagacccagagggtccctcctcagtccaggagttctggtgcgctccccggagcttccctggcccccctgactgctatccttgtccccaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttct

SEQ ID NO: 36554 - DNA, 38486 bp, Homo sapiens
gctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagtaagaggcatgggaagttcgtgtgtgtgcgcgtgtgtgcgtgtgtgtgtgtgtgtgacaaggcttgcgggagagagagggagggagggagatgggtccggtgttttgtttcctacttgcccttgcaggtagctctgggtcctcagagcacagtcgcctcagggtcacccatgccgcctgctaccctccttcccaggggcaagcagagactgagaacattccagagattagttctcccaactggaacgctgtggggcctcagagctcagcgattctgcatcatctgtgattacgacccacagcccgttcaaacgagcgttagtagcctgctaacctgcaggaagtggtgtgaatattaattacaagtgttccaaaggaaacgtgcctgcttctaaacctggttgtgatttcttgaacgttgatgttttaattaatgtgttttcttaaataaactgcctatggtggtatgattatcagattgaaaaaaacttccttcagaaatattagctttagattaagtaattagctctaaattttaaaacagcttcccactaggattattcaatatctcgactgcctggttaaatagagggcttttactccatgggagtcacatttgctcaattcatattatcttacctacaatgtcagctggggaaaggggtccgagtgcaagagtgcaagacttcttaccaagcatgcatatttctttatatttccaagtatgcctgtaccaggaaatagggccaagccgtagactgctcaggttacacaaacagccagaagcaggaaggcctcacagctgaggatccagtccaggcctccgtgcatgctcaatgtcttgcctagccagtctgttttgagattgtatgaagatcttgaaccttcagactcacgttttgtggtttgattcacacaatctgttgtggagaagagcaggatatttgtttctaattaaagaagcacttagatctgttaaaaggaaaaccctagacaaattacatttaactgagtttaattgagcaaagaacgattcacagttgggcatggggaaccggaataggttcagagagactctggggctgccacgtggtagaagaagatttatggacagaaaaaggaaagcgactcccagaaaacggaagcatatagttcacgatgtacggagaaacctttaggctgaacttaaaatatgtcagaaggcagctttaggctaaacctaatttagcaggtctaaggctcactgttggtagcatcctgactcacaggtgctaccaaacctgcatgcgcctttatcctaggcctgcaggtccacagatgtcccaaagctgacagaggtgctcatcctccctgtttgctgcttgtgcagggggctgtgtgaactggggccagaatgttagggggctggatggagtgggggtaggggtggggagagaggagaggagactgggtgaatgatgattaatggtggacagggaatgtttaatgacaaggtgttagggccgggcacggtggctcacccctgtaatccgagtactttgggaggccaaggcaggtggatcacgaggtcaagagatcgagaccatcctggccaacatggtgaaactccgtctctacttaaaatacacaaatttgctggacatggtggcacgctcctgtagtcccagctactagggaggctgaggcaggagaatcgcttgaacctgggagggggaggttgcagtggactgagatcacagcactacactccagcctggcaacagagcgagactccatctcaaagaaaaaaaaaagatgttgatgaagagttgaactttgtaaaataattgaaaagctgtattctgagccaaacatgagggacgagtggccggtgacacagcccaaggagattctaagaacatctgcccaaaggggtctggctacagattggttttatacattttagggagacataagacatcaaccaattcatgtaagatgtacattagtttggtcccaaaaggcgggacaactggaagtggggcatgggcttccaggtcataggtggatttaaagattttctgattggcaattgattaaaagagtttatctacagacctcaaatccatagaagggagtgcctgggttaagataaggggttgtggaggccaaggttcttactatgcaaatgaagcttccaggtagcagcgtttggagagaatagattgtaaatgtttcttatgagacttgaaaaggtgccagactctgttaattctctcctggatcagagaaaagacctggcaagggaaagggattttctacagaatgtagactttccccacaagagacaactttgcaggaccatttcaaaatatgacaaagaaatatattttagggtaaaatacttcaatttctttcaaggcctgctatctgtcatgtgatgctatactggagtcaggctggaatttggtgtcttatttctacaaaaagtcttaagtgttagattttttaaagggaaggtggggttcaagaaagacacagagagagagagagagagaggagggggagggggtagagggggagagggagagagagagaggctttacaacaacacaggtttattacaaaaacctgtggaggtgggggaccagcttaatgccagagcccgccattgcttacaggctggggtatgtacaggtatgggcaggagggttttgggcagtatggcttgctgccctggaggatattgataagatgttcttatgttcaggtggtttggccagggatattccttgggctctgtcaggatttgatagggatatttcttcagttgggtctttgcttggcagggtatgataaagatgttcctgtgtcttgtggtcaggtggctaggcaggatttctcagggcccgaacccccatggaatgtttcactttgacaaaggcctgtgaaatggcagggggcttacaaaatggtgtagtttggactaacattaaggtctgtttcaatgttaatgctggtcagttatgcctgaattccaaagggcggaggatataatgaggcacatctgacaccttttccccatcatggcctgaactcgttttttaggttaactttggaatgcccttggctgagaggaggactccatttagatggttggggggcttagaattttatttttggtttacaaaggagagagagagtgtgtaagagggagacagagagaggaagacacaactgtttagctggcattaggaaccagaatttgctccttttgcaagtctgatgttcatggagtcgggacaccatgtgccatggttgaagcagcttaggttttgaagacagacagagctgtatctgttggtctagccacttcccagctgggtgtccccgttcaggatacactgcccttcaatgttaccatcaaagagggtttaatgggacgctggggaggaaatcccaccatagttcctggccccatgtaggcgctcagcactgtcagttcccatcctaaggtccttcttcgaagagagaagtttctgctgcatggagaggtagagacagggtgaaggtacccagctgtggctgggtgggcatcacagggggtaaggggcagagaaagcttccccttcaccctctgaaggttcactgaacgtcaactgacaaaaggcagattaacaggagaaaggctgtgacaatttattttaatatgcacagcatgagagaatggttgcccaataatccaaaggggtacagcagtttgtataccattcttcacaggggagggaggaaatggggaatgcagacaattcttttgagtggtagtaaacaattattagggagaatgaatggactgggagacaaagtaacttgtcaatgattctctggaatttgattggccagaggggtaggcttaatctggtgggaaagttcgtccaggtgtgtgcattcctcggtcttcttttccacatgagataatgaggtctgagggaggagacggcaggcaattgtgtttgtcttagggggtctggtttctaggtagataagggagtttcagaggactgcccagctgcatcctgtgccttggtagagaccacaggttgagacaggaggcagtggagaggtcacaaagaccttgaggcagcttctttagttcagtcatattttgaggtgtaatattctgatttccttcggtggggggcggggggggggcggttaacagaaataccaaactctgtgaaatcttttaaagaggtttattctgagccaatatgagtgaccatggctcggagaaaacacaaacccaagaagccttcagtgggtggtcccaaggcaattgggttacagtttggttttatacattttaaggaggcaggaattataggcaaagacataaatcaatacatggaaggtatctattggttcggccccaaaaggtgggatatcttaaagccagggggcttacagattataagtggactcagagattctcagatttgcagttgttaaaggagtaaagctttgtttaaagacttgaattcagcacaaagaaatgcttacattaagagaaggggtggccaggtgtggtggttcatgcctttaatcaagcactttgggtgaccaaggtgggtagatcacttaagcccaggagttcaagaccagcctgggcaacatgatgaaatgctgtctctattaaaaatacaaaaaattagctgagtgttgtggcactcacctgtaatcccagccacttgggaggctgaggtgtgagaattgcttgagtccatgggttgcagtgagccgagatcatgccactgcactccagactgggtgagagtgagaccctatctcaaaaaaaaaaaaaaaaagataaagaggtcatgtgatgctataccagagtcagttggaaagtaagccacatactgggttaatttaaaagaactggcctaatgagatttgatggtttgtagggcgtgacttaacccttgccttgtaaggccttaggtcttgtctacaatttgatgtcttcttgctgcagccggctttgttagtcttatgatccccattttaaccttaatcctgggcagttgtgcctaaactccaaaagggagggggcacaaccaggtgtgtcctacctcccttcccctcacggcagggaattcagtttttcaggtctctctggggttccctcggccaagagtgggtctgttcagttgtttgggggttaggatttcatttttggtttctcctcagcacatgtgtatctctggagaaagctagggaaagaggaaagacaggcaaagcaaaaggagattattatctagaggttttaatcaactcataagggaaataaagttgaaactctacagaaaaggaggtgaaatagcaccccactgtcatcatatattcatcatatatacgtatatatattttcagacctactgctctgtcgcccgggctggagtgcagtggtgtgatctcagctcaactgcagcctctgcctcccaaggtcaagcaattctcctgcctcagcctcccgagtagctgggactacaggtgcgccaccatgcccggctaatttttgttgttgttctttttgtttttttgagagggagtctcactctgtggcccaggctggagtgcagtggtgtgatctcggctcactgcaacctctgcctcccaggttcaagtgattctcccggctcagcctcctgagtatctgggactacaggcacacgacactgcacctggctaatttttgtatttttagtagagatggggtttcaccgtgtgggccaggctggtcttgatcacctgacctcaagtgatccacccgcctcaacctcccaaagtgctgggattacaggcacgaactaccgcacctggccccactctcatcatattattccaaaaatagccatggtctctctgaggcccctcacctgagagaacagaagggcttctatcccttggggctggaggtgagcccagctgaatcctctttcttggggctggactgggagtaggtgggatatctcagtacctcttccatttactgaagctcattcctcacacttgctagtgtcacaaacagatgcccattgggtgcaattaacgtaagaaaagatagcacttttaaggcttgcttactcccagcctcattttgaagctctaggctcctgtgcattactaattcataagtctaggagcacatacctttcattatttccattttataggtggaaacaagaagacttgccaagtattttctgcaaggctgtgaagcatgttagaagcaatggtaatagcaggtgcagagtggccaagtcctcatttccccctcaatggacaaatccctttagctgagcccatgagtcattggcctttccagattgatgctgccctggagggatggagcccagggttggagacagtcagggcccatctgtacattccttctcctcactctgctctctcaggctgcagtatgaatgagaaaactccaatcccaagcatttacacacttttttttttttttttgactcggagtacagtggtgcgatctcagctcactgcaacctccgcctcctgggtttcagcaaatctcctgtctcagcctcctgagtagctgggactacaggtgtgcaccaccaaactcagctaatttttgtatttttagtagagacggggtttcaccatgttggccgggcttgtctcaaactcctgacctcaagtgatccactagcctcagcctcccaaagtgttgggattacaggcgtgagctactactgggcccggacagcatttacacactttagatattcagtgacaatgtttaaatcctaaacaacagcttatttgtagcagaaggggattagtggaagggaagagcctgctttgagagcccttgctacaccaggatcaatattgacttcttgtgagagggggagatcatatcctgttccagtaggaaacacattgcctctaatactcttaacacagggagagacccaaactatacacttggtgtggaattttaaaaggaaacatttttaaaatattagcaggtaggaaacagatattgaggtactaaaacaagtcagacaaggagatagtgggggagacaactggtaaggagctaaaactgaaataaataatgtgaagcgaaataatagttactgtaacccaactgaacgtgggtccattcacccagcatacagaaacaaacacaagcaccaggatttgcagtgacagaaagggaagcattgattgcagggtgccaagcaaggagaactgggcagctaatgcttaagaccctaactccccaatggctttcaggcaagggttttaaaattttatttattttattgttatttgaaacagggtcttgctctgtcacccaggctggagtgcattgatcctggctcactgcagccttgtcctcccaggctcaagcgatcctgcctactcagcctcctaagtagctggaactacaggcgtgcaccatcaccacacctggttaatttttgtatttttattttctagacatgggttctcactatgttgtccaggctggtctcaaactcctgggctcaagcagtcctcctgcctcggcctcccagaatgctggaattacaggtgtgaaccaccatgcctaaatgggtttttaaaatttgagatagggtcacaccatgttgcccaggctggtcttgaactcctagtctcaagtgatcctcccaccttggcctcctgaaattctggattacaggagtgagccaacagacttggcccaagcaagggtttttaaaggcaggggtatatttcaggaaagcagaaggtataggaaagataataaatcaatacatggaggttataccttggtttggcctcaaaaggcaggatatcttgacacaggggcttacaggccacaggtggattcagagattctttggtttgcagttggttaagggagcaaggctttgtctaaaaacttgggtcagcagaaagaaatattaaggttctaagctaaaaagtatctgagacaatttagaaaatttattttgccagggttaaggacatgcccgtgacacagcctcaggggctcctgacaacatgtgcccaaggtggtcagggcacagcctggttttatacattttagggagacatgagacatcaattcatttatgtcagatgtacattggttcagtccggaaaggcgagacaactcaaagtctatatccaggtcataggtagataggagacattcttttgagtttctgattagccttttactgaatcaaaggaagcaatcagatatgtatttgtctcaagtgagcagaggaatcactttgagttctgtctgtcctttgtccacaaggaatttccttgtgggtaaattgtgagggagctatgtagttttttttttttttctttttttatctggtgtctaggcaaagtggctcacttctgtaatcccagcacttttggaggctaaggcgggtagatcacttgaggtcaggagttcaagaccagcctggccaacatggtgaaaccccatctctgctaaaaatacaaaaaactagctgggcatggtggcacatgcctgtaatcccagctactcaggaggttgaggcaggagaattgcttgaacccaggaggtgaaggttgcagtgagctgagatcatgccactgcactccagcctgggtgacagaatgagactctgtctcttaaaaaaacaaaatctttatagctatcttatttaggtatagaatgggaggcaggtttgtccaatgcagttcccagcttgacttttccctttggcttagtgatttgggggtcctaagatttattttcctttcatgaggtttaacccgtgtgtgtgattctctgcaggcccctcaggaagaaatttagaacagggaatggtggtcagaattcagtcctcagttcccgcttagctgaggtctgtgtgacagtggtcagcattttccatctggtggaggtcctggtttctgagaaacaactcaagaacttatgtgaagacgttgtctttagtttctatagggaaccgaacgtcttgtaactctgtcttatttgggtgactattatttaaactattattatcttctcgcttagcgggactgaaggatagcaaggtgcttggaatttcccttgaaggaactcaagagtttttatttccgtgcttgaggtggctagcaggtccctaagagtgttccttgctctgtctccatgccagaagtttattatggggtgaaaagaggaagttaaggacaggaggcaagacctactgaaggctcaaaaactgacagaggaggaagtatggatgtggaagtgaaagaagtccacagagctcatcacaagatgaaggtggtcccaggcatcagagttgattatctaatgaaataaaggagaagaaagtcatactgttttataacagggaaacgtcggcaggtaggagccatcatccccaaagttttcttgtacctgctgggcaaggtgtcagagccctggcaatggaaagtgattggcccacagggagtaagaatttaccgacaacaatataggtttgaaaaggaaagttttattagattgagagaaagctgcagaagagtgcagcgggctgcctcagcgagaggactgagcgcgccggggaggattttccttaggggtatttatggaccttaaagcaagagcttaggggtaatttggtccatattagccacatatgtcatgataaatgattacatttgtagacattttggtgtcgtaatgtcagcaagggttgcacaatgagttttgtcatgcatgcattccggagatgtatagaggtagagaaagtctagttacatataaattttggggaaagaagcctggaaccggccttagatatagggaagatcaattatttctaaactcctcagataaggagttctgcctctggatggtcggcttcatggccaccaggtggtctttgctctctttagtggcccctccctcctggcctcctcatctccaggcaatctttatgtcactatagattcatttgcattttgagaattttatataagtgaaattattcagtagtactcttttttaaaatccttgctttcattcagcataattattttgagattcactcatttttggggggtatcaatagtttattcctttttcttattgttaagtagtatcccattgtatggctctatcatgatttatttatctactcacctgttgatggatactcttgtgagtcagggttctccagagaaacagaatcaatacacacactcacacatagacacacacacggagaattattttaaggaattggctcacacagttgtgggggctggcaagtctgaaatctgcaggaaaggctggtaggcaaaagttgatgttacaatctggtgttgaaggcagtctggaggcagaagtcctttctctttgggggacctcagtcttacctcctagggccttcaactgattggatgaggcccacccacattaaggagggtaatctgctttactccaagtcaattgatttcaatattaatcacatctaaaaaaacaccttcacagcaacatttaggctggtgtttgaccaaacaactaggcaccgtatgctagccaagctgatgcataaaattagccatcacagagttgttcctgttacaaacaaagctgctgtgaatatttgtgtacaattctttgtactgaaggaaataaaaatattttacccaagatagatttctttgacagattttcaaatggccctgcaaagctgttttttgtgggggaactttgcattgtggagaatctccatgaatgcagcaaggccttcccttgtccagatctgggagagattaatggagtctgacacctgtaaagatctggaagaaacacttaccatctattttctctaaggggctgctatctgtgagatttcgtctgtataacatgactcccttggctagctgagcctcctcttcttcccctcccatatcctgtcttgccactaaaacctgacttaccaccataacctgtttttttggccatgttctgagcctgcattgcttctgtgaacccaaaatatctgataggtctcaaccaatttagaaagtttattttgtcaaggttaaggacatgcccgtgacataaaaggacatgcccgtgacatagcctcaggaggtcctgatgacatgtgcccaagatggtcagggtacaacttgcttttatacatttcagagggacatgagacatcaatcagtatgtgtaacatgtacattggtttggtctaggtaaggcaggacaaatcaaagcaggggcttccaggtcatagatagataagagataaaggttacattcttttgagtccttgataagcctttcactgaatacacaatttagtctggctcagtgaatctgcattttttttttttttgagacagagtttcactcttgttgtccaggctggagtgcaatggcatgatctcggctcactgcaacctctgtctcccaggttcaagtgattatcctgccttagcctcctgagtagctgggattacaggcatgcaccaccacgtccagcaaattttttgtatttttagtagagacagggtttctccatgttggtcaggctggtctcgaactcccgaccttgggtaatccacccgtctcagcctcccaaagtgctgggattacaggcgtgagccaccgtgatcggcacatttttacataagcaatcagatatgcgtttgtctcagatgagcagagggtgactttctgtccagcacctgtgaagataagcttttccttgtgggcaaattgtgctttgtagctatcttatttaggaattaaaatgggaggcaggtttgcctgctggagttctcagcttgacttttcccttggcttagtgattttggggtcctgagatttattttcctttcacatttctgtagcctcaagatggcatatgaacttctgtacctcactgtggagcggggtctttgttctgaaggctgctatgtatacatatgaaataaatgtgtgtgatctttcttttaatgtctgttaattaatctgcctcatgtcagtgattttcagtgaacctccagggggccaagggctttggcccctacagtatggacatacaattttgtttctcttagggaaatacctatgaatggaatgactgggttatacattggaggtatgtctaactaaaagactcccttccaaactgtttttcaaagtggttgtaccgttttacattcccaccagcattgtatgaaagtttcagttgctctcatatcctctcctgtcttttttaattgctatcatctgtctttttgattttagacattgtaataggtatgtagtactatctaattgtgatttaaatttgcattccactaatgactaatgacgtgccccatctttaacgcaacatttccctttacttgcaggttattttgctttgcaagttggaaaggcaagattaaaatacaaagttacgcccccagcagtcactgggtcaccagagtttgagagagtatttcgggcacagtaagtaatgcttcttccacccttcatggatctgtgcctgccatacagacacaattcctgactaggggaaagggatatggagaagaccctaagttcatgtgcaatatctagttataacaagtcactcttcacagccaagaccgttctcagaatccagaaagtttgaagggttcggggcatgaagtctctgcccacatctattaccaattcagcagggtatatttacagaaaaggctgggatctcaggagggactgctgtgtctcccaaggagggtcactgggtcaaagaggccccctggagccttgtgagaccacaatagtctgaagttggattcgttatgctacaattttctatcttattttttcctccctacttcaaaacagaggtagatcaggattaatcttttgccagtttctctgtgaaccatttcttaaaatcagaaacctgtaagaatgagaaagcttgccagctcacatgcatgcgccatgttttttgatcatcttgtgctccttgttttttcagacccacacaaaatgttccaccataaacaccgtgaacttgcctgctgcaggaatgctagggcgtactttatatttcatcccccaaaatacgtgctttaagaaacatttcatgcgtcaccactgatatatcattgggttcttttgttaccatcttgggatttttcatttatgtttacaagtgagattggcctacactttgcctttcttgtctggttcttgtctcattttgatacagatgaacctagtgtcaaatgagttggaggaagcatcctgttctactttctcagataattttaataaggttggaagagtgtgttccttcaaggttgtgtagaacttgccttaaaataatctgggcctaatgtttttctggtgggaaatttttaaattatgggatttgcattctttaatgattattggactaggcaggctttttgttacatcttgaatcaattttggtaggccttggtccttgagatgataacattggtctcttgattatccacttgctccaaggagggttttacagactactccctaggcttgaaagcgtggggtgaataccaccgggagtacacgagataattgtaagaggtgtgtagacttggttttaaataacattgaactacatgatgagaagtcattctcatttcaattatctttgaatccttatggttaagtcaagtggaaagtattggtttggagccagcatgtcccacacctcaaaattaatgtttatttttatcaaagtaatttatgtacgtgatctgaagataaagtgggattacaggttttatgacaacaaataactcttccttgtccctacctcccctctccctctatccctagagataaccctttttgattactactttgggtatttacttctgtatttctaaacattatactttcactgctatttattgattcacaaattttagacattgtcagttggcttctttttatggaagaaataatttcatgctcctttacttcttcttttccttacctcatccttccagtaacattatatcactctgttaggttaaatcaatagccaatgtttataattattgtgattaagaaaataatgttgaaagcagggccttatagtatactgtggttacatttccttcttgtgcaattttttttccctagggttaataattgctctttatttctttgtttgcttagtttcatgcccaaatcttctgcagaactgaaaatctcctttcgttacattcaaatgcattagataatctagtaatacatttttctgtcttggagtcatttctgcctgagtcctccacttttcgcttcaagttgcgggatgctcttggtgcttgctgcacagctgctatcctgggacttcctgtcaccatcctagaaatttcccttatactgtcctgatttggatttcctggacctcctgttttcctgtttattggttttctctctctttttagtggagtgcacccttcagaagcttcctgagaaagggtgaatgtttggtaaagttttgagacttcacatatctgaaaatgcacctttatcttgcctcacagttaagggatggcttgtttaaatgcatttctgtattagaaatccttacccttagagtttttgaaaaaatttgctccatggcttcctagttcccactgatattgttgagatgttctgtgctattctgattctggaccttttgtttggaaactatggaagcttcaggatcttgcctggcctactgtcccgagatgttaatagcattgtgcttgttgagaggctttttcttcactgtgctcaaccccaggtgaggccttttcacagcctgaaaactcatgtccttctgttttagaattttttttttgttttgagacagggtctcagtgttgccttggctgaagtacagtggcacaatctcacctcactgcagccttgacctgccagcctcaggcaatcctcctacctctgcctcctgagtatctaggactacagatctgtgctacaatgccctgctaatatttgtattttttggtagagataaggtttcaccatgttgcccagtctggtctcaaacatctgggctcaagcaatctgcccacctcagcctcccaaagtgctgggaatacaggtgttagccactactcctggcccagaatattttttaatattatttcttcccccagatttcctctccttcattttctctgttctttcattcttaaaacgcatactagttgtgtgttaacctccaggactgatcctctagttttcttttatcttcaggttttcataattttggatttttgttctttcagaggaatttcctcaacttctaactttttatctgaaatttgagatatcataattttaatttccaataacttatttttattctctgattgctttttagttgttggtgctgatgttaaaccgtcacttttttatttcattgatgtagtttattctcttatatttgaggattttaattataattttaaaaattctctgtaacatttctgtttcttccaagtatctttgtgtcttttttggcctttgtctttcatttgtatttattatttacccattaagtatttattgagcacttctgtgtaccgggcattgttataatagcttggcctagatccatgaacaaatcccacaaaaatccttgccctcttggagtttgctgaggaagccagaaaataaacaataagcagatgatattataagaaaataatataagctgggcatagtagctcacacctgtaatcccagggactcagtaggcccaggcgggagaactgcttgagaccagaagttcaagagcagcctgggcaacatagcaagagccccctctctctattaaaaaaaaattaaaaaattagccacatgtgggtacatacctgcagtcctagctacttgggaggctgaggttggaggattggttgagcccaggagttcaaggcttcagtgagctatgatcatgccactatactccagcctgggcaacagcgaaagaccccaactcaaaatgaaagagaaaatcatatattatgttagaaggtaattggtgctaaaaaaaaaaaaaacaaaaacagaaaggatagcgttgtaagagggtatgggatgggttcctggggggtaagttgggtggtctgtgatatacaataaagctatgggtgtaggtcccgctgagaaggtggcatttgtgaacatgtagagaaagagctcttgggtcagagacaatagtcagagaaaagcccttagctgaggatacacccagtgggttagtcaggaggttagggggctgcagggagcctggcagggagtgggaggaggtcaactcagagaggtcatagacggctgggtcacactgggccttaaaggccactgtaggggactttggcttttctctgagtgaaatggaaagtcatgacagggttttaagcaaaagagtgacatgatcttatattttaaaaggagaatcctgtttgctttgctgagaagagcctgtatagaggcattggtagaagcagaaaatgcatttagaattccaggcaagagatgatggtggctgtgttgcagaatttttgctccttagttcagctaaaactgggttcttgtcacatggccaggaaagattaggcgtgctgacacattgaagggtgagtagagcagaatttattggatgtaaaggaaaaaaagaaaaaaaaaaaaagaaactcaacaaagcgggagggggtcctactcacaggcccctgcctcgcagattaattccaggtcaccacccacgagctggagaccaggctcctccctctgcacaaggttcgaacttcctgtggctccaccctgttcctccagtgagcatgcaggctttattcagaaagaatcagtttggaaagggcaggcaagcgggggcagttctccctcagggtggcaagtttcatcctggaccagcagtccaggctttcagccttcaagcttttttagacttgagggtggggtttcaccagggacccttggctgtctcctgtctctgtcagctagagccagggagatagcagtgaaatgatgggaagtggtcaggttctggatatattttgagggtagactcatagaattttctgacataatgaatgtgaagtgtgagaacagtcaagaatgattcttggattattggcctgagcatccatcccaaaggatggccttgcgatgatctgagatggagaaggctgcaggagaactggttttggggaagtattaggaggttctgtcttgacatgttgtgtttgagatgtgacttaaggagaggccttaagcattatgatctactaagctatttggattgtttatgattgcatcataaactgacaaatacattgttggttacacctccaagtagagaggcagctggataaacaaatctgcattttaggagagagagctgagctggaaatataaattcaggggtcattggcacaggaagatgatttacagccatgagactggataaaatcacttaggggagtgtgtgtaggtgtattagtccgttttcacactgctgataaagacatacccgagactgagcaatttacaaaacaaagaggtttaattggacttacagttccatgtggttggggaagcctcacagtcatggagaaaggcaagtcacattttacatggatggcagcaggcaaaaaatgagagagcttgtgcaggggaatgcctcttttaaaaaccatcagttttgtgtttttttttttttttttttttttgagatggagtctcaccctgtcacccaggctggagtgcagtggccacaatcttggctcactgcaacctccgcctcccaggttcaagcaattcttgtgcctcagcctcctgcgtactgggactacaggtgcctgccaccatgcctagctaattttttgtatttttaatggagacagggtttcaccatgttgactgggctggtcttgaatgcctaaactcaggtgatctgactgccttggcctcccaaagtgctgggattacaggtatgaaccaccgtacccggcctaaaaccatcagatcttgtgagacatattcactgtcacaagaatagcatgggaaagacttgcctccatgattcaattacctcccaccaggtccctcctacaacacgtgggaattcaagatgagactggggtggggacacagccaaaccatatcagtaggtaaagaacaaaagaggactgagccctgatggcatcaggaggtcaagatgatgacaagggtcctgcagagagatctgaataaaggagatcttagaggttttacccaaacatctggtattaataattctcaactggctgttaagaaagaggcattagagagtgacgtggaagctccatgtgcatggctggggcttatgattggtcaggaggcagctttcttctggagaaccctcaaagtatctgtaggtcatctttctggtaccacttagtttctctagagaaaactctttaaacctccttcaggggttgaaggaaagaggggtggagataggataataggcctgacttttgagagtgcagtagtaaagacaggaaggtttttcgactgtgcagtgtgcagcatgcagattctgactgttttcaggacagaattttacccccaccctctattattcctgaagtccctaacagtctctggttctgtttctccaggcaataagcctcccacctcctgtgatggggagcaggctggggctcaggagtgggaagcagaggtggagggcagctaagccctccttattcagtttttcaaccactcttaagttccagcctttggcctctaaggtacctggggtgcccaattcctgagcttcttttggttctggggtaaggatggtctcagtcttcattgcttcttccttcagcaggcacataggtttcagctttctgtactctaccagtccagccactgttcctccatgtgctgtctttcccgcagaattttgctaatggctctcttccactcttgagagattgtttggaggttccagcaggggagcatagctactcatatacccttgaccgaaaactggtcctcctctatggaggatggtcgtcctctttgactgagcatgcagctttgggagggacgcacatggagtggggagggaggaagggaacacccgcctagccagccagatcagccgaatcaaccctggcaattgatggggtgacagatgttgcagccagattaccctcacttcctctcttttactcttgtgtctgctctcattctctttgttcttgattactcatatctatttttttttctttaactagcattttagtgaagcttcagaagtgagaagaaatgagcatgggttcaatctgccatgtttaacaggaagtcatcatgatacatttttgatatcctgtgcacacccattttcccttgtcaacaaaaagagtcaaactctataaaatacttaaagagatttatgtatgtatttatttatttttagacagaatctcactctgtcgcccatactggagtgcaatggcgcaatcttggctcactgcaacctccccttcctgggttcaagcgattctcttgcctcagcctccccagtagctgggactacaggcatgtgccaccacacccggctaatttttgtatttttagtagagacagggtttcaccatcttggccaggctggtctcaaagtcctgacctcaagtgatccaccctccttggcctcccaaagtgctgggattacaggcatgagccaccacacccagcctgaagagatttattctgagccaaatatgagtgatcatagcccatgccacagccctcaggaggtcctgagaacacgtgcccagtttgtttggggtgcaacttggcgttatacattttagggagatatgaaacttcaatcaaatacatttaagaaatacattggttttgtccagaaaagtgggacaatgtgaagtgtggtggggtgggagcagggggcttccagcttataggtagatttaaaatttttcctggttgacaactggttgagtttatctaaagacctgggatcaacagaagggaatgtctgggttaagataaaggattatggagaccaaagttcttgtttgcagaggaagccttcagatggtaggcttcagagagaatagtttgtaaaacgtttcttatcagccttaaagtctgtgttgctgtgaatgctgaagaggtataagggggtatgtctgactctcactttccatcatggcctgaaacagcctctcaggttaaatttttaaaagagccctggctgaggaggaagtccattcagatggttggggggccttagaatttaatttttggtttacaccctattcaacagagaaagaatctcatggtcagagccgtcagcaatcattagtatctaactagaatttagtaactttttgctttcattggatttatttttatacttaacctttatttagaaagctacactctttctgctcttgtaatgatgtaaaatttattttttcttaatttaagcaaaaaagctgatttgtagaaagatagtgatacattaaaaggctaaaactttcacagtgttagattaatgcttgaagtttgggagacactatgctatttataaaaatcatcacgggaggaaattccggatcttcccactttgtctttcatgatctgaaaacttgttgggaactactgggtatcaaggaggctaagtccctgggccacttcttggttctatttttattctcatagtttccacaaatttgactttctttgaagttattttgctctccctcctcttctatatctggaatcctcttgtcccaggaataaaactgaacaccatttccaagtatttctctcaagttactatttataaagtaagtactgtatacaaacccagtttccttgttagagatgttttgctttgttggattaatcatggtagaacagagagtagttaaaaaatgacgatcaataatcaggacagatttggagccaggaaatactttgagcaacaacacagtagttgttcccctggtttctcactgaagagtgaatggggatggctccactccatactttgaatttcttcttgaattttcccagccctagcccaatttttgccttagattctaaggcgtaggataaatcgggccaaaccaaatcaagagtcattgcttgcaaagccatttagactttatctgaagtagttagagcagaattccctgggataaccagttcagtccaaagcctacttggttatctgtttttttccctggaggaggaatgcactgtcttttctggctctcctggaccagaagcactggtttccctttgcctctttggaaggacttagagcttagaggtccagccttttccctacccttttctcctgctgattttgccctcagcatagccaagaagcccaaagttatgactaattctatctttaggtggacctggacatctcatcagcgtcacttcaaggttcactgatcctaaaggactgtttcttgttggaaggtcatctcagggtgggtatctatttgtgaccagagctgatatggagtccagcctttctgagttactagccctgggctccttaaaatctccattcacttcctcttcccttccttacaggagaggacttacagatgacagtctctagagtcttgccgtcttttgccagaatacattttttaaaattgtgaaaatagcaactataatttcaccaaggaccattcctttacgttattactgaatttagaaaattctatctcatctaatctgagcaccttgatccctttagagtaaagtcattttataaaatctaaaaagtagatccaagtaataaattgattttcttgcaatttaaatacatttcctctgattctaccttcactggaaggggagaatagctgctgacctcactccttttcatgtgctgaaagaccattattaagcatctttcatcttctggattttgaggctagggagcactaattcttcagctttttttctccaaccatttagaaattttggttctctttagacaaaaatttttaatattatttctaaacctggagtctagatgtatatctagtatactaataatggtttctttggtgctggttaagacagaagaattgcttcttagttcttgtgaatgcactcctatttgcttaatgctgaattattcagttcctgttccaaaattaacctgccacaaggcacaggtaagcctgatcatcgtgaatctcggtaccctttagaaatattagcctcttctcattctactgtgattctgtattttttttttttacattttattaactttttaatgtcattttgaattctgattctgaaatttggaaattaaaactagtgaccttaatgcatgtctaaaaactatggagaaaaagaaaatttacaagaatagtgatttttcaggtattgtgcaactataagattacagtaatgtgggcaactggcttttgtaataagtggaaaaaaaagagacagtaaacatattcctgttttcttacaagtgtaaccatcatggacaatagcagaaagcactagatgcccttatccactgaattattataaagggctgggggctgggcgcagtggcccgtgcctgtaatcacagcactttgggaggccaaggtgggtggatcacttgaggtcaggagttcaggaccagcctggccaacgtgatgaaacctcgtctctactaaaaattacaaaaattagctgggcgtggtggcacatgcctgtaatcccagctacttgggagctgaggcaggagaatcatttgaacccaggaggcggaggttgcagtgagctgagatcacaccactgcactccagcctgggtgacagagtgagacgccatctcaaaaaaaaaaaaaaaaaaaaaagggatctcccaaaatgacagagtgactctgtgtgatgagctcctcaaactccagtgtccttaccaataccaagcagcatctgtcacataatccgggagattctccaggtggtcaggggacaagagggagctgggaggtggaggaactgcaaatctcctttccctgcatgctctttgtgttccctacaagcagcaccactgaagggcagtggtgggactcatgctctcctgccaccagccgccacctccctattgtgtcccactcagagttacttgacaaggagcaatttagacagttacacgtctttataaaaagattaactccagcaacctctcatccccaagccttttctgagcatattaacctgttgctctgatcccagtcagtgtaatcatccaaaagaccgcccagggtccaaagtcagaagaccaaggccgggtcatccattcagagtgcaaatggctcatggcagtgtacagcccactggttcaggatgagtcacctaaacaagaagagaaaaaatcagaagcaaacagaaaacctgcaagaagcaaacttcctttgaattgctttgtctgtttttatttagaaaaagatctactgtgaacctggcattagaaatggctcatgaggttttccttaggagaatgtttcatattttctgaacaaagttgttgcaagcaaagttgcatattgtgttcgttggacacggtcaaatagagaaatattcataaaaagttttaggccagaagtctcccaagtgatgtgcccacattgaaggaatacactaagtaatccactgtgagggtgaggaaaatattggagcatctgtttatacttattcttaaaatcctatcctttaattaaaaaaaattttttttgagacagagccttgctctgttgcccaggctggagtgcagtggtgcgatcttggctcactgcagcctccgcctcctgggttcaagcgattcttctgcctcagcctcctgagtagctgggactacaggcacgcaccaccatgctcagttaatttttgtatttgtaatagagtcagggtttcaccatattgtccaggctggtcttgaactcctgacctcaagtgatccacctgcctcggcctcccaaactgctaggattacaggtgtgagccaccgctcctggccttaaatttttttaaaaaaattttatttttttatagagatgaggtctcactgtgttgcccaggctggtctcaaactcctggctcaaatgatccttctgtctctgcctcccaaaggcccgggattacaggtgtgaaccagcttcctgatcccccatcctttaatttttatgatgtttgttttataatgaatatgatattcttttccagttgaatgtattagctgtgctaatggataaatcccagattctccatggtttaacacagtggaagttcatgtcttgctcaagtctggtcctatgtgggagctcctgggtgtgggcctcctctgctgcaggaggatgtgtgcatatttttatggggctgtgcaactgttagagctatgcaatcagaaaagtttggagactagtgttgaaggaactgccacatttggagctgccaggccacagtttgattctttttcccacccccaaataacataaactttgtagtatacttattgactgagacaaggcccaaatagcacttagtttgggccatccttactgctcctggttaccagatccaggtgggaatgtgcagtagtcctgagcccccagggcccaggctccatggtactgggatgaacaacaaggggtctcagcagctttaactactcaatctccacagtgcccaccagactctttccagttcttctgggtcttacccagttttagcacttaaagctccatgtccccctaaattcctcagtcccaggcaaaccaagatagcgttcatgggaagcttcaatatcaaaggagcaggggattgttcaaagagggctctcgccagggaatgagtatacacagcctgttttcccatggacagcctgtttttccagtatggacatgcagagaggagacagtggtcataatcaactctaccccctgttctcacaggaagggaagattgacagctactgcaggctgtttgctgttccatttgggaaattttcctgaggatcccctgtaataagaggatagaatatatctgccttcatgacttaaaagaggctataaattattttcatgtcaatgaaactgtaattagccactgacaggattgtcaagaagtaattttcagagtttggtccccttgagttaaacatgcctgctgacagcttactgaggacgtgttattgtgggacaccatccaggcctggagggacccagaatcaggcagaaggacatggtcacatggtggaggggctggaggaggtgacaattagcaggtagaatgggattccaggtatttcaaggccaaaccaatacttggtgctttcaccaggcaggcagcagggaagactgtcagcaacaaacagggcaccccactggcagtcagatgatgatgatgatgatgatgatgatgatgattattattattattatttgagacggaatctcactctgtcacccaggctggagtgcagtggcgtgatctcggctcactgcaagctccgcctcctgggctcacaccattctcctgccttagtctcccgagtaactgggactacaggcacccgccaccacgcccggctaattttttatattttttaagtagagacggggtttcaccgtgttagccaggacggtctcgatctcctgacctcgtgatttgcccacctcggcctcccaaagtgctgggattacaggcatgagccactgcgcccagcaattattttcaatctctgagagatgatagcaagaaatgggcaaagtctcatttccaagggactaaggcttgaggcaggtcagcaaaagagggaccagggtgaaagtacaatgagcacagctgggacgtgaggttggggtgagctcagcagtgaccagccacttgtaggggacaaagggcctatttcttgagaaagaaaggtacagagatatggtgctgagctgctccagtactccaggtgttgccatcctgtgagcacaaacgcagctgcaatcacatccttgcctaaatctcagtggcttccagccacctgctgctcacccaggatcccagcaccccggttccccatcttcccaattccttctgggaatacaggggatgtgcccagggacacagctcctgctggcaagcagctgaagcaaggggctatgccactgtcctgctccccagtcctctgtgagtacaataccctccccaggttctggagtgccttccaccaccaccaggagctgctctgggtctgtggcagagggagattaagggtgtgactctccccgactttgtctcttctgtcatctgaggcatggcaccacttgtatctggaatctcaccaagtttttcatgaggacgatccgtcagcatctgttctggtctctggtttcccattaggtgtgaaactagttccctagcttgtgagggcagcaggggaactccaaaacatcccctctatttttatttcctttctccttgctcaaaggccttcttcctctttcagataagagacacaaaagcacacatgcctatcaatttatgtggacagacacccaaagggcttctgccctctgcagtgcagtttggacttaggacattcttacacaatattatctctttgtccccagatgccaagccaaggccactagaaaaacctctaaataattagacttttatgaaggctaacctgggctatttttgaaggtgcttttaaaacaatcttatcacacctaattttgaataaagatatgttgtggaaaaacttgatgcttacatttggaataatttaaggtgtattacaaaacaataaatgatgggacaattgtgttatgtttccaaaaaagttcatataaaatttcagtgagtgggctgggcgcggtggctcacgcctgtaatcccagcactttgggaggccgaggtgggcggatcacgaggtcaggagatcgagaccacgatgaaaccccgtctctactaaaaatacaaaaaattagccgggcgcggtggcaggtgcctgtagtcccagctactcgggaggctggggcaggagaatggcgtgaacccaggaggcggagcttgtagtgagccgagatcgtgccactgcactccagcctgggcgacagagcaagactacgtctcaaaaaaaaaaaaaaaaaaaagaaattttcagtgagtgtggaaggactagagccttcctctgctactactacattttacctcgtgggaaacaggcctatggatttagccaaggaaaaagaaacgtgggaatgctgtttattccttgcatagccgtaatataaagtatgaattttatcaagtatcttttcactcaacctatcatagccactcaaaaagatgttaatggaaagacaaccatcagaagcaaaatcatgccaagaacgagaagcagcaggaggaaaaactttggttacttctgtgagttctagaaagttgtagttacggtttgcaagagtatcagtgttaggctttagacaagacattccttgggtcaccagtggccttttgggtggtaatggccacagtccaaaaaggaagaagaaagcaattttgcattcatattatccatttccaattttttaggggactgatggtcactctcctggcccttagagatgtgtgtgggtaacctcgctggtgtctttgctggtggggttaaaattttccatacgtgcttcaggactctacctcagccatgtctttctgtgagcattgagcttgttaatgatgcatgtttcttacccagctttaaaagatgattgagttattactggggagttattattggggagttttttcccatgtagttgaggcataagttgataaggttgagctgacctagacgcagttttctgtgggattatggagaatgagggaagaattacgctttgtaattatgcttttttttttttttaaattcagagaaaaaagatcacttatggtgacccaggctaaaagacctaggtcttcaacaaccagcgtcatctatttctagatcaattgccttgtaatattaagtatttaagctttgaggcttactgaaggaaagatatggggtcatttacaatcctgtagactatgaccttccaccaggatctactcaagacctcatcacacattatgttaaattctttctggtggtgaaattgtcagcaaagagctcggccaacctaaccaagatcacttggagttataccttaggagggaggatgaatataagtcatctttttcccctttgttagatgcagatgaattaattatagttcccagagaactattcccttttgcttaaattagtgtcagattttccatccacgtcttctatgaatagaggcaatatgacttgacattaggacagagctttggaatctagagatggatgctgtctatctttgattctctgcaatgcatgtcagtctgggctctcaggccttagtttcttcctccataaaatgggaatgaaatatgctcactgatttacttcaggagattttaagggaattatttaaagaccattttgtaatgttctgggtaactcaagtggaaggcaatggatgtgagggaatttttaaaataagaaatctcttgaatatgaattgagtaatctcttaagttctttagataagatatggagtgatctttaggctcaggaggcctgtcttttgggaaagtgctataactcacttctactaccggcaacttaatacgtaagagaatattcttggccctgctctgaggtttaaacaatgttcaaccttgaaagattgattttaaatgtaaaggtcatttaaactcttttgtaagttcttatattttgttaaaataggctgaacatttacctctagatgaaaaatcaatgcttcagtgtatacttttctcataaaataacctatgtctttatttttttctgcagacaaaactgtgtggagttttatcctatattcataattacattgtggatggctgggtggtatttcaaccaaggtaatgttaaaatacagtcaactgtgttctaatgatgactgtgatgcttaaacgattaaggagtagatatatggccaggcacggtggctcacacctatattcccagcactttgggaggcccaggtgggtggatcacctgaggtcaggagttcgagaccagcctggccaaaatggtgaaaccctgtctctactaaaaatacaaaaattagctaagtgtggtggcgcatgcctgtaatcccagctacttgggaggctgagacaggagaatcacttgaacccaggaggtggaggctgcagtgagctgagatcgtgccactacactccagtctgggtgacagagactccatctcaaaaaaacaaacaaaaaaaggagcagatatgcaactatatagctaccaatcctggagactaaacaaaataaacagtgtgtgcatcagagtgctatgttgcaggtatatgaactttggcttcattctaatttaattcaataatgaaaaaaatattgagacaaactatatgctagatactcaagaatgagaacgacatgagctttgtcttcaaatctaataatctacagttgactcgaacaatggaggggttggggtgctgaccccccgccccacacacacacagtagaaaatctgcatgtaacttgataacccaaaacttgactactgatatcctattggtctggaagccttactgagtacagtctactaataaatattttgcatgttttatgtatcatatactgtattcttgcaataaagcaagctagggaaaagaaaatgttattaaaattataagtaagaacaaatatttactatttattaagtggaagtggaccatcataaaggtcttcatcctcatcattttcacgttgagtaagctgaggaagaggaagaagaggggttggttttgctgcctcaagggtggcagagtcagaaaaggtgaaggaggtggaagcggagacagaattggcaggcgcagtaggtataaatttatagaaatatcatttctgacgtttttgctttttttctctaaaaatgtttctatatagtaccaatccttcttccactgttacgtttagtttcagtgcttgtatcatagaagggtccatgtcataaaagaagtaaaaaagcagacttgaatcatcagaacccttctgccagattgtctaatgtcaatttgttttctggtactgcctcttctgtcttcttccttatcatctggcagtggttcagagcactcgtctctaccaagtcatcttctgttaattcatctggcgtggtgtctattagctcttgaatttctccaagattcatatcttgagacccttcatcccccacattctttgccacagccactatctctttcatgatttccttgattggctctgttgtaaatcctgtgagtgtcatgcacaacgcctgtacacagtgttcttcagcaagaatttattgtttcaggtttgacggctttcacaaccttcctataacaatgctagcatcttcaatggtgtaatccttctaggcattcataatgctgtttctatcagggttctcttccacaacattgacgatcatatccatagagtaccttgtatcatgagccttaaaggtcctgataaccccctgatttagaggctgaattaaagatgttgtgtttgggggcaagtagactacttttatgccttccacgttgaactcatggggttctgggtggtcagggacagtgtccaatatcaaaagaatgttagaaggtaatcccgtcctgacttcagggacaaagcattgatggaaccaatccagagaaggggttcttgttgtccaagctttttttttgtacaaccaaatgactggcaggtgctgtttatctttttccttaaggctcagggggttagcaactttatagataagggcagtcctgattataaacctgactgcatttacacaaaacagtagagttagcctatcccttcctgccttaaatcctggagcttgcttctcttctttactaataaatgtcctttgtgactttttttttctcccccgggacagggcacttttgtttgcattaaaaacctgttcaggcagatatcctttctcctcaatgattttcttaatggtgcctgggaactcatgtattgcttcttggttggtagaagctgcttctcctgttatcttgatattttaaaagctaaacttctttctaaaattatcaaaccatcctttgctggcattaaattcttcagctttagatccttcatcttccttttgcttaaagttgtcatacaaggattttgctttttctcgaatcctattagagtctacaagtatgtgtttcttttttcttttaatagtttaatgtattttaatagcaaacttacaggaacagcacagaagacagacaacattaaaaacatgtacttgcatgtaggacaactcagttagaaaagtatagtgaatggatggaatctactgtatgataaaaatgctacaagcaccatttagttgccatcaataagaaatttacttgttttaaaaaaatccaaatgctggcattgtccagaaaaatttaacaggtttatttataattattataaagttgaaccgctgaaacttgttcactgaaacattttaacttgcattaatgctttacgtctccgcatttatattaaaaattcacacacaaatgaaaatggaaaaactgccaatacctgatttctgtcccctatttttccactcgcaatcatatacttaggtaccttttgaccccatggaaaaaaattatctaacgttcagaactaccaataacaggaagaagagaaatttttttttttttgagaatgaaatgtttcccatcatagtggattcttaagcacgttctccacgtatgctgtgtgctagctggatgtcttttggcataattgttacacgtttggcatggatagcacacaggttggtgtcttcaaaaaggccaaccagataggcctcacttgcctcctgcaaagcaccgatagctgcgctctggaagcgcagatctgttttaaagtcctgagcaatttctcgcaccagacgctggaagggaagtttgcgaaccagaagttcagtggacttctgataacgtctaatttcacggagcgccacagtaccaggcctgtaacgatgaggtttcttcacccctccagtagagggcgcactcttgcgagcggcttttgtagccagttgcttcctgggtgctttaccaccggtcgatttgcgggcagtctgctttgtacgagccatggtacagagacctccttacttaccccccttctccttcggctggagctcggcgagcgagaggcggcgctggcgttggagagccaagtatgtgtttcttatagcaatcctgctcccacataaaagctgcatttcaatatgagataaaaagacattttggaaaaagtgcaaggtttttccccctgctggtgtagctgcaagtgacagctttacaaatcactttttctttcttttttcttttcttatcttttcctttcttctttcttcatcttcttttttttttttccactggtccttgcactgaattcatttatcttgcaatggtggtcaaccacagctcacagctgcagacctcaatctatgacacatattaagccattcaattttttcttgtaatatcataacttttctctgctttttgggagcactttcagcaccactagtagcaatctgtatgggtatcatggcattattcaaggtttatggtattgcactaaacattgatgaaaaataggcaaaaaccctgagagatcactttttactgcgatacgcaattttctggaaagaagaactgctcagttggagataattagcatcaccttttaagcagatacttgcaacacttgagctcactgcaatagcaacaggaggtggctacaaaatatttacagtagtacagtatttctatagttaattttatgcagttatgatttaatactgcatctttacacttgtttacatttctctcaactacaagtggcatcatgcattatggtctgtgtttgtatgctttgataaattttaactttgcataaaattcatatatatatctatatagtctttctgctgaagctttgtaaaaatttgcgtatattttatgatagtaaatgataaaatagaccagtatctacatctgttttgtgcatttgtgacagacctttttcctaatttttcagtatttctgggctatgtgattcatttgtgagttttgtcacattgtcacaaatctccaaaatgttttccaatatatttatgtttatttttgtaaagccacctcctgcacaatccaatatatttatttgaaaatatccatgcataaatggacctgtgcagttcaaacccatgttgttcaagggtcacctataattctaattaactgaaggaggaggacacagaatgaaaaattcacattaataattatagctggcgaggcccagaagcttatgcctgtaatcccagcaatttgggaggctaaggtggagggattgcttgaggccagaaattcacgaccagcctgggcaacaaaggagaccctgtgtctacaaaattttttttaaaaaactatctgggcacacatgtagtcccagctacttgggaggctgaggtgagaggagctctcaagcccaagagtttcaggctgcagtgaatcatgacagtgccactgcactccagcatgggtgacagagtgagaccctgtctcaaaaagaaaataataataattatcattatagctattatttattgagcccttactatgtgccaggtactgtttttgttttttggtctttggttttgcttttttttttttttttttttttgagatggagtctcgctttgttgcccaggctggagtgcagtggtgcgatctcggctcactgcaagctccgcctcccgggttcacgccattctcctgcctcagcctccggagtagctgggactataggtgcctgccaccacgcccagctaatttttcgtatttttagtagagatgctgtttcactgtgttagccaggatggtctcgatctcctgatctcgtgatccgccagtctcggcctcccaaagtgctgggattacaggcgtgagccaccacgcccggccaccaggtactgtttttaagttttatgcatacattgtcccatgtgtaagatttacaggatttaaagccttcatatgagggagggtctataattaatttatactttacagatgaggaagctgaggtacagagatgttaagtaatttttccaacttgacattcaccaatgtggggaaatttttcctttcaagtgcagagccgggtctgtaagtatttgtaccaacaacccatgcaccttttcttaaaggtctccaagtatgtagtgctgccgtttgtatgtagcgactctacaaacatccactttctatttgactggggtatccttggtgagctgagggctttctccaaacttggcttatgcgtttaacagtgagtcagaccagcccctgctaccttcgttggagaaattcaatctcctttttctggtaactttcactgtctcattttggtctatacttgattgccaagatttaaataaaccaaaatccagctgctttcaaaggcaaccccatcactctctttcttttagtttttactgtgaactgagtaatttcaggtacaatgtcctttagagaaagacttcttcactttattacaactatacttgtgtcgcttaagggcatgaatgaaaccgctgttccttgtcacgtaagagcacgttaacaactaataagaaaagcgccttttggtaatgggactctgtctctgccatttgaccctttggatttctctgtgataggctgaatgaggcagactgcctgtcagaaaggattgcttgagtatcttgtcagaaatttcttttcattctttctcatccaaagtaagtcacctactaactgttcctgaactgttctcattggctttctgggagtaactccctagacagggagtctcaaaactgagaaccatgttcagaactctttggcttcctcagaccctgggaagggtccaccagctcttccttcccagctctttgcttggtccgctcgttcctgtcctgtggtgccgatacagatgtcatcccctccagaggccttcctataccccattttggcaacctcctccagttcctctctctcccatctctcttcatttctttcacagcactttcaagtttgcacttttcttctcatttttttctttgttgtctgtctttgctgagagaatgtatactctctgaagtcagggagcttgtatctttttcactgccgacctcaatccttaaagtaatacctggtttatggtagatacggggctgggtgtggtggctcacacctgcaatcccagcactttgggaggccaagacaggaggatggcttgagtccaggagttcaagaccagcctaggcaacatagggaggccttttctctgaaaaaaaaaattaaaaaattggccaggcctggtggcatacaccagtggtcccagctacttaggaggctgaggtgggaggattgcttgagcccaggaggttaaagctgtgctgagctgtgatcatgccacacattcctgcctgggtgacagagcaagaccctgtctcaagaaaaaaaaaaaatcatgcggccaagtaaaataataaatttaatttaatctagcatatcgcagtcccacacatagactccaaatgtttacagtagggctctggcaacttgcatctgtgaggtgctgaggaagagagtggggccctaacatagggaagacattgatatgtattgatatgtttcactggatgcgatgatagaacatcatcatactgtatttcataattctttttgagataaattttgtatgtaataaaatgcataaatcttcaatgaatgttgagaagtacacacacctgtgtggtccagatctctatcaagatctagaacatgacaaccacccagaaagtgtcctcctgcttctcccagtcagtccccattctcactcccagatgcaagcacttctgattgttttcatcagttaggtttgtccattctagaacttcgtataattggaatcatacagtatgtagcctgtataatgcttcattcactcagcaaaatgttgtgttgcatagatctgttttttttcattgcaaaatgttgtgttgcatagatctgtttcttttaattgaatagactctatcacagcttggttatccattctcctgttgataggcttctggactgtttccagtttttgtctataatgaataaatctgcaatgaacattcttaaacaagtccttttgtgaacacatgctttcatttctcttgggtaaatacataggaatgagattgctgagtcaaatgttacgttcgattttataagaaactaccagaacttttcccaaagtggctgtactattttgcattcctgccaatgatgtgtgcggattccagttgcttcacatcctcaccaacattttgtgttactggttttttttttttttttttttttttttacaattttagccattctgttggatgtgtggtggtgccatctcattatagttttttatttatttatttatttttcagatggagtctcaatttgtcacccaggctggagttcagtggcatgatcttggctcactgcaacctccacctcctgggttcaaacgattctcctgcctcagcttcctgagtagctgggactgcaggtgcccgccaccatgcccagctaatttttgtatttttagtagagacgaggtttcacaatgttggccaggctggtcttgaactcctgacctcaagtgattcaccccccctcggcctctcaaagtgttgggaatacaggcctgagctaccacgtccagcctcattatagatttaagtgggaatttgttgatgttgaatcatgttgaaacatttttcttgagattattggcacatttgtttccttcctatgtggattctctctatattctgaatataagtatcttgtccaatatatgttttgtgaatattttctcagtcgtcgtacaacatcttaagagactgctgttgtattttgtgccttttctttttttttcccacccccctatagtttttgctacttgtctgggtctggtgtacatatatggccgtcacctatacttctggggatattcagaagctgctaaaaaacggtaaggagaacccagtaattttgtatttatgcaaaaagtagcaggataaggtctgggtcagtttccttctcctgagagatattaacagcactgtgagttgtggtggcaaaagtaatccatactgtctgaggtcaagtcttgccagttcatacacaattaggcatgagatgggaaaatgcaagtataaaactgtgcactgaatgtggactctagttccttgcaaaaattttgcattgtctccagaaagttaccgaggaaataatcctgcctagccttgataatgctttgaatgttcaaagaaaccaagtgatctctatggctaggcattccctttaacttatgtgatgagctaaaattttcaaattgcaaaaatatagaagttctggacagtgttaacgataggacagcctacctcaggactctcagcttccttattacagtccagtttgtcacttttctccctcatgtccactctgcaggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatacttgcagaagctgttcccaccatgaaggtaatatggtatcatttgttaaataaaaataaagtctttattctgtttttcttgaaa

SEQ ID NO: 36555 - DNA, 17975 bp, Homo sapiens
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccagggcggagcccagtcgactcccggattcccctgccccgcccccggcacgaggccccgccccggcggccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagaggtgacgcccagggcagagcgcgcggggcgcatccggggcgggcggccgaggagggcgcggcggctccgggaacccggcgacgctgcgggggaggggcaggccccacaaacccttcccctattaccgcctcagcctctaacttcccgaaacgccacgctcccggctttggttgggggatgcagacgggcactgtgcgaagggttaggtgcttcgttgcacgggggagcggaggagagggaacaggtcgtaaaaaccttccctaaaatcttagccctagattggacctcgctacacacccgacgacaccccgttcaggtggctccaactcctggggttcaaacagtgcttgctggagtcctgtccgactgacttggcttacccctccttagctgtttcctcctagaactatcttcagtggtcttactggcaggtgttggtgtccagatggatcgccttcgcagggctaggtgaggacactctcccctcctcaccatgcactgagatctgagaggctgccagtgcagctcacctcaaggtctctccgaagacgcaggcccccatgctggggtctgtaggggaatgagggacactggaggaagagtagggtagtgagctgggccccagggggactggctgaaaaggagacagcagctaatctctggattgtatcgcagcttgaaatgcaatcccactgtccttccggtccagaggatttggacttctttctctgcccatctgctggtgttcagcagcttggggaggtgacctggcagctgggttagatgggggtggtctgggggaattagcccggcagctctgcccaggggttggccgcttatgtaagaacttttaacggcttaaggggctcctcggcagtggggctgctgagttaggcccccctgtcctggcaggctgcctctctagaattgactcaggcttaggcaactcccagcctttctcctgtcctagaaatccagctcctggggttcaggccgcagggcgatagggaggggccacaggggctgaatgagccggttggggcttgacagaggcagtgcttggttagagtaggggttgcaaacataatgtttcagagctcaggccggagccatgtgagtgcatcctttctccagattgcacttctgcatcaaggggccatccctacccccacccccaaccgacccgcaccccccacttgggctcagggagcctgtgtaaacctgagccccagccaggtggtgtagtgagattcaaaacctgctggccagacctccacctgccttcgccaacctggagctgtgggaagaggacaggattctgtgagcagtcctgggtttgaatccagtgttattgctctctggcttgaacttggacaggctatgcccccgacccagctcaacagtgctaatgttactaccttttctgcccttcccccatcttcccctcaagagtgttttgaaatcttgttccttcaaatagccccaggcctgatagagccctcggggttccctgcctggacctcagtacccagctgggcactgttgccctgctaccctgaggaaggggcttggacctgccttcctatccccacagctgctaggtgggggtctcagggaacaacagcccttcctcggcttcggaggccgactggttgcctcggtgtctcctccccatggaggaagcagctggggaagatcaggaagagggtgtatgagagtgggggttgagggtggattagcggagtctctggaaaagcacagcctaacccagggctgagcccagcagcttagagtgatgaggagcccaacacaggttaaagtgggaggtgtgtaggggagcaggagaggggagtggggccatgaagtctgtaatcactgggaaggtgaccctccccatgcctcagccaggcagcctaagaaggctggggcagatgtcacagtcaggtcacctgagatggtaaaatccagctgctctcctgggccctggctctggttgaatcctgaatagtactctagccattcctaactcatactgtaggggacagtgacccagagcaggtcctttagtgacccagtaacccagagagaccactgggctggtctctgctgtgtgccaatctctgctctgtgcctgcagttggcatgatagctctgttcttctgtggccagaaaggtaccccagagcagctctgaatggtcaggcactttctgtggctggtctcactgctctgctccacgtggccagtgaaaggtcctagtgctggtgctcctcaggacgctcccctggtcccccatgtggcccgggctccctgcatgagcccaagaatgctgaaggttcagaggtgcttcccacacatcgctggcaatccggccccagcctcccctctgcacacagatggaacagtctgtgttttcctggcagggtcccgggggcatcaatgggggaggctgggcatcccagggaacctcgtggcttggaggccaagcctcccctgggcctagctgccatcacactgctgagaagtaaataaacccagcctcccagggccacagccagccaccaagccagggaggggactgtgtcccacaccaccttattctcttctccccaagtgagctgtgggagccacaggaggacacagggaggaggctgtggagtctgggtggggggacccactcttggtctgggaagagcactggcagttctggtcccataagagggaaggggatctacttcctaccaccccacctttccccatgtgaacctatctgtacccagtcactgcccccatgtagaaatctggatcttgctgggcacccagggccaccaacttctgctttggggatttttcagaagttccctagcccctgttcttatttgtatgcacacttgtctaagccaggcttatgatcctcccccatcttcccaccgcaggaccctcccaaataacaaaccgctctctgagattaaaagccctggtaccaacaccattttctcagccggagatagggcggtgagccgaagcactgggccatgaatcagaagcagtacccctcccttcctttccgaactatagattttgcctctgtcaagggaatgggtacccaatacttgtcaattaatagattgtggagttaatgtgctcatttatgaaaaatgctttgtaaactgcagagggccccaaggccacccaaaggtcaaggagtgtcattatgaagaatgccggctccctaggatgtcgggatggggcatagcgatccaacctcaaagtccttagtgctgggtagctgagagcccagaccggtttctcagggctccgggccttgatcagggtccgcggaagagtattggggattggggaacggcagaaccgtgttagaggtgccctggggagaagggcaaggtgggtggccccggctgggggagaactcgggggtggggggggtggggggtgtgggggtgtgggggggtggggcctctgctggggggtcctgggtggctggatgtagagcggcggagggggcgtgtcccggcctgacccggtactctcccccgcagccccacacctcctacccggtccgggcttgcggggtcgcagcgccgctgcaggcagctgggggcgtgcgcgcggcgcggctgagccctttgtgcggcgcgggcggaggcggcggtttccgcgggaggggcgagaagggcgggaggggcgggaggacagggcggcgccctggcccgccctgccgctgccgcagcccccgcccccgcccccggcccgcccggcccgcggcagcagcgtggccgcggcgcggcgtcagcagtagcagcagcagcagcggcggcagcggcgggcggccgcgcgggtgtttatgtcgggtcgcggggtctcgcggcagcatggcggactacctgatcagcggcggcaccggctacgtgcccgaggatgggctcaccgcgcagcagctcttcgccagcgccgacggcctcacctacaagtaagcgccgggtctcgtacccctaggtgcgcgcatccacgcgccgcgacccccgggccggccctgcacgtgcgcggctcccccggcgttccctgcccggtgcgagtgcctgctgtgggcgctgggggctgggcacgggaaggaaggaggcccgcgccggagcagacggacgtggcacggcgacaccgcggccctcagagccctgacccgtttctggccagatccgggttcggcctgtccccttcctcctctcagcggcatggaggggccctcgggcgtgtgggaactggagatgtgggcattatggggagacttttcccagccgctggtccaggacgccccctcccagcctcaccacgagggcagagggtccccggagccaagcttaagcagccgcttccgcatggccccaggagaggcccagccaggtggttggggtggcttcttttccaactgtctagtccagcgctttttccagttgtgtccctccctgcccacaggttggtattggtgcccctcccaaggcgcgaattattctgtgactgctacccctaagcccaccctacatggggttttggaggaggacacagacccacccgtctgcctctggcttcatttgccttttccgtggtccctaggccagttgccctgcgtgctgcaggcctggcactagctctgcctcctggctgcaggactgtgcccctgccaggaaggagcatcagaaggggcagagtggggatgctggccagtcaaaagcatccctgccttgtctcctgccagccctgccctggcttgtaagcactcctgcttggccagcagtttccctaaacaccaggatacccagtcactcctgaggagtgtctcctcctgcctgcccgtaggcgacgggtgtatagaacacctagaaaatgctatgaggcccagactccagcatttcttctgtggcctctttgctatacagaagaagggctgccaaaggctgggagcagccgaaattctttgtttttttggtggtctttggtgatgagattgaaagcccacctttgatacagttgtcattgaagtcttctaggagaacaccctaggggaacgcctaggagtttctctaggccttagggcagattaatgacccacccccctccaccctgtggcttttccttcctgcgctagggatgcctgctgctttgcttagctcagttcatagtgttcctgaagtgtgggatatttgcttttgggtgtgtctctcaaggcctgctgtgattttagcaggttggggcccctgagctgtgaccctgcacctagatgtacccatgcaggcctgcacttcccttgcggagtttgctgtgaccgtggcccaccctagtgttggtagctgccatgctttggctggggacccagtgtcctggtcccacctctaaggcctctttcctcccctttcccgtcctggccatttctgttctgctctgtcagaacatgccctgcactcagccccctggggtccctccatgctgttccgagccctgtgtgactcagcagcccaggcaccggggcatgcggactgtcctgtgctgggtcatgttcatactgtgttgagcgccacaaaattgttctcaggtttgttcccaatgtttacttattttctctccccatcaagattgagaagttttcaaaggcaggcactgtgtctgctgtgtgtggcgatatgggaacttctgtgtcgcttgacaaactctgagacttaaaggcaatggatattttgggcctattaccttgatggtaccccagtagacctttcgctgtctttggctctagctctgggggctggagtttgccagactctagtgaggtgcacgaggtgggaactgccctgatggggcagtagggatggggggctgtagcctctgctcctctaggcttttctgtacccccctgctgcctcctctggcatggcaggctctgcccctttggggcacccctccccactaataacactcacttctctgtcttcacagcgacttcctgattctcccaggattcatagacttcatagctgatgaggtggtgagtacctcttcctttgacaaggggagggggctgtgtatgtggtggaagaggctgacttcttgctcaggggcagggcatggagagatggagagacttttcttgggaatgggtggataggatatagtcctttttttttttttttttggagacagagtcttgctctgtcacacaggctggagtgcagtggtgtgatctcagctcactgcagcctccacctcccagattcaagtgattctcctgcctcagcctcctgagtaactgggattacaggcacatgccaaaaccccccgataatttttgtgtttttagtggagacggggtttcaccatgttggccaggctggtctcaaactcctgagctcaagtgatccgtccgcctcagcctccgaagacgctgtgattacaggggtgattccacccagctggtatgggtggatatagcctttattgttgccagagaaacaggcagagatcaaagggttatacctgatggggcagaggcagctatgggaacacaggagtgtcctgagtgaggcctggcccagggctgggtggctctctgtcagtgacagagcctgtgggcaggttcagaagaggcctgggaaggggtgggcttgggagtgggaacggtgggcttgggagtggctgccttattgtagagaccataaggattggattttgtctggaatgctgaacaaggacatgatagaagccagtgaaattatggagatttgaaaccggtagacagacttgttcactgatccacaatgtacaagaactggcaagagggtttaaaagagttacattttggataaatacaaggaaacgcagtgccttgctttcccagaggggctcatcagtgagccgaatcaatgaacaattaacatatgataaactcagagaagcccagatgggtagtgatgatggtgtaagtcatttcaagaaaaagtgccatgattcaatgatgaattcatatacattaaaaaaaaaacatttcttttctgttgctattattattgctatttattctggtctgattctcatgaaaggccagagggcctgagtgtgcctggatcacttacatgtgagggaagttcacatccagctggtgtttagccagagctgacccagacagattttcagggggaaattcgaatgattctggttgtttcccttatgacaacaaccaggaagcctgcttggtgcagctgttcagtttaacaaagtttactggccagtgtggctttgtgtcagaccctgggctggctgctaggaagggagggattgaaaagacccctaccagctgggcgtggtggctcatgcctgtaatcccagcattttgggaggctgaggcaggaggatcacctgaggtcaggagtttgagaccagcctggccaacatggtgaaaccccatctctactaaaaatgcaaaaattagctgggcattgtggcgggcatctgtaatcccagctactcgggaggctgaggcaggagaatcacttgaatctgggaggcggaggttgcagtgagtcgggattgcactactgtactctagcctgggtgacagaatgaggctccatcagagagagaaaaaaaaaaaaaccctgcctggccggcaaggatctccttgtcctgtggcttctgtcaggaaggctgtggcccttctgtggcatgacaaaagagaagatggtgttttctagatcatggggccagaggtctgaactagggttagtgatgggtttcagggactttgaatctaaaaaaattacatagcaaagtctgcacaaatgtcttggggactgggatccactactgttggcctgaccctcagaggggtatgtgctctggcctttcctccatgggcaggtggcttttaaatggatacttgcaatcctgaccactctcctgagctccagaccattcgttgcttgctttcctggatgcctaaaagactcttttccatgcctacccccacctcagcccttgtcacccagaatccattctccaccttggagcctgagtgacctttttgaaacataaatcagatcatttctctgtcaagaccctccagtggcttctctccgaatcaaatctgagcttctgtccgtggtcttcacggccatgcatgctgcccctgccttcctcctgcctctcccttccctccactcccctggccttctttttctttcttaagtgtgcctccgaaagaactggaccctgaggcgggtttgcactcagtccctcagccgagagtgacagcccctctgacttctacttaatcggctcccactggtcacctcccaggaaagaggctttccccagtcaccttgttgccagtggtcgcttggcctttttgtttttctctgcagccttcatcctgactgaagtcatcttgagcatatgtcctgtgtctgtcatttttctttccaagtagaacataagctccattagatgagctgggaactcatccaccttgttcactgccatgtccccagggcctgtcctggtgccggtgcatgtaggagctcagtgagtgagtgtccagtgggtgataaactctttacgtgggctgtgcctccatcctcaggacctgacctcagccctgacccggaagatcacgctgaagacgccactgatctcctcccccatggacactgtgacagaggctgacatggccattgccatggctgtgagttacacacctgcatggggactccagggcacacaggaactgaccatggtgggctgtgctgaggggcagggctgaggaggaatgggccccggctctgaccacacttcccttctacatcagctgatgggaggtattggtttcattcaccacaactgcaccccagagttccaggccaacgaggtgcggaaggtcaaggcaagtaccaggcctgtccccagcaagatgccacctggcagtccccacctcagaggccctcccagcctcccctgccagccctgcactgctacactccctgcgtgtccttcctctcagtggagccttggggccgagccctcattttcccactggctcctcatcccactgagggtcctggcttctctgcagcacagctgcatcctctgttccctgtggccagcctggacatcatccctggctttcttccagccttttcctcccccatctctgcccgcagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtacctgcagggcaggggaagcagggctgggtgtagagaggaccctcacgctggggcctcagactggtgcctgtgaccagggaccagagggaggcctggctccttctctctcacctgccaacctgcaggcaaatgttcctggccccacaggtgatgacgccaaggattgaactggtggtggctccagcaggtgtgacgttgaaagaggcaaatgagatcctgcagcgtagcaagaaaggtaccagggagctagttgaaaactcaacccccagcctgactccctgtccacagtcccgttgttccttcacagccttacaggttatcccagcaaccagactgagccctggggaaggttcgaataacctcaggcaggccagagcacaactcctgccatccttctcttagcttagggaagcttgcccctagtgcagcatcttcatagtatgtttcccaaaactagtcctatgcgatgctcatcagaaaaaaatcctgagcaataactcctttctctatcccctatcttgcataaagaattgcacattcacttattaaaggctctcagaagtcctgcagttaaatttatttgacactagagctgtttttataatattttccagctagaaacaactttagcttttttttttttgagacagagtctcactttctcacccaggctggagtacagtggcgcaatgtcagctcactgcaaccctcgcctcctgggttcaagcaattctcatgcctcagccttctgagtagccaggattacaggcatgtgctactataccagctaattttttttttttttttgtatttttagtagagatggggtttcaccatgttggccaggctggtcttgaactcctggcctcaagtgatctgccctcctgggcctcccaaagtgctggaattacaggcgtgaaccaccatgccctgccacaactttggcttctatttatttatttttgagacagagtcttgctctctcatccaggctggagtgcagtggtgtgatcttggctcactgcaatctctgcctcctgggttcaagcaagtctcctacctcagcctcccgagtagttgggacaacaggcacacaccaacacacccaggtaatttttttgtatttttagtagagatggggtttcaccatattggccgggctgttcttgaactcctggcctcaagtgatccacctgcctcggcctcccaaagtgaggaagctgtgagccaccacacccggccaactttcgcttgttagaaaaaaaaaggaaaaattaaatattcaccaggtccctgttggctatactgggaaatgcttccctggtccatactggagggttctttggtgtctgtattggacagggcacatgcttctccctgcaggacagcatcactcctggctaggagatttcggccactgtggcccagcaggtgaaaggctgccagtgctcgggctgcccatcccaggccacggggatgcccatccacagacccccaggaacctgctgggctgaaagatttctttgctccctgttccttgggaagagggctaggtccctaggaacacttcctgggggcggtgctgtcacctagtggctgactggggtacttcagtggaatctctggagtggtccactttcatcttcaccctcctaaacatctcccaaacttctccccaccaagcctgcttcatttcacccctgcattccttgtcagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggtaaggcccccgcctgagtggtgggggagatggatgagtggttcagcagagtggaggtttatgaggacccaggttcacctctgattaagcctgtgcccctcccttgctactcttcctctctctttctgagtgctccctggtgtcagaattaggagggtggcagcaggattgcctgagctcagaggttcaaggtcacagtgagctaggatcgtgccactgcactccagccctggggacagaacgagaccctttctcaaaaaacaaacaatggtttgtgtcatctgagatacaaagaaagaaaacaaacaagttaaaattctccagtggcacagccataagaaagaatgaaatcctgtcctttgcagcaacatggacagagctagaagccattatccttagtgaactaactccaaagcagaaaaccaaatactgcatgccctcacttataagtaggagctaaacagagagtacacatgttcataaagatggaaataatagacgctggggactccaaaatgggagagggtgggaggggaacgaaggatgaaaaattggctatcagacacagttttcgatatgtgggtattaggtacacttgaagcccaattctcaccagtatgcagtattccatttaagcaacaagcacatgtacccactgaatccttaaaaaaaaaattgacaaattgttgcaagcaacaattgcaaatcaagactctcccccaccccccgataaagggaggtagaataaagataaaggcttattgatcccttgtgagtgatctggaccatacatctagattcatctgtattctataactaggaggaagagaaattaggaaggtcactggcaccctctcaacagctcacaacagactgcaaacaaaggcctctgagggccttcttggctcataagttgaccctgataatttagctcacgtttactgagaaccgcctgtttgccaggcactgcgtcaagaccttaatgtatatcagtccattgaggaacagtcgccattccattttcagatgaagaaacaggcttaaagaagttaagtcatttcatttggttagtgagttggtgggaacaggatatggctccaggcagtgtctccttgctttaaggatcagtctgtacaatggataggaaaggccttatgtactctaagactgcattagttgtggttaacctttcagggaagcagtcccctttgagaattgactgaaagttgtcaagtgaatttccagaaaaaaaaaaaaaaaaacaaccagaaggaaagagcattctcataacagttttcataggatttgaggggttcatccactcaggctctccctcctgccttgagaatcctcagctgtctaagcccaagctcttccgtcctttctcacaggactcgtcccaagggaattcggtgtatcagatcgccatggtgcattacatcaaacagaagtacccccacctccaggtgattggggggaacggtgagtgcggggtcgcctcccacccgcctgctcctgcccctccaatgagtaacccttttctgtccttcagcatccctaggtgatggtatggctcctggcatgggtggcagggagcatgatgggctttggtcactgtaggggggttggggggtgctagactggggtcccaagaggctgttgggcaggcaggggcatcccatcctcacattgttcctctgccccatccccacccccagtggtgacagcagcccaggccaagaacctgattgatgctggtgtggacgggctgcgcgtgggcatgggctgcggctccatctgcatcacccaggaaggtgggtgtcaggaggtgagcgagtgcccgctggccccggggcctcgcctttgttccccagatgtatatcaagtactctctctgccaggccctgttctgccatggtaggctccggggtgacccaggcatgggccccaccccatcgggcccactgacttaggggaaggcaggtgtaagcagggtgcaagagctgcagcctgcttctcagagtgcggtcaagggggctctgcctggggcttggggcctggggctggtgtgactgtccatggggcttgttggaacctcagggtttggatttgatttgtgacaaggcagatatttaagacacagagacgacatgtccctgaatatataaagatatgttatacacctgcttcaccatgtggttgggcgtggggagttccacccaattacaaagcccttttgcagggtgggttcctgaacatgaagtgggaaggggggagcctggcatgtgtcccccatgtggttattgaggaggtgctccctggaggctggtatctgacttgtggggtggctgcctggaagacttgggtcctcacttggcctgaggagatgtacccggcccctcctgtgagggcaatttctccaaaacactgagtgatgcatttggcctttcctaccccaaacagctcccccttttggtcctcagagcctctgctatttaggtttgtgcccttcgccttaggtggccaccatggtgaaatgagggccctctctcacccacttaacaaatattcattaggcacctacttgtctcaggcactgttcaaagctttgaggtagagtagggacaaaacaaatgagaggcgccatctctggtttatccagctttgcatccgtccctagacaggtgtggttccttgtagtccccacctaaaacctaacactgaaggaccttggacacttagacttgaagaaatgcaaaccagtatcccaaaggggaccatagtacctaaccctggtaacggtttttgcaaacaaaagccttgaaggggaacttgtgccttgagagcaggtgaggctggggccacctgtctgggggcattgggctctgaaggccgcttctggttcccccgtcagaatcccctgtcatgctcttaggggtggggtggcccagatccctagagtgacactcatcctggtggtatttgccagcacctatgttatgcctcagacacaccatccagccctgtcccttttcctgagtagaggtagtgcacaggaggaagagctgggctggccccgctccaggccccggagttgctgttgactcttctctgccttgtgcaccccaccctcccccagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacaggtgaggggagaatgtgctggggattgggcaggcgagggctggaagctgggggggtggcactagtgggctggaggcactaatcccttgcccactgtagtgatgatgggctccctgctggccgccactacggaggcccctggcgagtacttcttctcagacggggtgcggctcaagaagtaccggggcatgggctcactggatgccatggagaagagcagcagcagccagaaacgatacttcaggttccctgaccctgggccccacctgggcagatcagcccacaacccttcagggcccgctcatgccaccgacttccccagatggcagccagtccccatatggtggttctggaaactgaggcacagggcttaagtagcagacccaggatctgtccctgggccatctgactcagcccagtgaggggtggcctgggggaccttcctgggcggtatcccgtttttgcccttaagaggtggggtggggtcctctgagcttcaagctgctgggctcagtcttccaccctccacgcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtgagtgctgagactgggggtggctcctgcttcctttctctcgctcttctccacccttggtggccctgatctgctccacctaccttcctcctaggtccatgatgtactcaggagagctcaagtttgagaagcggaccatgtcggcccagattgagggtggtgtccatggcctgcactcgtaagtgtggtggcctccttgctgtcacttggaggcagtgggttgggcaggtggggccagggttctgaggtcaagctgaggttccagggaccccatggaccacctgcagcagggacagatgctgctgcaggatggcccctcaccctctcttcgggggcccagccccctgttccttgtcctttagtccccatgcaagcaggccctcccctcccctcgggcctctcccgagcagggcacaggaggtgtggccagtcactgcacctggactcccagcccttgcttgctcaggaagcttggtggctggtggcaggggctgtggtggcaccaggcagccaggcagaagatgcgggtgtgacccctctggcgggtacaagggcagagagatggacgccagggccagcgctggggcaaccgtgggcgggggcagtgctcgttggcagcagtagttgcaggcatgtgccccaccctggtcaggagccctgtccccaggtatcagcgggcgtctaacctgtgtctctttccgccccacccttccgtagctatacctttctgccgtgtaagtaaccgcgctgcccgggccaagcgtagagtagagcaggggcagtctgggtgggacctgggctggaggtgggggtgggtattgggtgggggtaggagggtgctggggtgtaaccatgagatgtggaccctgggtttgggcccccccggccccctaactccaacaccatgatggaggaaaccagcagtgtcccctcatccagctgaaacacatatccctttctggctgcagagagatgcccgtgacctcaggcctaaggctgccccattttagactggacccagtgaccacaagcagcctaggccactgtgcctgcagggctggggctgggtgcggacatgggcagcagaggttcggctccaggttggagtttgctccatgaggatgggccatgcctgcctgagctgtccctccaccctgggcactgaggacatccactcagatgtggcgatggcccaaaggagcatggccatctctgcacccagcatggttcttcagggaatgctggcctgggggaggacagaggcctagggcctgctccaggccctcctcctgcgccgtacggctgagatctcagggcttctcagctctctgttctctcctacatctgggggccctggggaaagggttttgggaaggagcagggtccacacacccactcttgttccccctcttgccttgtccccacagttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaacgcctccact

SEQ ID NO: 36556 - DNA, 5505 bp, Homo sapiens
agtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggtgggcgcctttcttagaccccgagccggctccctcagccggggcccccgcgggcggggcgacccaggcatagtagggtcgggggtgggggccggggcctggggggcggagcccggggccggagggcgagggccggggtttggggtcgcggccacctggcgccccgcgcagtcggacatggttgggtgcctggccgcgccgggccggttgggcctttgttcggtgtgcgcggagggtgagggaagagtgcccaccgggccgcatttagtacctgggtaggaaccggcgcaacttgggggtcatggggtcctcggcgacgcggagtgaccatcccgtcacttttttctcggccgtggccgaagtaattaggccgttcagtagctggtctcagttccagttctttgaaccagtccaggaaaacccacctggtgccgtcctttttcctttagcaaccgtgacacactttccctgtcgctgacggggtgatgcagcttttactagtttgtggtttagaatggtcaaatggtcattttcatctgttaacacagaggaacacttttctttttcttgtttttgaagtgagtggtataagaataagctttggaggcgaccccccgaaaaatgagcttgatggggattcgaaaatgtttactgggtatggtgatttgggccattataggttagccgcagtcatacaattgagggtattattaaaggagtttcattttaaggccgattaagaacttgagtggactttgggcatcattttctgctagtatacactggccaaattttgggctttgagaaacttttgcgtttgagtcctgaagcaccgtactagaacatggtggctgtaatcgatcagtaaaattagacaaattttaaatgtccctgtccccttccccccaattaaagtagattgggggaaagcgagtagggacatttaaaatttgttgtccttactgtatgcgggacacttcatttagggcgtggcttcagaaaacagtcaacccctttttcttaactaggtagcgactagaacgctgcgttctgggatactaccaagatttaggggagataaagcccatgccatcgttggccaaattgtgaccttgttttctgtctgctgcctttgtaggttagatttctccgaatgctatttaaggaagaaagaacaaaacagtgggtggtttctctttttctccccctccctagtagcatggaagtctgttttcacatgaggactactgaatatttctatgggtagtagtaattgcacccttttgtattcctagctagaaaaatagcatgtttttctggctgtaggtaaatttcaagtagattgtgttaaccttatagtaataataaactatactcgtgtaatatgctggcagtgttcaattatgcgatgttaatcaagagccctattgaggatatccaataatgaacacaatgtaaaccgtaataatcttactaaaacctagaaaattattctgaaacacatctggtgccaagtgtttaggataaggatttaagggtcggtacaagtttcttttagggtataatattgaaaataaatgaagctatttctcagacttctttctgatggcagtaggtcgattttttagttttaatatactcaaatgatttgtgtgtggtaatgtatagaagaaagtttacatatctgaagtgatgtattttaatccaataaaaattagagctggtattaattggccaagccagtaacctttatgaaacaggatagtaatttccacacataattttaaaggggaaactagtaataatatagcactaaggcatgagtctagggtggtttgtattaatatgtaatggtgcagcatgcaatgtaaatttcaaaggctagtatttatttttcccagtgtgcagttatctctatctttctttgatttttcttaattacaaacttaatttcctagtccttttacgtgagggtcttaatgtttctaagggcataacagtgggtgcccccacccccacatcatggaagtctgttttcacaagagaaaaactgttaatttttctgggcagccttacaaattagtaatacttgcactattttgcatttcaactgaaataaacgttagattttggaaataattttccttacatgtagttagtttgaaatctctgtgtggcaaaatacaggtagaatcctcatatggggttgatgctacttaaacatttttcctttataaagaaaccctgatggaggagagcctgtttccgtgtttatggagaagggtggtaacttctatctaaataacttgttggtagatttatgtactctgtaagtttgatagaaaaggtacaaaagcactacatttctctttgagaataatcaacaagatagaacgtagaaataagataacagattatttgaagttagatgttaaagcagcatttcaagaatgtgggtgataactggtaagaattacaaagaatcactatatagttcactggaattgatgaaaactctacaaattatggtagtaagctatgacttggtggccttaaggcaatctaacaacacagtagaatttttctgaggctcactttgccctgcaaataaattggtacttaaccacagactaaaatttaagttgatgacagctgggtgcttatagcgggttagggattcagtttactgtgtctcagaaagtgaccagattgcacctcattcatccccagccagctgactcacagacagatatcttatactggttaaaaatttgggttggtggttatggatggttcagtataaaactgttgctactactgcaggtggtaaacatggagctgagaattgtgactttcataaagtcctttttatggtaattgagtaaaaattcttactcaatttggggaaagagatttgttaggcaaatctttgatagaatgctttgggatactgttaatgatacagatttgtttttgagaatctcgtaaggctacaattatacatattgatggtttaactttgaaggttattccatgcttgcctaagaaactgaacaatgtaagttttggatataggtcagtaaattaactggaaaacggtgaggttgcacacaatgtgtatgtacagttagtggttttctgtttttaattttgaacaaagtacttgaagtataaagcaacttctggagcatacaaggactagtagctactacaaagctagtgttgagtaagaggaaacccaaattaactgtaacttagattttttcgttacataaaagtctaataatctggggcagggataacagctttacagtcaaggactaggctgggtccttacctcttgttgctttaccgttctcaatttacagttgcttctatggtcctagattcctgctctggctccctgatcatattaatgtgcattcaacaagaaggagaaaaagagttcagcatgttctttccctttgagaacacttttcataataagttacacattttcttatatcttgttggcttatgatttggaggctggtaaccatatgttcaacttatattttggggttctcttcctgaagaagattaaggcaactggtaagcattctgtgataagagaaaaagattaatcctatggaaaatgctttctgcttttggattgtgcactcttagctccctaatttgaacataggccatcatatcagaattaaaggtagtagattgcagttctcaatattaaagcaacagagttccttaaggtacatgtataaagcgacagttgtagaaaaggcactggactaacacttggctgtatcttgtaacaggcatgttatgttacccagagaactttccaaacaagtacctaaaactcatctgatgtctgaagaggagtggaggagacttggtgtccaacagagtctaggctgggttcattacatgattcatgagccaggtaagctatgctatgttatagtaaagcagtaattgttgaaatattggtggttatggttgtcaaaattttaaaaatatcattgacatcaaatgatatctgaaagtaactgttctgataagtttttttttttaatgactaatttcttgactctggagagagttccaattttatggtaaataaaataccacagcagtgaaagtaacacattattctacttggaaaataatgtaagaagtaaaaaaaaaaaaaaaaaaatgtattttaaaatctgtatcattgttaacagtatcccaaagcattttatcataagtatatcctaagacaagtgttcttatctatgtgtggaaattgatttaatttaaagtgattcttcagccctctgaaaggatatataccacatgaagtttaaatgaggtaatagcatatgaactcaactgtgcttatgggtaccttatgctattatgtggtattaaccaaaagtttttcaggtgttaaatagtaaactctactaaaactttgtgggttttctagactaaaacagtgtgggttaaattttatatttggattatcagtaaatctaacagcatttataatgctttgaacaaaatttgaagacatactatagaagctgaagtaggtggaattaaaactatcttctactctgctgttaaagaaaagcattgcatcgaaaactctaaaaggactcatcactttcttgggattgagatacgtaatcctattagaattcagtccagataatacaaaagcaactgaagaacttaagtgtagatttctgtgccccacctattgaaacagaatctatggggatgagcattagtatgagatcctgtaggtgatttgaaggaggtgtttttccctataaagaggtaatctttttacttttaatctatttactgtagacagtaactgtgaaaaaaaaatcattttggatacctcaaaccaattaatagtggacttagtttattttattctggcttagttgagaatacttttgaatttctgttgagtatatgaaaatcatattaaaatgattcaaaacattttctttccacagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcattt

SEQ ID NO: 36557 - DNA, 28888 bp, Homo sapiens
acttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggtaaggaaagcccttcactcagggaagaacagaaggggagattttctttgatggttgtttggaagtcaggcttaaacaattgtgtctgtgtgtgcgcatgcacaaacacttttaccttatctttattttcttctttttatttgaatgtatagggttgtgtgtatttctgtgtaaatttggggttttcctcctcttagtctttcacttttgtggtgattaccagtcccatttttagagccagggctgcaacttgaaggttttgctaaaaccctcaccgaagtgtctatgatcagcattttaactattaattaatgtggccaggcaaggggtggaaggtgagaagactagaaagggaacatgatatacacatttactcagatactgggcttttctaacatctgcagtgcaattgaagttaccagtcatctgcagtctaaaaagaaagtgattttgggaggtgcgtagaaaaaatcatcttattatttttcctctatattacttttttctttttttctcctgaagaaacttttttttttggtgataccttctttttctctagcacgtataattttggaagcatttttcatatgcagtgtatacttcagaaagagagagagagagaggaaaattgtcctgttcagcgtttgcatttccattattcctgctattagttaaaaacaacaacaacaacaaaaaacaagcaggatacctagatctggaaaagggagaattgtgtagagctgtcttcctaaagttctgagttagggctgcctcagaccactttcataactatctccagtggctttgtgttttatatttattaagatagagaaaaaaagagtaattactaagggcagctgctgtagctttatggtgattactgaacattgacatgctgtcacgtttttggaactttgagtatttaatcactttgggatattctattttcccccatcttgagtgtggacagatgctggtgatgtagccttctgggcacagagcaagcctccccctcagcctctgcaccagaaaggctcagcttcacacactccaagtatgttttctacaagaactacactttgtggctttctgacccaaacatttttatactaaattacacacaacaaagttgtagctcagagagggaacaaatggcttatttaggccaccattttcttgagccattatgatttcacacagggctcccttggccctgtaaattggcaaggattccattattcaacccgcatacatgtacagagaccctgctctggcccagatagtattctgggtacaggcggatagagcaggaaacaaaacagctacagtgatggacaggtcagcctgcagcaatgcctgcagtctctgcaaaggtagctgtatgggtgggcaggtggctagcacttattcagctctggaaggatctcccctctggcctctcccctgacacccatcaataaaactgaggagcatcggtggacaggggaccttgtgccccctccctgcctgtgcagttggggctgaacccagctacgaagtttgagctcactctctccagctccctctcaattcagagctgaactgtgggaagcttcagagctctctgtttcaaggacaggttctcctcacctctcctaatggaggtgcaccagggaactggccctgctctgcccagggctttctcctggactttgccatcatggtctagcaaaccctgttcagattgaggtgagtggtgagatttcgaattctttttgacagataggattaagtcttcttctgtgggacaagtgggaggtagaggtaagattaaagatggccaaatgtctgagtcctgacagccacaatatggagatctagactttttacagaccacagggcacaggggcctcactaacagagttcccggaagtgatgagtgtgctgggggcttcctggttgaagagacactagaatggaccagctgggagctaattttttgggctggagtgtgatggcctgcacatcactgcctctgtccctccattgtcacagctgccccttaggagccagctgaggcaatttgtggtcagagtgactttgcacagttgtcctgcctgtgttcaggaagggagtttctgtggtccctttgaaaccacagaagagcccctcgtatagctctcaatggagggggcaaaacattcaaataactcaggagataacacaactatttgtttttaactgtgagtttttaggcaatcacaaagatccagatgtatgtccaagcctctctttgcaattctaattaacctcaatgttgcaaccatagacctaccttacagagttcaaaaaaatatgcaaaaaccctgcctttcttcttcctcataccccaaaatgccattctgaacatttcctgttagttaaaaaaagatttccatggtgttaccaggcactgtacacagtctgtgtcccaagacaaggaggtacagttccacatgcgcccatgactgggttgggctctgcactctctctatactttgagagcctgattttctgtgattgggcagagctggcccacctggtgcaatgtcctcctctgcctttcaaacatgttttagtcatcaagatcttcaaatttgtaaccctttccagcttgatccagcagaatgcagatttggaaaaacagaacgagtttaaaatacatgattctaagaaacctggaccagaactatcaaaacttggtttcccagagaatatagcaaatgggctcattggccaatactatgacattggcttttgagaaaagaaaggctttattgcaaggctggccagcaaggagacaggagttgggctcaaatctgtctccccagtttggggcttagggcaagttttaattacacagacgcatttcttatgagtagcaggcagagagcctccaacttcttctgcctaggtaccagcagcttagacatgatgcaaacctgggaagcacatactgtatttggagaaagtgattgggaagaaatgtgagctgaggggaggggctcagtgcccctgagctacacttagtgatggcagaggaaggatgtcctcccgcaggaggctgttccacatctgctctggttgtagggggagctggcaggcattagcagcggcctctttcccccaagagaggcagcctcctccaagttttggcgacattatggccctgcaatcataagggtttgtgagcatagtgctaaggagggaaatggagctgctgttactagttccaccccaacacacacacacacactcacaagaaacctcacaagcaccgtattggaagactttgccatccaacctgggatttgacaggctctagaagcagaatcatagactcatgaagttcccccaaagcaggaatcttccttacagtaacccccaaccacccccctccaccgcctccaccggctgcttcttcctgaacactgcagtgtttggaaaactcacaaacttccaagcttgcctttcctattgttgcatggattgaaagcttgcgttgtgtgaagaatggcgcttcctgctgtgcttagttttatctcatataatctttgcaccatttaatccttgcactcacccactcatgcaactgcctttgcagagactggaggggccgctgtaggctgacctttccttcactgtacctattttgttccctgctttattcccctgcacccaggacactgcctggcacaaagacaggtctttataagtgtatgcaagtgaataaagatatatatattattattgttatttttgagacagtttcactctgtcacccaggctggagtgcagtagcgcaatctcagctgactgcaacctctgcctcccaggctcaagtgattctcatgtctcagcctcctgagtagctaggactacaagcatgtgccaccacgcccagctaatttttgtatttttagtaaggacagggtttcaccatgttggccaggttggcctccaactcctgacctcaagtcatcctcctgcctcgacctcccaaagtgctgggattacaggcatgaaaccagcctagaaatacatactattatttattcttgttttacagataagcaaagtgagtcatggagaatttggttgaaagtcccaaggtcaggagtcgtgaagctgggattaaaacctaatcatctgactttagagagtagacacttgctccatgcatattgcctccaattcattcattcaagcactccctgctcaagaagttctttcttatgttgagctgaaatctgcagccctatgcgttttacccagcagtcctggtgctgttccctaaaatcacttagactgtgcctgctctttctgtgtttacagtgtcagctgtaatatccccctcttcggcctaacgtttctgaagtcccttgccactgggtctcctctcctcttcctgtgttctttctaagaacacctatgcagataggtgtcttctgtacagggaagctgttcctgagatccgggcatcgactctgttagaataatctacgtatgagttatttttttgagaactatgtgtcattgctgactcatattaactctgtggttaactaaaatctcaagatctctttatgtttgttgagaaacttatttaacttctctggccctccgtttccttcactgagcagtggagtgattgataacctccacctgtggttgctgaaggtcttgcacaagatgatatagttaaagtagctagcagtgcccacgtacggcggatgcctcacaacggtttgcagccatctctctatctgtgtctttgtctctctctcacactggttttggcttactgttagcagctagccgagataagtgtgtttatggtctttgcatgtattgtttctgtagcatactggaggattacaagaggttggggagtgagggggcggtgaggagtagacaaaggcagccaactcttccaagtttagcttagaaggaaggagcggtaaaccctagttgaatgttggactgaagcaggtttgtttttgttttgtttaaaggatagggaagatctgtgcgtgtttccaggataaagaaaaggagagaatatgatattaaagattctggaagtgggagaaggagcaatgaaatacagacttgaagtcagtggcatggacagggtcaagatcacagttagaggatgcagccttagagaaaaggaaggggctcggttctctgagcaaggagggaaagaagagaggcagatgcagagaagtacggcacatcgtgctgctggttgtagaaataacctctgacttttaataaagtcatccctcggtatccctgggggattagttctatgacctccctcggatgccaaaattcgtggatgctcaagtccctgatataaaatggcatagtatttgcatttaacctacacacatcctccatatcctttttttttttttttttttttttttttttttttttgtgagatggagtcttgctctgtcgccctggctggagtacagtggctcgatcttggctcactgcaagctccgcctcccgggttcatgccattctcctgcctcagcctacaggtgcctgccaccacgcccagctaattttttttttgtattttttagtagagacagggtttcaccatgttagccaggatggtctcgacacatcctccatatactttaagtaacctctagataatctctagattacttgttttgtcttttttttttttttttctttttgagatggagtttcactcttgtcacccaggctggagtgcaatggtgcaatctcagttcactgcaacctccgcctcctgggttcaagcaattctcctgtctcagcctcctgtgtagctaggattacaggcccctccccacccccaccccccaacaactggctaatttttgtatttttagtagagatggggtgtcaccacgttggcctggctggtcttgaactcctgacctcaggtgatctacccgcttcagcctcccaaagtgatgggattataggcatgagccactgtgtgtggcctagattacttataatacctgatagaatgtaaatgctatgtaaacagttgttatactgtattgttaaaagacagtaacaagaaaaaaaatctgtacatgttcagtccagacaaatggttttctgttttttttttttttttttaatatttttggtcagtggttggttgactccaggaatgcagaacccgcagatatagaaggttgattatgcgttcagaggcagggaataccatcttgggttccagaaagaaaatgatcagcattttctgtcatactctggtaaaaacagatcttttgaatggacaggtgtattaaaccctgtggagctggctgggcctggcggctcacgcctgtaatcccagcactttgggaggctgaggcaggtggatcacgaggtcaggagttcgagaccagcctggccaatatggtgaaaccccaactctactaaaaatacaaaaattagccgggcgtgatgacgcatgcctgtagtcccagctactcgggaggctgaggcagaagaatcgcttgaaccctggaggtggaggttgcagtgagccgagatcacgccactgcactccagcctgggcaacagagtgagactccgtatctaaaaaaaaaaaacaaaaacctgtggagctgatgaaatcctgcagggagcttcacggtgacagcaagaggagaaacacatccccatatgccccgcagagtttgaagtcccggctgcacctctccccagcagcaggttgactctggaaagttgcagcgttcttacctacagagtgggaacagtactacccattgcacagagtgggtgcaaagctctgtgacggaatacatggcaagtgcccaccacattgcctgggatgaggtgggcccttcctttacgtaagagagccctacagatacactcaaagtgggcacattcctacagaaggagtgttatttgtgtagaaaagaaaaacatgaaaggcttttattcctatacacaataaagcacccctttaatgtctttttgaggaggataatatgaaattgatgaaaaggaaccctgtggttggatccctgacaatcacatgtatcccttttttcactcttgaaaaaggagtaaaggaataaaatagaaggggagagggggcagagagaccttcaccgccccccccccaccccccatcatccaatctatagtcaaaccctccagactgtgtctccttggcatctctgacacccccaccgccaccaccccagtcaattcctatcttatccccctatcctggatctgattctgctaagttcctgccacactaaagacagggtggctttctgatgacaacattcctctgcttaaacctgtcagtaattccttgttgctctcagacggaactaagttctgaatttcttcacacggctctcagcaaggtcacagtcaccctgctaggccccaggggcaaatctcaatggtcatcttcttgaagacctggctcagttatttctttctcattgaggctcacgaccccaccttcttgcatgcctcaaacggccccttaccatgctcttctttcgcccatagctcagcacaccatatcattttaatttatgtattttgcttaatgtggatgatctgtctcctcctctgctgtcctcaccagagcatcagttcctcaaaccaaggctctttgttttgttcttggatgcaagctaaatgtctggcatgtggcaaatggtcatagatacatgtcattgaaagaatgattcatcacctccctctttggccttgtctgtggttctaccaaatcccattccctccccagtgccctccattccccctccttggctgaacattctgaaccacagacagttctttaccctgaacctttgcatattttgttctcttagcttagagcggcccctctccctccgtctgcttggctaatttctacttgttcttcagattttatcttagatgtcattccctcaaggaatccttctgtgactcaacatggaattaagttgcctcctttgaccctgaaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacagtgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaaccctgatgttgctaataagtgggggcatgggcaggggggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagccttcaactcacccaccccttgctcccctgcgggtggaagtctggaggtgacaccactgcattttctaacacgggggctccttgagcaactagaacaagaacagaaagaatggggacattagcaggtgctttccccctctctcattcttttctttgaataaaaaggttgtttgaaaacacctgagcggctcctaaagatgggtgcaatctattcgggatgcaaatccgaatgaatgttattcaaatgctcctctcttctttatgcagagtgtatttcaaggctcagccagtggcaggcatgctggggactatggactacggactaggggcctgtcacagaggaaggcctcatgctagagagctaagggaggagctggccttcagttccatcccaggagcaactttgatgttcccagagatccttccaaagggggagtcatggtcacccaagaaaaatgtattcagaatgccaagaatggtgcaaactcaggacaaagattcacactgcagggttggagtccctgggcttgctgctggcaccatgggagggagggtccccttcaggggtaccgttggtttcctgtgaattaaactggcttcaagggatctcgactgaacaggcctatatcacactcactgatatactctctcttcagtccttctcctcatctaggtatttttaattgtttcagtgaggtgtaggcatgaggggattggagggggcatctcctccattgcagtttttcattggctgctttgctccctcagctccgaaatcgctgggccactctcgaacgcattagtacggtagtcacaggttgattgcctggccccttgccctctgtgggcattttccctttcagacagcccctgagtactcacagtgctgctacagtgggccacctagatctccctctttctccatgctcccacgtgctctgggctccactcccttctcccaagcacttctgtccagggctattccagcagtctgacctcaaggaaatcctttgctaaactgattatagagaggtttctattttaacatttaggtcttccatgtattaattctcagaatcaatttaagatgtttaaaggtgtgatttaagacattttaaaaccatttggaggagagtacagaaattatgtcacttgctgtcagcctctttgcaccatctgcagagaaagatactagagtcccgccttggacacatccacatgcaagaggtgcaaagaaggtgtctttgatgaggcaaggtcaaaacttctccccagacgaaatccaaagaaagcattcctactatgctatatcagtttggaaagaaaaacttctgccaggtgactgcattctcactggtcacattgtgttcctatggactcctcagctcaaccaatttggagaagttatggtgcaatttcaccatatctggttagaagttaagtttccaatttgctggcaatgaagaagaaatggagcaggccaggctgtgtagtttctgccacgtgcccccgggagtgaacagctctgtttgtaagaagccatggtgcttagacctgggctcgctagttgccagcctccaaattgcagaagtgccctttggttggtggctatgctgtgtcacttgggaaggtcgtttggaagttccacagtcgttgtggggtgccagagattaaaaagcgtaagaggagagtggaaagtgattgttgctgcttgggcatccccaccgtgtgggtgctgcagcccagctctcaaaacccatgggtctgtacactcaacctccatgagagggaaggagaaggatgagggaggggagagatagccatggaaaggtaggaactaagcaggcagggtggagagttttctgtaagacaaaaactgtctggacactgctgcggttctgttacaaagaccacttcctccctgggccagcaacatatctgtgtgcctgtctgggttgtaaaaagggtcaaagatcaatgcagcaggcagctacatgctggcaaaagccagaggcagctggtctgtttgcctgtgccaggaaaccactgggaatggggttgtgtgttattctaggagaaagtcgtcccagcagcagcttctccaggggcatccaagagcactgaaaagggttgcaagatgacccatgaggctgcaggaagaaaagaacatgcatttaatcttgctatctgaaaagtaagacatgaagctttcctcatttttaatatacacatggacagtagtatgtgtatatagtttatatgcaaatatacttgttataaggttgcatgctcaaaatttttggttcatggggtgtgggatcataaatgtttagggaccatggctatcaaggaaaaacagcatgaaggataaatgatactggtggattaaaaagacagatgcatgtatttttagcataaaacacaactgctgactgatacagatagctcaagattctggggcagctgctgaacagatacactagccagtgtggctcatcggctcagacttggccttaattaatgggctgtccctccacccatctcccatgagggcagagctgagccagggtttgagagctaaaaggaattggacctggactctgttcacgtgtatattttaattctaattaattcattcttttgaaagacagagtcacactctgttgcctaggctggagtgcagtggcacgatcttggctcactgcaacctcggcctcccaggttcaagttattctcctgcttcagcctcctgagtagctgggattataggcacatgcccccatgcctgactaatttttgtatttttagtagagacggggtttcaccatgtcaggctggtcttgaactcctgacctcaggttatccacccgccttggcccctcaaagtgttggaattacaggtgtgagccaccgtgcctggcctgttcacatgtataaaacacagtttaatgtcctattcccagccaatgagcatggctagagcagccttggtcaaagtttggtttttggagaaaaatccttgttagctgacctaagattcctctttgtgagtgtaagtaagcacaggttgcagagaggagaagggtctctggagaggtgtaattttctaaatggattacaagttcatggacttttaacaggtgttacaggggataacaagttctttatagacagacttttgaggacgtttaagggtattctgattcttggttttctaagaggggaatgtattatttaactacagacacccctaccgcccactttttgcagagtgtatcaaaacatgtttttggaataccaccctcatgtcgcttctccctgcatctcttatctcttggtgtccattctagactcactttctttctgttttttatttttatttttttttgagatggagcttcactctgtcaccaggctggagtgcagtggtgcaatcttggctgactgcaacctctgccttccgggcttaagcaatttttgtgcctcagcctcctgagtagctgggattacagcatgcaccaccatgtccggctaatttttgtatctttagtagagacagggtttcactatgctggccagcctggtctcaaactccttacctcaggtgatctgcccgcctcggcctcccagagtgctcagattacagacgtgagccactggtgcctggcctagactcactttcaagtggcatagacttgtaaaattatttaaaggtgataggtctacaatgatcctgtcaattagtattgacactattattaataaactgttattaattatatttacttactttaaattaatccaaactaattaacggaacactaaagagtttctatgttttattcccagaggtggagaaaaatgaaagggaatatagcaacgaattcttttctccataaaaacatgaatagtgcagcacatcaagttgaacataccacagcaaattgttgcaagatctgctgagtagctcctatttagacctcaaggaatgagactcaaaatgggttcatcagttctgttttgcagaaaaaatagcgcaaaatttctcaaaagaaaatccagaataataataatttgtcaataggaaagacatttccactgggggttaagaaggaagacattggaacaatgatagccaccacttattgaatgcttactgtgagccaggtggcacttcaccttgtttcattctcacaacagtctagggaagtaattactaatgtctccatccacctcttgtagatgagcaaactgaggctcattgaggctaggaaatgcacccacactcacatagcccataagaggcagccatggcattgggcccagaccatgtgaacttcaaagactacacgagcagccactgggcagctgtcatggctaaagccacttgaattcagcccagcagcaaccccctctccaggaggggcacataagcttgcagctttgggtagaagctgcacttgaagtcctggatggcgagagggactggcttgagccagagccaggaacaaggctctgagaatattctggaaatccacaggaggaacccattttcttacagctgggagaatttcattcaactccaggctgaccatgttttattaggaacgaaggtgacttgaactaatagtcaggaatggttgaatacggacccaatgtcaaatcactaggcagttcacatttctaatgagcaaatcccttagacaattaagaatttttttccttttgcataacccagacaaaatcgctacttaaaaacaaaccaaagacccgaaacatgagaaagagaaggaagcaggggaaatctttggtactaataagtttttaaacaataagagcaccagatattttaccccatcagacacagaatgttattcgaataaccaaaaaaggaattttttctctaagtttcttgaactggaaaatgaatcatattttctcagtcctgaggctgcaattttgtgcctctagtaacatataagaatagatgtgatgccagtgcccagtagctgctgcaattgttacttggggacctgtttattcactaagcacttcaccccagtgataaatttgtaggggcctcctgccctttggagctcctaccgtgtccattagatcagtggaaattctgggattcagagcactttgcaaggtcagcaggggtctgctctttctgtcctgttcctggtttttggttgtgcctggattccagggtaggtttctcatctgttaccttcatagacttctccagaaaaggatcttttgaccatcagaggaccacgaagattccattggtgaggcgcagataacctgatctctctgggttctctgcagggcacagatgaagggctggccattcccaagttctcagtggtaccactgaggcatgagaccctaatggtttgcatgagcagtttgaaaattgcatctttgtttttacctatataatcacatgaaacccgtggttctcaaacgtcagcaggcatcagcatcacatggagggcttgttaaaacagatttctgggccccaacacagagttttaaattctgaaggcctgaggtgggtgtgaacatttgcatttctaacatgttctcgatgctgctgccgcctctggtcccgagagcatgcctggagaactgccaccttcgaccatggactgtgagaattcacatggacctcagaattataatcagtctctcagttttacagataaggaaactaaatccagagagattgttttgccaatggtgaacagctggttaaagtcaggatggagactttaatcctagtcaagtgacctttcctctgtatttatttccctccctttttatgcctctcaagtctagttacactgtttttcatggatgggcatatttattgtcctgatctggactgcagacttctcaggaggacacctatgatttaatttagtatagttgaagagttaacagacatggctttggagacagactgattatggtgtgaatcccggctttgccactccctagctggatgaccctgagcaagttattcagcttctccaagcctgagttccttattggaaacatgagagcaattgtgataggcagaataatggccccctcaccaatcatgcccacatcctaatcctaggaacctgtgaatatgttatgttacatggcaaggggaaattcaggcagctagccagttggccttaaaataaagagattatcctggatgatctgggtaggacctgatgtaaccacaagggtctttttaatgtggaagaaggaggcataagagtagatgtcagagtcattcaaaataagaaagatttgatgggccatccctgactttcaggttggaaggaggttctgagtcaaggaatacaggtgacctctagaagctggagaaggcaaggaaatggtttctcccctagaagttccagaaggattgcagccctgctaatatcttgactttatagccctttgagatttattttggatttctgacatcctgaaccatagtaaaagggtgttttttgtttttttgagacagagtcttgctctgttgcctgggctggagtgcagtggtgtgatcttggctcgctgcaacctccgcctcccaggttcaagtgattctcctgcctcagcctcctgagtagctgggattacaggtgcttgccaccacacctggctattttttgtgtttttagtagagacagggtttcaccatgttggccaggctggtcttgaactcctgaccttgtgatctgcctgcctcagcctcccaaattgctgggattacaaggcgtgttgttttaagccactcagtttgtggccacttgttacagcagcaagaggaaactcatacagttatcatgtgaactcacaggaatatggtgagttaaaaagagaggaagggtgcaaaacatccacggtagagtgagaactctccagggagtgaggactgtgcccagcatacagtgatcaccctcttagtaagctaagtttctgagcaccagcttttttgagttgactttgttgtctttaacatttgaagatcacccttctttgctcagcctggcttgcagacctgggctgatttgtggatctgatagaaaagtttccttagttgggctcttctccccgaccacccccatgccagtgtggccacatcctctgtctgcattgctcactcttcaattccaagaagcgcaggggcaccgccaggaacaggaaccctgccagaggaatacatcaagaaaccaagtctcccttacgcatcaccgtaggaacagagttaatggattatgaacatgtgtttgctttataccattgtttgtttcccaggtggcagctggctgccccatcttattgggtagatgtaagtggaattacgaatgggatttatgtttcatgcacgatggtgattattaacttcaactttcaggtaattttcagaccacattgcactaacttggtctctgattgtttttctccttgtttgtttattctgcagccagaactgtgtagatgcgtaccccactttcctcgctgtgctctggtctgcggggctactttgcagccaaggtaactcagacttccctttgttcattctccttctataaagtgcatctcaaggaggttcaaagggcaggctttttgttgaaaggactttgcctgacctctggctcccatctgtgaagccctggagaggtgagagccctcgggaggccgtgtttcaggcatgctctgcacccgtgcagagcgcgtgtgataatgcattgctaatgcttgctccctggtggctggctgagagctgctgtgctgacaagggtggtttaaggctaaatgtgactcagaatccttaagcagtgttagttcagatacaagggcattataaatgagagtgcctgagggatctattttgggaccgctgtcacttggctcttctgctaataagcttccagtgtggtggccctccttcaggcatgtttccactgagccacgggctggatgccacatccccggccttcccacagttatcagcagcccacaggcttgacttgagcaagttggaaagacaaatcaacttccagagttgatttaacattgagtggaaatcagtcatacttttggtcccctttcggggccacgcctggcactgtgcctggtggcagatcggcatgaactggccagcttctgtggccctggagggcacaggcagaaaggccacactcagtcccatgatgaactgtttaagacttattgttgtctccccgctctgtaaagtagatagagtggattttatgtcccttattacctttcaggatactttgactcagggagataaagtaacttgggtacagctactcagctggtgaagaacacaggcagaatgagtgcctgggtcttttgacttaaaattctggatttttcacaaagatcctcttactttattcatttacataataaatatatattgaagagctactctgtgccaagccctgtgcctagatatacagtgataaataaagagtagcttctagaggtcacctggcggtgaggcacaggccagctggcaagatggaccacagaagtcagtgaatgaagacaatgacaagggtgggaagcgccatatgggaagagaaccaagttcagtgatagagagcagaggtgaggcggcagcagaaaccacttaagggacaccacgtggcactccttctgtgctgagaaggctgtcagtaagctcaccatttatttcctattttctctcctgagttaaataggaaacatgtctcgcattacttgaaaaatcaagtcaaactatgctcttactaggagttatggttctttttatgtcttagatgatgcttgatctagatgaatgcggacttgctgtagctagataaatacaatgggagtttgaaggtgtttcgtagccctggaaataggtatttcctgtcaaaacaagctttgtcattgccagcagacaaaagcatcagtaaccttggttgataatcgtcatttcttaggaataaagtagactgtagaattttttttagcagaaaggaaacccaaagataattctagtgcaaatccctcactttatagagcagaagctcaagtcccagaggaacaagtggcttgaacgaacatcagaattttaggggctggatttgtaccctcctggtgccagcagcccacttccctgcaggaggcactcaccttccttgcacaggggtatgagtgtggccattttccacccataatctctgttagctcatgttcaattgggttcccattgaaagaaaaatggaccagtaagttggagcagaatcattcagatggtataacataaggaaaaactttgcccaaggcaaatcgtgattgtgacagctttgtgatttttagagaatagcatgggccaggcacagtggctcatgcctgtaatcccagcactttgggaggccgaggcaggcaggtcacttgaggttgggagttcgacaacagcctgaccaacatggagaaaccctgtctctactaaaaatacaaaattagctgggcgtggtggtgcatgcctgtaatgccagctactcgggaggctgaggcaggagaatcacttaaacctgggaggcggaggttgcggtgaaccaagatagcaccattgcactccagcctgggcaacaagagtgaaactccgtctcaaaaagagttcacagtttctcttttgctttgattttcttatctgccggataacaatagtattttggaaggcaggaggaattgtggaaagaaatgggttttggggagtggctgattggaggcaaatccaaggacactcattgctggtgtgtgactccaggcagttactcagcttttccaagcctcagtttccttattgtaaaacaggaccatggtctagctagtagcattcctatggtgagtgaaataatatgtataaagctcctgacacagtgcttggcatatatcagattgagccatgtaaaactgccaatatctggctatttatgacctacaaaaatagcatttcatatgattccacctaacatctgaagcgcaataaatgttattattgataatgcaggtggtggtgataaagttttgaaatcagaaagacctggcttcaaattccacgccttcactggcctgacttattttcattcatttgacaaatattattttgaacacccctatgtgccaggcactatgccaggctcagagatgatctaggaaaaagacagatgtcctcatctgtcttaggctcttgtggcctaagcctaaatttcctcgtctgtcaaatggtgacagtaacacactccttaccagagagctgggaggattggagactcaagttcccaaaacgccaggagcactgcggcaggtgaaaagtattccctcaatggcggaagtgtttaaattgcttttatatctgtagctctagataacactagttccagcttagttaactcccagctccaagccttcaggacttcatagagttattggggtgctgctcttggcagtttcccaaaaagctagaatgcagagggaatctccttcccaaaaagctagaatgcagagggaatctccttcccaaaaggctagaacgcagagggaatctccttcccaaaaggctagaacgcagagggaatctccttcccaaaaggctagaatgcagagggaatgtccttctcttctaaatggtagctgttagttcaagaaaggttaaacattgtgctgtggggaggctcaggggtgaagggtgtacttttaagagaaccagtttcagagctgggtttggggtttaagccctaccctctgcccccttttacgagctgacagccttatgcaagcctggttgaccacctgaacccacgtttccacatctggaaatagaaatgtgggtactagttatgttgaaaggactcaggttagatgatagatatgcaaataccttggaaaccaggagtgtccagtcttttgggttccctgagccacactggaagaagagttgtcttgggccacacatagaatacactaaccctatcaatagctgatgagctaaagaaaaaacgttgcaaaaaaaatctcatatttttaagaaagtttatgaatttgtgttgggctgtattcaaagccatcctgggccacgtgcgacccgcaggctccgggttggacaagtttgttgtaaacaatgccatgatgccggcataaggtcgttaccagtattaggaaggttctcaggtttcctctagcccttgggctcttttcctgaagtgcgtgtgtcttctgctagattttgtgaccaatgttgattgcctaattgggctaacagcatgttttggtggctacgaaactgacacaggtgttttcatttctccacttagttcctgctgcgtttgctggactgatgtacttgtttgtgaggcaaaagtactttgtcggttacctaggagagagaacgcagaggtaggtaactgggactactaaagaactgtggagcgattcctgatttttgagcaggaagagtgacaattcaaaacagtatttgactagattcacggctccgtagcatccccttgggtgggagggggaaggctgactaggacctctgattcttctttccctgagctttgaaggctctgaaaatacagctggggggacttgcccagttttcttattaagcaattcctccgcatggtgctggctttcaaagggtgcttcagtgctgtttgctgcacgtgccttgcagccccacaccctgcactcccgccctgcagagtctggcgctggaatgacattttaggtctgggttcccaggcctcctgagagtgaaatgtttcattgtttgtctagagaaatgagaactaaagcttgcaccttgtgataagttgtcctgaggaacatatctttcagggaccagaagaaagaatgttgggaaaataagatgcagtaagatgcagacatgacagcagggtgcagcggctcacgcctataatcccagcactttgggaggctgaggtgggtggatcacctgaggtcaggagtttgagaccagcctggccaacatggtgaaaccccgtctctactaaaaaatatacaaaacattagccaggcatggtggtgggcgcctgtaatcccagctactccataggctgaggctggagaatcgcttgaacccaggaggcagaggttgcagtgagccgagattgcgccactgcactccagcctgggcaacaaaagcaaaactccatctcaaaaaaaaaaaaaaaaaaaaaaaaaaagatgcagacacgagactgtgaaactgactagcatcaccattgcattgtttatagatgttgccagacagaaagccccaaagcagcacagtaccttcctgacatctggactaggaaatctagattttagtaaaatacatgctaatacttacagaagaaatgtcggcgttagagtatgccgtcagttccttagagattgcaattcctaatgcactagtatggtttcaggtgccaggaacacgttctgtgaggctgctgccccaggtgctgaccccagccttccacaccattttccttccttgtgttcacagccgctctgtcttttacaatagcacccctctctagtggctaatgggctctatgattagatagcatccttcagtagtgataaaggcagtgacatcctagggaggtcagcgggtgaaagcgctatatctggaaaacctgagagcctgtgaagctcaaggacttgacggggttagaccgtgagccgggctgcagctggaaaaagaatgactgttctttcagcagatccttccctgtgccatctctttcttcattcctctctagtggcattcttatttatcctctaaaaccacaattccattatctctcctattcttatcaacactgccctaaatgatattctttattctcttttgccctggaaaacctctatcatgccttttcccatgtgattacctcgttaagagtgggggtggaatgtctagcaatgaaataagagggtcttctcttttgcctggctccctatgcagccctatcttaccccctgcaaagtcccagggatgtggctcagtcactgctcctctcttcatctgtcaccacttgcttgagatcctacagctgctttaattccgagaccatctgcagaacatgacaaaatttgtccacctacccacatgtccttttaactttaaaggctttactaactgattcctattagggaatgaacagaggtggcaaaaataaacaataggagattgatttacaagaaatctttaaaatagtagatttcttcggacctcattgaaatataaatggcctgccttcttgtgtccctccctggtctccctctttaggtgataagaagaagatcctgccagccccataacccgccatctgcgcgggttctagacccccttctcctcccctctggccgtggtaggcattactgatgaatcatggtgctctttcttccagagaccaaacctggcctcggaatccttcttaacacagatactgcttaacacaaccactctgagcagctgtcataagtagaagtaatagatactagaagaaatgtctaagcctaatctagaccaaaatacggcctgatatagatgcaagccagaggggctttatggttaaatgcaaggagattttcaaccctgccgtctagaagctacttgctgagatcttcttcagttgggcccatctcctccccaggcctctcttctgttcctgggctatgtcacacttggactctgcagacacctaatgctcttgggacctgctttagttcttgacctcaccaaccgaggaggaattgctagatgagatccttcccccggaatttctctcttgaaccccagatggtccgttgcccctttccagaagttgctccagccctgtccgcttaggaagttcagtgtcatccttgatccagtgggtagggaagacattccataatgaatgccccagtctgagcttcttccttcaggcttcaggctgccctgcgaggattttgcagctccctttttaatgccctctagaagtttctggctcttattttcagcccttcatcctactctctctgaccccttcctctatcctgtttagttcacctgtagcagttactacccagcagtgaaggatgaatcttggtttcgtttcttttctcttcttttcttttttctcttctcttttccccttcccttcccttccctcccttcacatcacctcatctcacctcaccttacatagtcttgctctgtcacccaaactggagtgcagtggcctgatcttggctcactgcaacctccacctcttcccaggttcaagtgattcttatacctcagcctcttgagtagctgagactacaggtgtgcactaccacacccagctaattttttgtatttttagtagagatagggtttagctatgttggccaggctggtctcgaactgctgaactcaagcaatctgccatccccggcctcccaaagtactgggagtataggcataagccacccatgatgcccagcctgaatcttggtttcttccccattcatttaagctattacctgggcctgaactcaatggcacctggcaccaactggcaactgactcttggtcttttattacctaccttccctagcaggcactgggttgctccctcttcctatcccatggagtcctgtcctctgttggggctcctactgatcctcttggcaatatgaagttctcagctcaatggtgggtgggcaatgactgccaactcttgaggccaatgaactcaggttaccccactcctcctcctcctgagttgctcactcactcctcattcactcaacattgattcagtagatatttgctacctgctctgtgccaggtaccaggtcagttgctgaaggagtaacagtgaacatgacggagtctttgtccccaaggagacccaaggtgtctcctagagccaggggcacattgcaagaccaaatatattcaacttaccaaaataatcatagacctagttctcaaaaagcaagaagactgattcctcgttgtcatttctcctcctcagcatcaatgttttagagtctgtgggcccctccaagtgtggagtatggtgttacttcaccagagtttgaggagaaacattcttcttttggaaggccggggagcatagatggatatcaaggctgctgtttctaaaagcgaaacccaccaaacaacagtattagaatcatctgtggtgcttattaaagatacagattcctgggccccatcccagacttatgaatcagaatctctgccagaggaagcctgagaatttgcattctcagatgattctgcattctcagataacacattctttaggtgattcttacacacactggagtttgggaatcgctgaaggctgttcacttctcttttctgagaaatgattcattcatttcagaaatatttgcagaggtccttatttattggagatttgtgggtgggcagaggagaaatatcttgtcctcacagagcttacaatttttattttctttagaggtcaccaggcttaaaatgacacttccctaaattctgaaaagaacagatttttaaaacaagaagggactgtaatgttttctgttcctacctcgtattttgttcacattaagaacctggggtgggaagtggaggagggggggtgactggcggggggccacagagagctgagctggggtggtctcgaactcctgaactcaagcaatctgccagcctcagtctcccaaagtgctgggattataggcatgagccacccacgatgcctgggtggaactcagggctctggatgcctgggcgcccccatctcccacactacggcgcctcatcctagaagtggttagcacctttgagatgggaattatttagcaggatgcttttgtgttttcatgtaagttttatgctgcctgtggagggcacagctgtttcaaaactaataaccaaatcctggtctccgaagtctgaaggcatcctttgccctgcagtgcaaagcacgggattctggcctcacacaggcaggtctgaactcctgtgttgcctcttgctggctgtgggacctgaggcaaatcatgcaacctctcttttctgtttgcctagatggaaaataggtttacaatacgcccccataggatggctgtgagaattaaaggaagtcatgggtgtacaatacctggccccgaaagatgcttaataatttaattctgaccttcctcactcatttaggattatgtaccaacttttagaaacaatgaaagattagtgagtcttctgtggttggtataaaaaaaaaatagaaacatgaaagagatgtcctccttgttcaagggctaatgaccctggtgtgcgctgtctaggcccccaaggtcttccttccctgctcacagcatttcaggttctccgcagctttgctgagcctgggtcaggttcggtatctgcccaccatgctcacttgccacagctgtggccccatttccaaacttcagagacttaaaggtgcagctaatgatgtgcccggcctggggtcacattccctgagccctgcagacaagggagcaggaggctgagctcttatcttccacaccctgtgcacagcctgggaagagttaaagcaccctagtcctatgctgcgagggccacatgccctgagaccttggaaaaaatcctacctgaattgaagagcatcactatttcatcaggaggcgctgccatttcatttttcacttcggttttatcttgagtgtaaaacagcttcgcaaatcactttttcttgtttctgtaatgagcatatggtggcctcattcgtgtgataaatctgagccaccacgatatttgacttttcacaatttaatttatctgaaccctctattctctggctaaaaaatatcccttacttggacttctttattttattttcaattcccttaccagcactagcaggggactctgtactcatctgctggcgctgccataacaaagcactgcagcctggggggctcaaaccacagaatttattctctcacagtcctagaggctagaagtccaagatcaaagtgtgggcagggtcggtttctcctgcagcctctctccttggcttatagagtgccaccttctacctgtgtcttcacatcatcacctcactgagcatgtctgtgtccaaatctccccttcttataagaccccagtcatactggatgaggatccacccatatgagttcattttaccttaattatctctttaaacaccctgtctccaaatacagtcccattctgaggaactgagagtaaagattcaacatatgaattttggaagggacctaattcagcccacaacaccctcttttgggatgtttattttcccccttaaggagctagttaggatgtcttatctcatgaacatgactgtgaacaggaaaacagggagagaatgaagctggccaaggaacagggctggtgtcagctagcagtgcttttctgatgtgagtgggtcccacagggagcttgttaaaatgcagattctgattcattaggttccagagggacctgagatttcccatttctgacaagtttccagtgtgggggctgatgctgctggtccacggaccatactttgagtagcaaggagcttgatacataatggctgagtgactttcagactcctgctgtagaaaaattatgagttggctgggcgtggtggctcacgcctgtaatcccagcactttgggaggccgaggtgggcagatcacctgaggtcaggagttcgagaccagcctggccaacatggtgaaacaccatctctaccaaaaatacaaaaattagccaggtgtggtggcaggtgcctgtaatcccagctactcaggaggctgaggcaggagaatcgcttgaacccgggaggcagaggttgcagtgatctgagatcgtgccactgcactccagctgggcaatagagcttgactcagtctcaaaaaaaaaaaaagaaaagaaaaagaaaaattatgagttatattatcagcatatggggtgcctttcaaattgataaaatttctaatattaaacctgtggatgccaaatgctgctctctgattatggcaggaaacggcacttggcagtacgaagttagctgttgggctgagctggctcatcttgttgtgcggtcctgattgcctaaagatgccttcccaggatctttactaacaatcctcctgagtcatttggactttcccaacctgttatcacctctcagatgggccagccatggaggcagtcagaggagggctctgcagagggagggcagaaacagggtggcctctgcatgccattaggaggtcacatctcactgggggatgcagtttaggatttagtgccttggagagaaggatagagtatattaaaacatgtctccgctaggcatggtggtttacgcctataatcccagcactttgggaggccgaggtgagtggattgcctgagctcaggagttcaagaccagcctggctaacatgacgaaacctcatctctactaaaatacaaaaagttagctgggagtggtggcgtgcgcctgtagttgcagctacttgggaggctgaggcatgagaatcacttaagcccagaagactgaggttgcagtgagccgagattgcaccactgcactccagcttgggctacagagtgagactctatctcaaaaacaaagaaacaaacaacaacaataacaacaaaaaccaagtctctccctccactcaaaaatgcaagggcctgtctcccattgctgggtgcccaggtctcatgaatgtagatatgaattattccagtcagcctcaggagaatagaatgagccctcagatgccgaagcacctttcagattccaccggttttatcggctcatttaaacttcacttctaacacagtcctgcattacacacgtgtctgtcgttatgggcagctgcagagagggtcttaatggtcctaatgctcagtgaggatgcccaatggtcaacagaacctgccatcttcaggccatcaaggagctctggagttaaggaaatcatgagagcacagaggggcgggtacagcagagccctcgtggtaatgggttttgaggtctaggctctcttcacttgggtttgaaataagttcaatgactagtaatagctgagacacttctacccttcaaatgaagtaaatgggaaaatggagcattgttgagtccagggagctataatttaaaccccatatatctaaaaggggtaacatttttgtgtgtgtgaaattggtgtcattcgcactgcatctacagttttctttttccttctcttccagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgtttt

SEQ ID NO: 36558 - DNA, 953 bp, Homo sapiens
aagtgctcacacgtgtgctccctgccctgctcctggccccttggccggccgggctgtttctggccatgggtcgctcccgccggacaggcgcgcaccgagcgcactctctagcccggcagatgaaggcgaagcggcggcggccggacttggatgagattcaccgcgagctgcggcctcagggatccgcacgaccccagcccgacccaaacgccgagttcgaccccgacctgccagggggcggtctgcaccgctgtctggcctgcgcgtgagtcccggacgagcccggcctggggcggaggagggtccgcggtaccggccgggagatgtgaagttgaagccccaggcagcgcagagtcttctctcttgggacccgtgggtccgcccgcctcccgtttctcagacccggatcctggcgtcagggacaagctagggctagggagataggtgcacttgggagactatcacctcctcactctccttctcacttccattcctacaggaggtacttcatcgattccaccaacctgaagacccacttccgatccaaagaccacaagaaaaggtatgaaggagtaaggagaggattgatggatgggtgctcagcagatagggctctcacctggtcagctcccaactcctgtttttctttctcccaggctgaagcagctgagcgtcgagccctacagtcaggaagaggcggagagggcagcgggtatgggatcctatgtgccccccaggcggctggcagtgcccacggaagtgtccactgaggtccctgagatggatacctctacctgacatggcctgaagatgcagggcagaggaattgcccatggacagtgacgcaaggactaggctgggagggagcgtgccaaccccttttgcctctgggtttggggagcggagggcctcttcttggtgccctgccccaaataaaggaactggacaaagag

SEQ ID NO: 36559 - DNA, 15675 bp, Homo sapiens
atctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcaggtagccggcagctcctgcccagcatcccctcctttagggcagaaacttgatcttgactgccgccgcccggggcccctggctccgggactagtatggctctgcgtgggatgcaccctctgccacgattaggagagaactcgcccccaacagagctgtcctctctgctctggcttcctcccttcctctccgcgctgcgaggtctgcacagctgagcaaatatagtggtgacctgagagaccctgctcggcagcctgccctaagccttcacgggggagctagcccagagagggcagtgatttgcccaagggcacacagctgatggatcagccttaaaaccgacgccgcagctccttgtgtcttcagtatccttttcttctcacaatatcccgcccccagtaccatttggtgggtctggtttctcattacttattctgaggcctaagcatgtttttttctttcccagcatcgctgaagttcttgactgcagcaagggtttctttctttctttgaggcggagtcttgctctgttgcccaggctggagtgcagtggtgcgatctcggctcagtgcaacctccgcctcccgggttcaagcatttctcctgcctcagcctcctgattagctgggacatacaggcgcgccacagcccagctaattttttaacttcttttagtagagacggggtttcaccgtgttggccaggctggtctcgaactcctgaccttgtaatctgcccacctctgccaaagtgctaggattacaggcatgagccaccgcgcccagccccctgcagcaaggcttctaacagctttgacctccaaggcttctcctggctttactggaagttatcttactttgagctcccttccttccacttaaggaattgtaaataacttcttggagggctatttgatttttgtttttgaagacaagatctggccctgttgtccaggctggagtgcagtggcacgaacatggctcactgcaacctcgacctcctgggcccaagtgacccttctgcctcagtctcccgtttagctgggaccataagcgcttgccaccacatccagctaacttttttatttttagtagacatgaggccccactttggagcccaggctggttttgaactcatgggctcaggcgatcctcccacctcggcttcccaaagtgctgggattgattacaggcgagagccacctgccaggtcatggagggctgttcataactcattgttacagaaaatgccaaacagctgggacgtgggaggctagagacataattattcagcttccaatgggcctacattctgggcaagcattttcatctctggggccaagctgcagttttctcatctgtacactgaaggagttagacttgatgtctgagggctcttgttatttattcatttatacatttatttaattttattttttgagatggagtcttgctctgtcacccaggctggagtgcagtggtgcgatcttggctcacctcaacctctgcctcctgggttcaagtgattctcctgcctcagcctcctgagtagctgggattacaggtgcatgccaccacgtccagctaatttttgtatttttagtagagatggagtttcaccatgttggccaggctgctcttgaactcctgatctcaaatgatccacctgcctcggcctcccaaagtgctgggattacagatgtaagccactgcgcccggcccagaggatttttatgcataaggatatttgcctggggaaaggacctatggcttttaccatattctcaaaaggatcttaaaccccaatatggtgaagagatcatgcattagagtcttagtgagggtagtagaatttggcccagttcccaagtctttccctctttccccctctccctacagaggaaggcattactgggtaccggccaagaggctgtttggtggtcagatcgtgggccaggccctggtggctgcagccaagtctgtgagtgaagacgtccacgtgcactccctgcactgctactttgttcgggcaggtaaaccccccacttcctgccccaacccaaccctggtggcccagcagccatttctggccttgggggctgaggtcaaaagggaagagagggagactggaagacaaggggaggggtggcggacactaccaccctaagaggtgtctagggtggaacgaggtctggggctaacaatgagccttggacctcacacctgctgggactcactgggtacctgatgtctggctgataatgacacaagactttgttgcttaactgctccttgtgggcttttgttcttccattcttaacatagctcctggtgcggagcgctgtgctaggttctcagtgtgctgtgacctctgtgctagaggtgtggaggtagggcagcttgggttggagaagagagcaccagcctgagagtcaagggatctaaggcttcttttgtcaactgagcatagggtcaataaaaacaaaccaaagatgtagggcctagcttcagttttgtccataatttaccatgcagccttgtgaggttacctccccgccctacagtttggtttacttcagctgtaaaatggagaagggtgggaccaagggtattttagtgggatgatctctacagcttcttacagctctggggtcagataatgtaacttaaaacctatgtgtgaggccgggcgcggtggctcacgcctgtaatcccagcactttggaggccaaggcgggcggatcacgaggtcaggagatcgggaccatcctagctaacacggtgaaaccccgtctctactaaaaatataaaaaaattagccaggtgtggtggtgggtgcctgtagtcccagctactcgggaggctgaggcaggagaatggtgtgaacccggaaggcggagcttgcagtgagccaagatcgtgccactgcactccagcctgggcgagcactccagcctgggcaacagagcgagactctgtctcaaaaacaaaaaacctatgtgtggtggctcatgcctataatccccgcacattgggaggccaatgcggagaattgttggaacccaggaattcaagaccagccagggcaataaatcgagaccttgtctctacaaaaaaataaataaaaggaaaataaaagcaaaacctatgctaaaaaacaaacaaaaaaaaccctcactgttttctttccttccctgttacccccagagcagatgccctcatgtgttctgcgtagatccccagctgagaagagtttgtggacctttacagtatgtgatttgtattaagaaaaccatggggtttcccccttcattttgtaaatatgaaagttatccctgtaatggtaaatacactttttcatactgtcccgtgtctcttactcctcatccctgaggagtattgattggcccccctcttctcggcccccagtcactgctataaagtatttgaatacttaccttgggctcagccaggttcttatctttatgctagttgggagtaaatatgtgctttgtttctttaatttgtttgtaagtaccagccttttgatattgtaatccttccagcctagtgaaatacctggctgttttcttttgtgtgggtgggggcattacttgaactctgaatctcttcatcctgtgatggaagaattcaatgagtctttgccagtaaagtatctagtgcagggcttggcataatctagttttccataaatattattagtttttgatgattaacttatgggaataattaaaatttgcatgatacagagcatagttgtgtgcattatcttgtttagtcttcataagtaaacatgggtggcaggcattcctgccatcattcttacctaaggaaactgggacctgaagaggtttggaaccagctcccacagtgcccaaggaggcagagccaggatttgaacctggtttatgtgtctttgagtgccaaactctttcctgcttctttgcttcgctcttgggcaataattctaaacaatgagagagctgccagggtacccatcccaggttctggggaaaagatcctctttcttggaaagtcttcatccaggagcagcgtgaaatgagctgtgtccaagccaccatttcaaaataaataattatttggccgggcgtggtggctcatgcctgtaatcctagcactttgggaagccgaggcgggcggatcacctgagctcaggagttcgagaccagcctgggcaacatggtgaaacccagtctctactaaaatactaaaaattagccaggcatggcggcatgtgcctgtagtcccagctactcaggaggctgaggtaggagaattgcttgaactcaggaggcggaggttgcagtgagctgagatcatgctactgtactccagcctgggcgacagagcgagactcttgtctccatcaaaaataaataaataaataaaaataattatttgtgcccttgcttgtgtcttgaaaggctgcaagatagctaaaataattggtagttattatgggaatattaaaagtcaaaggacattaggccagtagtaatgggatttgggagaagcgatcatgtcaaaaaatttggctaagccatattgttgcagtttcatacaaggtttagttctgagcttcctggctgcaaggcaaaaaggggagagctcttatctgtttgtggtgtgactctgccagctatatcagatattaaaaccaatgctgttttttggctgggcatgtggcttatgcctgtaatcccaggactttgggaggccgaggcgggcagatcggctgaggtcaagagttcgagaccagcctggacaatgtggcgaaactccatctctactaaaaaaaaaaaacacacacaaaaattagccaggtgtggtggtgcacacctgtagtcctagctactcaggaggctgagtcaggagaatcgcttgaaccctggaggtggaggttgcagtgagctgagatcgtgctactgtactccagcctgggtgacagagcaagactccatctaaaaaaaaaaaggaaaattagctgggcgtggtgaccttagcccgtgatcccagctactcgggaggctgaggctgaggctgaggcaaggagaattgcttgaacccggcggctggaggtcgcagtgagctaaaactgcgccactgcactcccacctgggcgacagatcgagactccatctcaaaaaaacaaaacaaaaaagagatgtttcaattacattttaaaaataaaagatgttatgggggagggggagggttggtccttggccatttatcaaatcagttctttttctaaaagcccaggaaagaatgtgaattagttgggtttttgttttgtttttagtttttctctacagaggtaaatttagagcttgaagaattcagaacaaggtcagcaaacattctagaaagggccagatagtaaacattttaggttttgccagtgaaagcaactatagacaatatgtaaacaaattagcatgactttattacaaaaaaattgtattttaaggcaacagtttcctcatctgtacaatgggggtaagagtggctctacatagttattgtgagaccaacatgagaaaacataccctcctgtccaatgctgtcaggcaccctgcatcactccataatcattaactcccttcaatatgcctcagggcctacctgctctgttccaataacaattttcaagaatagggctggaactcattcacactgaaaggtagaccagagtactgaagtttctgtgatcctcctcaggaatctgcactttagcttacctgcagaccaaggattggattagaggtttttttttgttttttccccccaagtttggtggtagggaggaagacttcattcccagtgtctgaaagcagactgcacaagtaactttgtctagtgtctggactcttggtaagcccttctcaaatgcctttaaccttgaggagctcgcactctgatagaagtgctgctggtggcagtgcctgataacagagagctgagcaagccagttgacctcagacagtgatgtttattgctgttgattgagccctggtgcctggttgactccccatttggatcagagtgaaggaagcaacacttctctagacctgcttctttcatctgaaggttgaaagtcatccccaagatgtctcatggcccagatgtcagggttcctcaaggtcagcctgactcagacaaagtgagaacttcagggaaaccagggaagttctcttcctctccaaatcttccctcacctgcttgttgttggctgccttatccctggccagtgccttctactctggtggtggtggtcttgttgtttttgagacaaggtcttgctctgtcacctaggctggagcacagtgacgcagtcatggctcactgcagccttgatctcctggcctcaagtgatccttccgcctcagcctcttgattagctgggactataggcacatgccaccatgtccagctaatttttattttttattttttgtagaaacagggtctccctgtgttgcctaggctcttccactctgctttggagcagagacacctgacagtgaaggaccaaatggcttccatatacatcaggggtgaagtgactgacagtggcccttgcctgggagaggctgaatatacaaacagacaatggctagaccatgtagaaaaacagaactctgacgcacaatagcagcaaccagcacaggaagccagcctactatccacaagtcagacttgtaggaagtcagaccactatctttaccaaccagtccagcaagccaaataatgaccactgtaacaattggcctccaaagccaggacttgattaataactgatagctgccctaatttttgcccctgcttccaacttaggaccaaccggagaaagccaaatatgtactcctaaccaatcacataggatgtcccactcttttttgagacagagtttcactcttgttccccaggctggagtgcagtggtgcaatttcggctcactgcagcctccacctcccaggttcaagcagttctcctgccatagcctccacctcccagcttcaagcaattctcctgctgcagcctcccgagtagctaggattacaggtgtgtgccaccaggcctggctaattttttgtatttttagtagagacagggttttgccatgttggccaggctggtcttgaactcctggtctcagaagatctgcccgcctcagcctcccaaagtgttgggattacaggtgtgagccaccgtgcccagccaggtgtcatgcttctagttagcccaccaacagcttccccatgccaacagcctgcaatgggagcatccctgaagcctttttttccactacagagcattcccattcctttgcctgcctctaagtctctgccaaaagcaagtgatggtggttgacttcctgctacaacaagctctgattggctgggcgcagtggctcatgcctgtaatctcaacactttgggaggccaaggtgggtggatcagttgaggtcaggagtttgagaccagcctgggcaacacagtgaaaccccatctctacaaaaaatacaaaaatttgttgggtgtagcggcgcacgcctgtagtcccagctacttaggaggctgaggcatgagcatggcttgaacctgggaggcagaggttgcagtgagcccagatagcgccactgcacttcagcctcggtgacccagcgaaactgtctctcaaaaaaaaaaaaaaaattagctgggtatggtcatgcacccctgtagtccccccccactcaggaggctgagtcacaggaatcgcttgaacctgagaggtggaggttgcagtgagccgagattacaccactgtactccagcctgggtgacagagcaagactccatctcaaacaaacaaaaaaaagaacaagcgctgaataaatagcctttgtttgttctcaaaaaagaaaacaacaacagaataaacagtaaacaggctgcaggctagatttactgctccctgatctagaataatggttttggactgatgacaagatcccaggcatagatggagcaagatagaagcaaggagtattaattttatttaacaaacacatatagagccctcactatgtgccagatattattctaaacactttacaactacggattcatttcattatcattaaaatcctgtaagcgatgagcaccatgatgatccccagtttgcaaataagcacactgctcagagaagtgaagggtcacacggctggtgagtggtggagccaggatttgaatgcaaggaatctgtcaatgtctctgctgtttgtgctgttagagaaaagctccacctgcacagggagaagcctgatgacagggcctggtggtctctgtatccctgggcctggaccttagcagacctcagttagtagtcactgagatgaaatggaatggaagatgagtagtagagtgcctgtcaggcgttgtgatgatgacagggcctgtggacccactgtgtccttgtgcccactgcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaaggtgagagacctggaggctccatggcagacttttcaaaatgcagctgctatctgtttgtgggtcatagaatcctttagtgggtcttgaccagcatttttaaaatacagattagaaaagaagatactggagtgaataatatgtatgtattaagggcaagaatccttttgtgaaacttgaggtttagtcatgtgtgtttctggtgtgtgtctgtactgggtcatggtataaaatgaagggcttggccgggtgcagtggcgcatacctataatcccagcactttgggaagccaaggcaggaggattgcttgagaccaggagttggatactagcctcgccaacatagcaagactccatctctaatttaaaaataaggctggggctgggtgtgggggctcatacctataataacactttgggaagcccaagtgggaggatcacctgagcccaggagttcaagaccagcctgggcaacatggtgaaaccctgtctctataaaaaatacaaaaattagccgggtgtcggggcatgtgtctgtagtcccagctacttgggaggctgaggcggggggatcacttgagcctgggaggtggaggctgcagtgagccgagatcgtgttactgtgctccagcctgggcaacaagagcaagactctgtctgaaaaaagaaaaaaagaatatatattttgttgttgtttatatatatacatgtttgtttgtttttgagatggagtcttgctcttgttgcccaggctggagtgcagtgacaccatctcggctcactgcagcctctgactcccagactcaagtgatcctcccgcctcagcctcccaagtagctgggattacaggcacctgctaccatgcccagctaattttgtatttttagtagagatggcgtttcaccatgctatccaggctggtctcaaactcttgatctcaggtgatccacccaccttgacctcctaaagtgctgggattataggcatgagccaccatacctgggaaaaaaaaccatatatatattttatatatatatgtatatagaaatacttccgtaaccacttgttaagtaccacctccccagccccctaagtgattccctctctcccccaggcccctggtccagcaacttaggacttaatgcacaccaggagtgagtgtcctctggagagctgcagcgctatggcctatgtttggtcactgcctttgcattagtgcatgtttttgtttgtttgtttgttttgagacagagtctcgccctgttgcctaggctggagtgcagtggcatgatctcggctcactgcaacctctgcctcccaggttcaagcaattcccgtgcctcagcctcccaagcagctgtgattacaggcacatgccaccatgcctggctaatttttgtatttttttagtagagaccaggtttcgctatgttgaccaggctggtcttgaactcctgacctcaagtgatcgacctgccttggtctctcaaagtgctgggattacaggcgtgagccaccgtgcccggccacatgttttatgtatataaaacatatgtacaaaaatacaaatatgtattttcccctaaccattagaccaccagggagcatgttagatattttgaatacctggtaaaatatatttatttggatcacacctaatcaagtttgaaaaatgctggtacaggggaaagagctctgggtccagacaaaggatagacacatggattctgtccagggctgtgcctctgtgaatgctcacctgctgtgggacagtgcccaactccccagggccctagtttcttcttctaaaaaatgggaatgctcatttctgccctgcctacttcttagctgtatcataaggagagaatgtctctatctcgtgttagatactggggaggcagcagagtatgacgggatggatgtgggtttgggaacctgaaaggcctggattcaattctagattttgtccctactagctgtgtgagtttgggcaagttgctttcccactctgagccagtactcaccattataaaatggtgctaatcatattcctacctcataaggctgctgtgaggattaaataagagagaaaaggcacttagcgtgctagtactaactagcacaatggcagtgaattgtagttatatcactattaacagaaaaaacacagggcctggtgtgtggttgcagttcgacaaatgtttgctgaaatgaaaggaagacattgttaaaggaccttgaatttagatctgtgctgttaataaggtagtctctagccactcgtggctatattacattaattaaaattaaataggtccgggcgcagtggttcatgcctgtaatcccagtactttgggaggccaaggcgggtggctcacccaaggtcaggagtttgagaccagcctggccaacatggtgaaacctcatctctattaaaaatacacacacaaaaaaattagccaggcgtggtggcccgtgcctgtaatcccagctactcaggaggctgaggcaggagagtcgcttggacccagggggcagaggttgcagtaagcaagattgagtcactgcactcctgactgggcaacagagcgagattccgtcttaaaaaaaaaaaaacaaaaaaaaaccaaagtcagtagaatgaacaattctgttcctcagttgcattagccacatttcaggtgctccatagtcacatgtggctagtggctaccatagtgtgctgtgcagataggcattccatcatcataggaggttctgtccaacagcactccagaggataggggtgaaaatggcaggacctgtgcagagcactatgggtggttgtcactgtattgaagggagttccttggaatgggctcctccccctggggggatgcaatgttccctactgtgtagggtttggtaactcaggccaagtcaggcagcctgtttcttgagtgtttaaaataatgaagtggctgggcacagcagctcactcctgtaatcccagcactttgggaggctgaagtaggaggatcacttaaggccaggattttgagaccagcctgggcaacataaagagaccccatctctacaaaaaaaagtaaaaataatcccagcattttgggaggctgaggcgggcggatcatgaggtcaggaattcgagaccaccctggccaacacagtgaaaccccatctctactaaacatacaaaaattagctgggcatggtggcaggcgcctgtaatcccagctactcgggaggctgaggcaggagaatcacttgaacctgggaggcggaggttgcagtcagctgagattgcaccaccgcactcaagcctgggtgacagagctagactccgtctcaaaataaagaaataataaaaatgttagccaggcacagtggcgtacacctctagtcccagctactcgggaggccaaggcaagaggatggcttgagcctgggagttggagactgcagtgagctgattgcgccactgtactccagcctgggtgagaagacgaccttgtctctaaaaaaatagaaaataatcatactgtggacccagattgcctgagtccaaatcctgtctctccaatttttaagcaagctacctggactctgtgcttatttcactgatgaaatgggggtgataatagtacctatctcacagggttgttgtgaggaatactattgtatgtacaatgcttagaacagtgcatattacagggtatgccttattactatgatgtgttggttagatattcatgatcttgtcttcacagtgttggttatgaggtaggttactatcattatccacattttgcagatgggaaaatagactcagattactaattagcacgagaccacatggctcgtaagtggccaagaagggattcaaacgctgcactatcctgcctgccacaggggaggggagctttggggatatcaggggtccctgtggaagaatgaggggagtcagaagaggcaatgcagatgtgactccctctcttcctgggtctcaccccgaccctcttccctttactttcagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtaagagtaccccatggatgggaggaaaccactctccaaggggtctaccactcatttgctgtgtggccttgggcacatgagttcccttctctgggcctgtttccttatctgcatgatggggaagttggcttagcttctcacctgggccctctcagccctttgcatggggagaaggtggagatgactataatcccgacacaaggcctttctgaggaaggcaaaaggcacctcgctggggttgttgtccagctttgctgctaactataaagtatctttgtgcaaattggaagaagacaccccttttggggcctagagtgggagacttgggtggtgaagactgaatttcagtccctgctcacccctgccctccccaagtcgccatctcacttctcccctatcacacacacacactgtaggccaagcgctcttgtgcagcaaccagtctgcacacccatgcacgggagtcccttttccccctacctccgtgcaggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtgagtgtggggccgtgtgggacaagggcactgaccttgagtggcaggagcctgctttcttgggtgatgctgatttcccgacttcctgtgtggcgctgcacaggtcacttcctttccttccctcccaggctttggcatcttcatcttcaaaatgagagggtgaggccgggacacctgctctgctctaaatttctagaatgtgctggaaatgtgattcaccttctcccagggacccagttctagtcccaaaaccagttcagattctttgtattacaataggcaaatcatatcttccatctgaacctcagtttcctcatctaaacaaagagggttacattacagcagtggtatccaaacccgcagtccatcagactgccatttggggatgccttttcaaaatagattctgattccaccctcaagattctcactcagtaggtcttggataaggtccaggaaactgtatttttaagttctctaagtgattctgattaacctgattgggatcggggcattcagtggtccctaagggcctgcttggaccttccttgcaggggagagaaacaagactcgttcatcaatgtctagcttcagaaccctgacctcctttccaagggagtacatttcaaatgaagaaaagctttgcttgataaaccaaggacaaaactcaaggattctttatactcagataaggggtattctcaagtaccaatagcatcacaatccaagattgataaccttgaagtgaggacatgggttcagatttggcttcatcatggggccaaattcctgaccctctctggatttcagtcctggtctggaaaactggacaacacataactgcttcatttggctactgtgagaactgagtgagctctgctatgtgtaagggaaaccagcaatcatcctcataaacatcaaacttgggcccaaagccagcaagggagaaagagtctccagatggggagggaagaggccagacctcatggcctcaagtcctctcttctgagtcctttcttccccttggtggtggtagtggggatatttttcatgaattaccacttggaggacctggcttgatttattatacagggagccgatagttttcctaacacaagtggtcagaggtacagcagttctgcttggccgaactgttgaaggagactgttctcagagctcctccctctgtgatctttttgaggaagcgaggagaggtgtgaaagtgcttttaaactgtcaactggggttcctgtgggaggagttacccctcaatgacggtccataataagctcatgaaggggcatttggagcagccacgacactcagtgcacccttgtgtggggcagccctgccctgggccagaccctttgcaagaagtccacttggaggttgggcatggtgatgtgcgcctgtaatcccagctgctcaggaggctgaggcgggaggatcccttgaacccaggcgcttgagaccagcctggcaacttagtgagactctgtttcaggaaaaaaaaaaaaagtgtatttggctgttctgaagcaggccatcatcacccttcacctcacccacaggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgataccactgg

SEQ ID NO: 36560 - DNA, 11261 bp, Homo sapiens
gggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcgggtaagcgcggccgcgagtttcccactccagagccccgccgggccgcctggctcctctctgcttcttttctttttcttttctgcctgaactcgtctgcctgggtacctttaggagaagagagaggcccaatccaagggcgagatgcgatggacgcggtcggctggactcggtggggcccagaggatgggatgggcagtaggagttggagcaggtcctgcacgccagagctcgctctcctgaagggaggcgaggaggccagggggccttttccagaagtttgaactctgaataatgcaagtatatcatacatacaccaggactagttgagaaggctgctttggagcgggccggcgcctctcagcctcaactcaagttcagagggattgggtgacttaacccgaagctgcactcctagttagtgacaccaccaagaccaaaagccaggttcctttccagatcattttccaccacccgccttggctctgagactggcctttgtgagggaaactccattcctcaaatactttgctctcatcggaagccgaggacagacactccgtgaagatttgggaaagcttttctgaaaccttacactcaccccttcctctcttgctaaaccaacacctagtcccatccctggtgccctcgcccccccccgccccccccccactcctcaatacagtgtttctctgccatttgctttcatttgttctgtttgagggggtacatttccctctgctctgatttatgaacacttgaactttgcctggtgtggtggttgggagtgggcgttttaaagatgatgttaactattggaaagttcatagaaatggtaccaagccaagtgccagtggctcacgcctgtaatcccagcactttggaaggcctagactggaggatcgcatgagcacaggagttcgagaccagcctgggctgttagtgagaccctgtctctacaaaatacatacatacatatatacatacatacatacaaaaaattagacaagtgtggtcgtgcgtgcctgtagtcccagctactcaggagcctgaggcaggaggatcacttgaccctaggagaggtcaaggcttcagtgagctgtgttctcactgctgtactccagcctggtcaacagagtgagaccctatctcagaaaaaaaaaaaaaaagtacgaaaattactctgttcaatcattacaggtgttaagaagcacagtctgcagtacagcattagaatgggagctggtttagggttagaggacacctgaggccacccttcattctacagtccctacactgaagcccatggagggtatagctacctggctggtagcagagtggttggggggatcacaggtctactgtctgtctgccaggtagtgctcttgtcatttatagcttgttacataagaaagagtagtaaataattgtaacctataactcattcatttaagagcacatttctgtccctcagacaggagaataactgtatgcaactcagttgctcagaaaaaaggagtaatcagccagggactcagctttttgttgttgttttttgttaccaaaaaccaaaagttcgtttgaaaagtcatctttgaagccagaagttttttcgaaacacttcctgccgttgcacagaaccctaatgagcagtatttctgcttcttgacaaagtcatggattctaaaggttgccttaccatgtgacggtcattctccaggaatctgcagcatagctgaggtttttcacaaagatggttttaaaaccttgcttacaagggtgattgaccttgccttactctttatgtaaattatggcattttgttattaaactacgattgggtcccactgctggtaaatcagtatgagtaactagatttttaagtgtttatagttagaaacttgagaaagtaaaagcaggagtaagatacaaattttctttctggtatcacctcttctttttttattaatcacagacctcgaatgacaggaaggggtcatatctagttttttatcagactctgataaacatctgcctagatgggatatccttgtacttttcactaaatccaaagcttgagttttgccaggaaggaaaacaaaagtttaagatctccaaaagggatttctggatgttagatattgtttcaacaggtattgttgtcccatacagcaagtacagaccagcaatttacaaaattagaggtaaatttatagaaattattaggctcacattataagtaagattttcagagatagaattttaatatctctgaatatgagggagaaaaatagcttagtgagagaccaaaaacaaaaaaaaaacaaaaaaaactgttttagagaccaaaaaaagcaaaacaaaacaaaaaatccttagcctaaagtttggagagctacattactaactgtttgatttgaatatttgagctactagtgaatctcagctcataccatttgaattaagtaatgatgatgtaatgaaggcaaactgatggctgctccacaaacttcccccagggctaagcatacttgccttatgtagtaacaaagttggatcatatttaattctcaaataatagaaatattctttgattgcacaatagtagatagagccagctacttgccataactaagttaaggtgtggtgtttttactagttaggttttttttttttttttttttttggttgcttcagtgagagggcgaggtagtgaagaaattatgacgaatctctatgcttgaaagctgtggcaagtatgataggctagaattatcaaatgttttctacacatgtagctaagcagattcagctgaactcttcaggttaagaaccactgtgatcctcagatacacaaatctgttcttacggcattgaaggaatctggctttaaaatacagatgcagtttagtgcagtttttgtgttagacaattgccatctcttaactcacacgtactttaggactgctgctcaaaacataactgaaatatactaaaatcttgaagtctttgataacactttacagagatcttaataaatgcatactcaagatatagcaagagatgtctctgatcttccttttaatgctcagtgtaggtaaagtagtatttggtttactattatatgcttattgcttattagtcactatagcatttttcaggcaaattgaaagactggtctaggttaaatcttaaaaaaacaagtttgtccatttaggtctagtatactttagccttcatgtattgactgagtgatttgctttttaggatcaacattttttaataaaaatctgaatgagtaactctcctttgggccaaaggacaaattgggaacagtctgctctgaagttcatataaataatatttacccaagcataaaatgtgtgcttggaagatataaactatataatttatgcctaaacttattttacattgttttgattcccatccaaaatagaatgtggatcctgattgccttgctgcatcttatactttgtcgattagtatacctagtaatatccctttgtcttttttttcacaactctcctatcatctttcatgagcacgagtaaaaggaaatacttgaaatttacagatgattcacaaaaaaaaaaaaaaaaaagcaacagtcactaaagtttaacaactctttgttaacttctaggtttctaactgttcttttactcatttgtcaccccactctcttttctaaattaaagatatagtccaaaggaatagtttattaccatgtaattatcttgaaatcttactttttcaatttcctaatttaagactgtcatatcttgttgcttagtcttttcatattcaataattaaaatatataaaaatggaagtggttggtaatgtgtgcactgcatttgaaattggagtctgaatcatttcaatgcatatagtctttctgcagaatagcgattttgaacagttggcatatcatgtaagtttttataaatgtcagcattatgagccaatgaactatataatggtcagatttacatcacaataaaatatgagcataatagtagggtttcatatgtgaccatttgttacagtaaaatttagacctttggactattacagtacagcttcagttaaaccatatgaggagtcatcacaaaacaaaccttaaatttatgcattcacgtttgaccattgttttattcttcttccattattccctaaaacaatatataaaattatattgcattgtagagtttggagaaggaagaattttatattttggggtatctttgcatctgtgcagagaaaatgtgtcaataaaatgtagataaagcctgttgctcatgtgtttcaagaagaaagtgtctttatcatagaacagagtgatacatcttagatgtgcattgattgccaatcatttttccttcacactgtagtcagtaactaagtcaaggcaactgcaagatagttcagaaaggctagcatcccacttctataggtgtgtgggagtcagaagacctggattctagtcctgtcttctttagtcagtgccactataatcctggccaagcatccattttcctgttgttacatctgtcagatgaaaagaagggtctttcctatgccaaagattagtacaatagcagatagtaagagaacgctttgcaaagtcctatataatgtacaaagcagatttttcccaaagtgtttgacataaattattttaaaagtacaatgacatttgaagaaccctggaattgattcttcttgtaacaacacaaccagttgtgccttttgttctgaaacagattttcatgtatctactacttacaggggtgaaatcttgcatattgagtcagaagtgggtatgggctagagatatgaaggagagatgagttgagaacatgaactactttatctcatgtccagccctaatctatttgactagcatgttacccactgcacttatctccttcctgcaggcttcatttcttctattcttgtctcttcttcctctacttccagctttatgttttcctttagtgcctctcttctcttagactaaggggagacgagtcggaataaatgacagactttgtagctttaaatattgtcatattggtttttatggagaatatgttgtacagaacataaaactaattcattatgtacttaaaccaaattatcagacacatctgctctatgggtcatggtctgtatggatagccttaatcacaccaggttatattgctgtggaatggaagacatttgttcatagtgttgctcttggggtaaaaggggttatacctaaatgtagactctgtctgaattacaagtttttaattttttcttatatttatgtctagggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggtgagatctgctttgcttatgcatcttttgctttctagctcataattctgagctgtaaatgtaaagtatttagatatatttatgtgagtggtgtttgaaagtctggaaaatgagaagtgtagcatggatgtgttatagcttctttcagtccacaacaggactgctttccaaattggctaatggctaatagaagggcagattttccatcaaaacaaaaagaattatttagggcaaaaagcaaatgacattttctgtgagtttgagtttttaactgaggtacttctcatgcaactagagtggttgggggtattgtcaagcacgagaatttttggtttttacaaaaggctaagtgaataggaagatgcctctggtgaagatgtgtgtcacatgcaggaccatgtgaaaagatcagagaggagatttattcagatgatgtttgaagagttttaggttaactgtgtacgaaagatttgaaacagccagaaagtatcaacatttgtggtatgcttcataaacagtagagtgagaattttttcttttgtctattatggaaagctgaataaaatattttctgaaggaaaaaataaaacactcagttgactttcaaaaatcttaacagtctagtgaccaggcacggtggctcatgcctgtaatcctagcagtctgggaggccgaggcagatggatcgggcagatcgcttgaactgggagttcgagaccagcctgggcaacgtggcgaaaccctgtctctgccaaaaatacacaaagtagctgagcatggtggtgcatgcctgtggtcctagcttctcgggaggctaaggcaggaggatcacttgagtctgggaggcagaggttgcagtgagccgagatcatgccactgcactccagcctgggtgacaaagtgagaccccatctcaaaaaaaaaaaaatcttaatagtctagatatagaaaaaaggtgaaaattatacatatataaaatgtttggggggggggttacgtgcattggaactttcacataagggggttagtgacaatcagatttatgtaagaatgatgaaatgtttgaaaaattctgtgatgacagataaacattataccataaatttgttgaaatcataacacagttctagcttttagtttatgttctgtggatttcttgtgtgtgtttacgggtgtttttatatatgtatgtatgtatgattgttcctccaaatcacccacctcattctggatatttactaatcagattaggtttagctctactagaaacttacccttagagtgaaaaactacttgatgccaatgatgatctgcgggataaaagcgaagcaatgagagactgcacaaaaggagaccgctccaaaaatattgcgcaatgatggagtcactgggaaaaaaaagactgtctactgcaggcagaaatgtacactcctaagctagaggctaattgtttgaataaatatagcatcttaaaatttcctttcataaataaaacatagtgatagaagaaagatgaagcccaggagtgctatgtgagcacttaatctgacacgaaggagaaaatcacagaaagaaagccttcttatagagaagtcacctcattctcccaagaagctaggaccacaggcatgtgccaccatgcccagctactttttgcatttttagtagagacagaattttgccgtgttgcccaggctggactcaaactcctgagctggagtgatctgcctgcctcagcctcccaaagcactaggattacaggcgtgttcttctggacactcatgccctctgtctgctctgtatgcctattgggtgatttgctctacttgccagctttgctgtaaaaagacgaaaaaaaaaaaaggggcagtaagtataactgcttatgcgagtgtgcattttggtggaggagttttataaatgatagacaaaattcccctttaggctctatttaatctttcagatagtaaatccagatttgcccccagatgtaagacgtcatgtgactagtagcttgtgactgtgtaagtcatcggtttcactttatgtatggataggattacacgcagaggtgaaaggtgaaacgctggttaagagtacaagtttcaagtttgctctgtgcttccatacaaatataatagaagcagcttctgtagaatttccttagcagtaaaccagacgtgttccaagagaataacagtaataaaaaaatttaggttaaaaatcttagagttaaggcttaaagtactgcctaaatgtcactaaggtacacttctgagctggcctgcagctaacttcagatctgacttttgcttgaattgcagtcatccgaatttcactaggaacataggcaaaagataacttttgcaaataaatttcatcatttcacctttatggcaaataatggatttctaatatgaaactttaataatattaacatatgggaattacattaacatgtgactagttacactatcattggaattttaaccaactgcttccaaatacagttagagaattttataattatttgatataatggggatagctgggactgaatgtcacttggacattcaaaagatcaatacttgaattaaagttaacacttatcttgggagtggaggtaaaaaataaataaaaagcttgtttcagtgctatgaaagatgcctgtaaatagcacagctgttttaggtttcttgttgtctgagaaagggtttacaaataaggaaaaaggctacaatgaacctcatagcattggattggattagacattaatatgagcttcaggtttcatatgtgtgtgtgtgtaagagtatatgcatatatatatgtgagtgtgtatagatatatgtatgtacacacacatatgtgtaaacagataaagaagttgatacagatgcatgtgtgtatacatacgtttatttactagccatacctgctgagagggcttaaaaggaatgacaccacagaaccaattaacttacctcgtgctcaaaattcggtttttaaatatcattctccagtaaaaagaatgggaatctctagagaaatgcctgattttaggacgggtggaacaagtcaagtaaagatgtgcctgagatattttgttgtgcaagaaactaaggaaatgcttacaaaatgatggggacatgtgacaaagatacaggatactgccatacaagctccaaacatgtaagacaatttgagcaacaaactaaataattactgtaatgggttcaacttatagagtaaactaataatccatgataaaaatgaacaaatgaataaagaaatgggggagaagggaacctctttctttttttatttttatttttttattatacttttaagttttagggtacatgtgcacaacgtgcaggttagtcacgtatgtatacatgtgtggaacctctttctaacagtagaattccagctaataaatgtagaaggaatggcagaaataaaaaagtcaccattaaacaccacagtgatgattgttgtagggaggaattaattgatgataacattagtggggaaaagtgcggtgagaaacaggatatttacatatttgcactaagtacaaagggaaaaataataacttttctgtggagaaacatggcaaaaacaacttgaagcagtgtgcttcctgataaactgtgcagggtacatcacttgtgttttatttctgccaaaaatacatacgttgaatttaatgataaggaaacatcgaacatcacagatggaggtatattcaccggccagtgctctctgagagtgtcaaggtcatgaaaagcaaggagagtgaggaactgttcgagagtaaaagagaccagggcgacaacagtgaaatatagcttatgatcctggatctgaaatagggcattgagataattgatgcaatttgagtaagctttttaggctagcactgatacaacactattatgtaatttcctgattttgatagttgtattctggttatctaagatgttaacatttgagaaatatgtgtgaatggtaggaatgtttactttttttgcaatgtttttgtaaatccaaaattatttaaaaatgaacagttaaatatatttaaaaataagcacagtttttgcaatgtgttacctactgtatatttaatgataacttataattcagtcgcacaaatgctgtgacggctaataattccttagggtgtccttaatggacattgcactgacaacattgtttcaggctaatttatacatgacaactaaaaggaataattggtacttagagatggaaaaatgacatgatacatttatcacattttaatgttgtttgagccctttcagtttttttcacagtgtatcctgactgcttgaattagatattcaagggcaggaatttttttatttggaatgtcttcattatatgaattgcagcccagagcaaagattcattttcaaccgtcgagatagctcatggaacctcagtggcaaaggtttaagataggaacatcagaaaaggtgtccttcataaaaataagggaattctttccatcaccacattattctttaacattcaactctaagtgggcacacactttagtattagaggaaagtggctgtgcacttgctgccacctctaacaaattttcctggtcccattcatactcttaatgccttattctaagaattaatcctaaaaattaatcccgttcttcatttctgcattacaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgccatcatatggaagataatgtttacatccttttaaacatttttatatgacaattcctcaggatttggtaaggcttccaagttgtagcttttagtgtaagtgctggggtggtaataaaatgttacctcc

SEQ ID NO: 36561 - DNA, 15595 bp, Homo sapiens
cccaagctaacctccccaccccaataggatctggtggaagaaaagtcaggcaaacacaagcacgcacacaccactgggagatcagatcttctagctggctctctgctgccacagctccgccgaagggagggggtggaagaggaggactaaactcagagctgagaggagaggcaggtgtgtgcaggtaagcccagttgggagatgggcaggagactgggaagaatctttcatccagtaagtttcctccagctctgtccatttattgatctagtctctatcctctcactccttccttcctcccacctctttctcctctcaaatgagttcaaatttagtcttcctaacttctttcctatagcctcttccttttcttttcatcactctgtacccctatatttgcttactgcaaaagttaagctttcctgctgcagatgtttgttgtagcacagagagccacgctgcacaaagtgtttctacagatcaggtgtttccatagaaactggactccagaacccatttctttgcaccttttgtgtattgtcacacattgtggaagtcacacacatcacacggaggctgcacgttcactaccatcaccccacacgaccatacaaaatgaagacatcctgtccattcacctctgccctctgcatctgacatgcagagctagaccacatcatcaccagacaccagcagacacacacacacatgcatgcacacatgttccctgcatcttgtctctcgccctctcacacacacctccctagctgtaagagcaaagataaagtacgttttcccactgagatggcagagccagaagaaaatcttgcatcccaagtccaggccgaatagggaggagataagcaagagcgggagctggaagggtttcttcattatttagggcttcactgggtaggagggagagaaaaacggctttttccaacctgcacagtgtcttctcagcagctttcaatttctgtctcactggtccaaaccacttggcttttggaaagaaagaagaaagcgacccagttcccaatccttgaaggtcctaattcccagctctggggacagttcatttttttatttttttttcctgcaggcagccagaaaaatatttttctttaaagccgttctgaaattattccaaccatttaggttggcaaaaggtcctgtggcagaggagaaaaaaaaaaaaaggcagcagttccttaagcagttggggaggggaaaactgaagggcggcccctctcctgctcccctgctcattcctctctattaatagagagggtctgtcccaaggcaggcggggtgtagggagatcaggggtcccacacacagctgatcttcacagtcacctaagggctggagagggaggagtgtggagggcttactaaaaatacagatgtcggctctcactgcagatctactgaatcgagacccaggaatcttgttttaatacttcaggagattctgatggtccaccagggctcgagaatcaggggcctgagagagagctttgctgtaatttttaagcccaagactccggcagtgttagctgggcagaaggactgtgtcctggaaaaggagcaccagagtgtcccaaataggccacctcttttttggggagtgggagtaaacagggaagagctgtctccctctctcctccttgcaagcacaagcagccatatataccacagaggaacattccagtaagaaagttcccccaagatggctccacagagcttctgtttcccctcacctgttaatctgcctgccccaggaccccaggagcatgtgctgggcccttcccctgacccttataggtccctgctcctccttcccagcagccacctgtctgggctctcacagagggtgagctgaacactttcttcatgccccctccacctccctagtgggcaatcccatttattgggcatgtgagtgaagcatttcaaggctggaaggggcaaaaagctgggagaagtcaagaatcgcagtggaactccatggcccactgaggaaggcagacttgcaccttctgtggccagtgtcccctcacctgttgcagaaagcatcggtgagaagttggtgaattagaaagacagaacaagctttccctaggtggctggggacttccagagtctcctcagttagttgtttctgagacccaagtgtgatctcacaagccacaaaggggaggaagttgctctgtgtggaagagctggtaccccactcacaaggatccctgccttcgagcagtgcatgggggctgccctctagccaggctggagggaaggagaccccattactttgaaataatatcaacaagaccttaacattcagaaaacactcactttgcatgtattaactcatttaaccctcaaaacagaaaagaaggtgttagtatccccattttatagagcagaaaagcaattgctttgcctaagcctacctagctaagcatctgaatgaagaactgcaggattgggtctcagatctataatcactcaaggcatcagacacactcttctaggctttcttcaaggcttggagatgctgggggaatggggcagaggatatggtaggtggcgggctgtcagagaagagtcgtctcaccctggtttcttccccaccgctcagaatggaaaactttctcttctaaactagtggcctgaggccagaaaatcttcattctgtttacactttgccttgtggtagacactggggagacagatggtctctccataatagtgttatttttatttttagcactttttgatctgtagtgcattttaaagctgctaactgcacttgcttctgacaattgggtaaggaatataggtatagggaagatttttttattcccattttacagataagaaaactgaggcccagaacagggttcgcatcactaggtagtggtggaggggtgagaatcttctctcctaactagtatgcaccacaggctctcctcccactgccccaggcaagctcatccttgtatcgtttcaccttcctagaaaggggcatcttgaagtcatcatgcccccataaggctcctttgttatctcaggaccacatcagccctaatgggggccttgaaagggcctcaggctcactcctctactaactctgctcataaattggcaaagactgcttgattctccctgcttccaacacccttctggactacaggaagagatacagagagcaggatggctttcagacacctaggttgagaacagaaagaagggaaaaaagagagaggggtgttccgacattcaccggcacagcgctaggtcagaagcagccccattctccactgcagggtagctctgggtcaaggcatggaggcttaggggtgaccaattagacaggagatctgacaagtaagaagaatgccagttcagagtgcggcgtaaccctgctgctagccctgcctagccctgggagacaaacccaacctcattcccagcccaacctcaacctctccatacaaagccaattagccttaaatagctgctcctaatgacttgaccaacccatcaggacttccacccaaccctgccctgagcagaaacattccaccactcctgggttttaacattaaattaatgagagagatagggaagggggctatctcactttaaaaatcaaggagtccttggggcgctgtggctcatgcctgtaatcccagcactttgggagactgaggaggacagatcacttgagctcaggggttggagaccagcctgggcaacatggtaaaaccccatctctacaaaaaagacaaaaattagccagctgtggtagcacatgcctatagtactagctgctcaggacgctgagatggaaggatcacctgagcccagggaggttaaggctgcagtgagctgtgattgcactactgcactctagcctggtcaacaaagggagaccctgtatcaccaaaaaaaaaaaaaaaaaaaaaaaaaaaaaatcaaggagtctctctagagaatctgctgtttataaacaaataaatgagtaagtaagcctctgccacttgcagagattttgcactttataacatgccttcaaatgcatgatctcatttgatcctcacacagatgaggagcccgggttggagagtcagagccaggagtcaagcccagatccacaatagttggaattgaaattagaatttaaaactctcttagaggctgggtgcagtggctcacacctgtaatctcagcaatttgaaaggccgaggtgggaggattgcttgagcttaggagttcaagaccagcctgagcaatacagtgagacccccatctcatttttgtttaaagtgaaaaaagaaaaaaaaattaagattctcttaggaaacgttctttaatgtggagagtgaatgttgggttgggcaaagcaattgcctttctcttccgtgaagcagcagcttttccagaactgatggtggagagcagaactgcatgcagttggctgttgtaggtggtcaacaaaccttcactgattgagcaatgagcagagcccagtagaaagctgtgggtggagaagtgcacttgtgaaagcataagaaaaatttaaaaacacacacatggacccatcctaaggaatcttatgattggacagaagtttctagaaggcaggagcatagagtgtgggtctgaggctttgtaggagggactatgactacccatggagtccaggtaccctcagtctgtcacacagattctggtttcagagacctaggacatcacggagcactgccagagagaatggctgtgctgtcagctgtcagaacttttcatcctgcctcatggcaaagctccggcaggaaggggcatcaccccatgagaaaagccttagaaatgaatgctatttccttaagagagaagcatccctgcacttggaatggttctgattcagccctggggctgagggaaggggaggagagcaggctcagcttccccacataacttgctcctgggagcatttcctggggaacctcctgttggctctgggagcagcttggctaggcccagaggtttggaatgtaaacgggtcagaggactagtgaaaagataagttcccaaagggtctggtgctgcacatggggatgaggaaggcctgtgtttactgtggatgagaaggcgcgcacagccagcctgctgggtggagctgtgagtaacctgcctgttcctctcacccctgacaatgaagaccagggctgccctggcactgagccaaggaaaccccgccccgcccagcacaggtcacagccacagtgcctcactgcttttgctggaagccctgggcaaattggtgcccagtccctggcatatgctttcggtgacaaaggcaatgaagggatatagaaaaactcccgccagtgctgggagcctccttgggacagggcttctcacagtatgaaagatttctagatcatttctaggcttctgggtgattagaaaataaatttttttttttaaatcagggtcacaaaaattgaggcttttagaaatgtttgttttagaataccaatgctttaactacccccttaatttatatgcaagatgactgttctgttttccagaaaattacagaacttacacaatgttaattcatagttcaccaattacaagtgaagtggggttcagccaacaagactcaagcttaaagttttgcaattaatgccttctctttttaacccttgcaatgtatctctgacaatgttatatccttaacgggagatcaagccaaaaacctaactgcaaggtcctttgtgataggaggccagggaaaatggccttccagacctccttggagaggcctgccttggaagagaccaccttagagggaggtggagaaagacagtctctgccttccttcccttccgccttccttctttccttccaatactcagtgtactgcgtatgggctcatatacgcacacagaggataagtgagtgagtttgcttatgtgcatgggacctgaagaggtgtgtgtgtgagtgtgcagactggatctgctgttaaacagcatcttggccttggcgagccacttcttccttccagtcctcagtttttgcaaatggtggggtctggagttgattggtggatttcaagccatttttagcaaagaaacgtgtcccctgcccctcaacaaatgaatgcttcggctaaacctcaatatatataataggtttttttaaagagagctgctgaggttggcacagggatgggttgagggtaccccagggccatctcctcagtctcctccccacaggggtatgtcacagaaatgaaagcagagttggaaaaccactaggttataggatctttaaggacctttctggatttaaccaggacgctaaggttcatacatcctaacatccctctcatgaagacactgatgattttctcatgctgtgaatgggaggactgagggccagagtggttaagggtcttctctgacaagccccaggactcctgactcggagtccagtgtgctttctttctttctttttttttttttgagaaagagttttgctcttgttgcccaggctggagtgcattggtgcaatctcggctcactgcaacctcctcctcctgggttcaagcgattctcctgcctcagcctcccaagtagctgagattacaggtgtccaacaccacaccctgctaattttttgtatttagtagagatggggtttctccatgttggtcaggctgatctcgaactcctgacctgaagtgatccacccgccttggcctcccaaagtgctgggattacaggcttgtatgccactgtcccaccagccccaatgtgccttttttttttttttttttttttttgagatggagtctcactctgtcacccaggctggagtgcagtggtgcaatctcggctcactgcaaactccgcctcccgggttcacgccattctcctgcctcagcctcccaagtagctgggattacaggcacccgccaccacgcctggctaattttttgtatttttagtagagacagggtttcaccgtgttagccaggatggtctcgatctcctgacctcatgatctgcccaccttggcctcccaaagtgctggattacaggtgtgagccaccgcacctggccaccaatgtgctttctaccagcatgtcccccgccctcttcagagcaggctcaacacatcgagtggctaagccaatggccagggaatccagagcctcaagcccttgttattcccttacctgctgggtacaggcaaacaaggagatgcttccacagctccctgagctctgcccatcttccctagagctctagttctgcccaactctggcttcaaaaacatgacaactagttactgagggcccaaggataatgaccttatgtgtcttctccctgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagcaagctggagaacctgctgctcctggatctccagcacaacaggctgagcgacggcgtcttcaagcccgacaccttccatggcctcaagaacctcatgcagctcaacctggcccacaacatcctgagaaagatgccgcccagggtccccaccgccattcaccagctctacctggacagtaacaagattgagaccatccctaacggatacttcaagagctttcccaatcttgccttcattcggcttaactacaacaagctgacagacaggggactccccaagaactcctttaatatctccaacctgcttgtgctccacctgtcccacaacaggatcagcagtgtgcccgccatcaacaacaggctggaacacctgtacctcaacaacaatagcatcgagagtgagtggggtgggccggggcggggccgaaggcaaggaggttggcttgtgtagcacttccaccctctctagggagactcagggtggggtggtataaaaagcatccactttggcactggacttcaattcatggccttgccacttgctatctgggtgaccttgaaaagatatttgaccagtctgggaagtttcctcatctgtaaagtgagaatggtaacaatatcttctatcacaaaggtgatatgaggatgtaatagtttaatatggagaaagtgcccagaataccatacttggagggtcataggttttcttcctccattcttcctcagccccagttccttggcaactggatctataggtagggtagacatggaatatactcctggacattctgctaaaaacagaacagagacatttaaatacctatcctgaaatgtcctgggtctgccctctgcagaaacctgcccctgtgggaagatgcttcttcccaagcctgagcctgggttttgattcagggtatgcaactggtaaaaatgtggcagtcaggaaaagaaggtctgcatgctggtgctttctgaatctatctggaagggtgcgatgtttaggtgcacttaaggaagagtttgcctaagtgacatttacagggttctggacttggagtatcaattgcagcccaggagaggaggctggaagttgcagttttgcttcaatcaaaaatttcagctcggagcagagcattagcagaaaggtttagaagtgaaataatattttctggtccttgaacaaaatcagcctacattcacagaagggatgcagcagcagaagggaagagagggattgagggaaaagagaaggacccctagaatgatatttggggatccttaggttccaaaccaaagaatgagatggagattgttggtgtctctaccgacaccaacaatgggcgaatagatcgttcactcatttgggataatttcaagaagtaggggaggattttttttttaatcttacaaaaaaaaaatgggaaaaggggaagactgtataattttaccctggagacagcacactaaaataaaacacattacccccaggaagctatgaggccaaaatacagacagaagggataccttgattaataaatggctgataggtctctaccagattgtggaagaacaggttgctggaggatatcccaaccttctaaggttgaagtcagagaactcacacctcacccacatgagcccaccccatccagcctgtctcctgtgccttttacccgacagaatgggctgagtggggcctaggtcagtggggtgattacgttcttcacaatgaccataatgctgccactggtactgtctttaaacagcttacaaaatgcctttgccaacattctctcccctgattacagggcaggcaccactcttaccatttcacagattgaagaactcagcatgagggtggctaggccacagccccaagctcataagagaaaacccccgtgtcagggcccttctgctactccaatggcaaagaagaaagacgaggaaaaggaagaggaagacaattacaatgaagatgatgcctactcttcctcctcctgctcctccataaatgataagtgaggcaaggcttagggagaataaaacagttcatttaaatgctggcatgcctggtgccacaggcatccaacaagatgtgatggaggaaatggaatctcaggccatggacccttcagaatcagtaggctcatcatgtcccgggggttccggagctctccccagatcctctttcctcttcctgtcatccttatttcagttaccatcttttgcccatcctcatgtctcacatccaattcaaaggaaaacctgcagagtaattttcacatccacctactggcttcagatctcaccttactccattgcttctccacagtgtagccggattatctttgtacagcataaacctgaacatagggatctctaaggacccttccagatttaacgctccaggataccatggttcaagtatcctgttaataacatcgctctcacaaagacagtcctgttcactgccattcctcagaccagagatcaaaagcctcttagtgaaagcctaactaccttcccagcttactctccttagtacatcacattgggcactattactattcccagattcgcccacaagcagaattttggcctccacaacttcattcaaacagattcctctatcagaacaccatcccccaggtctccacctgttgtaattctacctattcttgaaggcccagttcaaaatttacttccaattctctagagttaacttgcaataacagttgttgatcaattccaacttaattcattttacaaatgagtaaactgagcctggaggtcaaggcagctcatctatgatcacacattcccaaagctagccagtttcagagagaagtctacagtccttgctctcgggtgtcttcccccttccccttcctcatcttggccgccagcctccactcccttctgatttctcgtcttctttttccgtagaaatcaacggaacccagatttgccccaacgacctagtggcgttccatgacttctcctcggacctggagaacgtgccacacctgcgctacctgcggctggatggaaactacttgaagccgcccatcccgctggacctcatgatgtgcttccgcctcctgcagtccgtggtcatctaggccctactccgccaccggatctgctctgaccgcacttgaaggctggggcccaggcacctgtgccggccattcgttttctctctctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagccatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaacaccctgcgtgaactcaacggtgtgaacaggtcaagaataacacttcaaagtcatcttgccagccaggcgtggtggatcacgcctgtaatcccagcactctgggaggccaaagcgggcagatcacctgaggtcaggagttcaagaccagcctggccaacatagtgaaaccccttgtttactcaaaatacaaaaattggctgggtgcggtggtacatgcctgtagtcccagctacttgggaggctgaggcaggagaattgcttgaaccctggaggcagaagttgcagtgagccgagatcgcaccactgcactccagcctaggagacaaaacgagacttcatttaaaaaaaataaaaataaaaataaaaataaagtcatcttgccacccaccccctaccattgagccaccatgcccagccccaaagcctcttaattgctctaacaagatgagtggggaaaagattatactcttaagaaattcctacgaaagctatccaaaagccttttctttcctcttttcttattatttttaaatagaggcagggtctcattatgttgcccaggctggtctggaactcctggcctcaagtgatcctcccaccttggcctccccagagtgctgggattacacacgtgagtcaccatgcccagccccaaagccatttcttgaagaatttctcgcaaactcacaaccctcatgaaaaattaatcctcagttccacgagactgcccacccacagacaaaaaaatatatatattcctaaagtcggaccagaaatctgacagctgcctttgaaacccaaagcctcgggttctttcaagctacatgtactaaattgtcgaaggtctcccaggagctctgtactgaggcagacacagaaagacacaaaacggtcgtctttcctgcccaagtaaagcttacagactaactggggagatgtagtgtgcatacaaaacagtaaaagagccatctcaaggacagagagcatagaccaagtcatctggaatggtctacatgccatgcggaagtccaccgaagggttagaacagggtgtcccagactctctcttctgagggaaggttggttgcaaaagtgggattcatgaccctcccaggctacaccatcttctttagaatgagaactgccaggtgacgccctcgctgctcctacctggctactaaacatcgacttcggttcacttcacggatgttcagtggatatcggtcacatgccaggtccccagctacgcattcaaggatggataatatacatagcagcacatccttgaggaactcataccttggtaaagggaaagaaatccatgaatggatacctctgtgtcctaagtgtttgtaataatgctgtgtgtcaggcctctgagcccaagctaagccatcatatcccctgtgacctgcatgtgcacatccagacggctggttcctaccttaactgatgatattccaccacaaaagaagtgaaaatggctggtccctgccttaactgatgacattaccttgtgaaattccttctcctggctcatcctggctcaaaagctcccccactgaacaccttgcaacccccacccctggccaccagagaacaaccccctttgactgtaattttccattacctacccacatcttataaaatggccccatccctatctcccttcgctgactcttttcggactcagcccgcctgcacccaggtgaaataaacagccttgttgctcacac

SEQ ID NO: 36562 - DNA, 39666 bp, Homo sapiens
ggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccggtaacgcgcgtcttggtcccgcctcccaggagcccctatgcgcccacctactcccggcccctcggcttccggaacccgcccgagcccgaagcgcctcttccgaggcgcgggatttcctccccggctgcggctgggacgggggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctggtgccagcgtgggggaggggggttacgcccccggcgctctcctgccctccctgggagtggggacccacacagaaacgggtcactgttacacccgggttctggtgtccgccatatggctgttgagagacgcctcagaaccacctgtgggacggatgggcagcgatgcccgccctgggcctagaggaacacctgggtcccaggcccaaaaccacgtccgccgcccactcttccccgtgcaccgcgagtggaggctgttctgcctttccacttgcttaacatccagtctgtgaagatctaaataaataacgtggaaaatgcaaagtataatgtactaagtgaaagaactcgagcacactgggggtccacgaagctgcagctgcagcccagggtggcacatcggcgagacggtggtgcgcgcctccaatctcggagggcgcccaaaatggaaaatgtttttaggccagggagtgagcataaacattagtgtttttgtggtcatgtagcaaattagggcagaggagagttatttaaaagtgagtttaaaaactgatttcctttcttttgtagataaagaacaggaaaaagagaaaaaatcagtggtaagtccctcttttatgtgtactctctaggataatttggttttttgaagaggagagagaaaaaagcagagtaaaaagcaaaaatacattccatagtaaaaagcaaaaatacaagaggatctccagggagaaggaagtctgtcaccctcctagaaggccacctctgttaccaatttcttgtatctttccccagagtctgcacagataggagcacacaagtatttgtatccttcaggtagatttgggctgttaaagcttaagggatgattgtgaaaggatttgaaaaacgctcattgtgttgtggggaaggtcagtttcatcttgggttgggcagctcagatgtgagggaagctctgtccaccaccaccctctccccccagtgttgagactggtgggtgggcaggggatcagagagaaaccattagggtccacagatgtgggttcagttatcagggtggctttgagatgctggctctgggctggggctgtgactagtgtgaggctgaaggtcaaagaagggtcaggttggtgtccatggggatattgggtgctttagctggctggggtagggagtgatattttggtcacaaaccaaggctcaattccttaaaagaactgaaagtccctagctccagtggctgggaagggggtggcttggcaagtggtggcaggagtaccgtggctgggatctgcagagggtagacagtgcgggcaggcccccagcgtactcagggtggtggagagctcttgggaagtagtgaaaccacatagagaggattgaaatgcttgagatttgtggaagtttgttgaaattaggagaaggatatgccagcgggtgccatagaaggggagggaaatgcaaagttgagctggatggtaattaatgtatttttgtttgtttatacatttaagagacggcgtcttgctgtgttgcccaggctggcctccaactcctgggctcaagtgatcctctggcatcagcctcctgagtagctgtgatgacaagtgtgagccactgtgcctggctatttattagttattgagctagcattgatgtgagctgggcctgttctttgtgctttttgggtgtggtttgatgtgcccccagacacacaatagctagttcatagaaagtggtatggagcctgcattcaggctcaggactgtttgtaaacattcaagtcctgtgagctcctgtgtgggatgcactgggctaggacctgggcacctggcaaacagccctgacatttgggagtctgcggtctgtctgatgggggaggtttgtctgatgggggaggtctgtctgatgggggagacagcagtaactaggagaatggtggaactagaacagcagtgagtatggtggctgtgagtaggggggctgatgactgagaggagctttgggaagccttattgcctgctgggagatggagcagagtttgaggcaggagtgttggaacaggtacaagtcacagaagaatgagaacctgcaggcctgggcttgtggccagtccctagagaggtggctggggagggctgggggataggtgcagagggactgagaataggtcctaaaacccagagtcactgaagggcctcacccccacccagcacgatccgggttgcctctcagggagcgatgtggggaaccatgagtggagggcctaactgggtgagactggaaggggagagaccttaactaaactagagatggcacagagcccgcagctgagtgggaaagcagggcccaggggagttgctggttggttgactggtgttggtgggtgaggagagatgtccagagtgttaaaggtgtctgggtggatggtgcagccattacatggcacagtttacaatattagataattgagtatcacaacaaagttttttaataaaataactggacagaacttaacatccaacagggccatacctaatggctcatgcctataatcccagcacttcgggaggcaaaggtgggaggattgcttgagctcaggagtctgagaccagcctgggcaacatggcaaaatgctgtttctacaaaaaatacaaaaaattagctgggcatggtggcatgcaccagtagtcctagctactcgggaggctgaggtgggagggttgcttgagcctgggaggtcaaggctgcagtgagctgttattgcattgctgcactccatcgtgggcaacagaacgagaccctgtctcaaaaaaaaaaaaaaaatcaaatagtagggagttcaataaattgtgacaggtcttatataatggattatgtaaagccattaaaaaccatgtttttgaaaaatatttagtgacctgggaaggcactcactatgtaaaagatgaaaaaaaaaaataacaaaaccaacaaaagtatatgaagtatgatcccaaatgaaaaaaaaaactgtccttaggaaacaaacaggaaagaaatattataaacattaatgccgaaattctcagtctagttaagagatagatgtggggttaacaaggagcatgtaagagagagtttgtggtgtgatggggtaaaagtgtcttcccttagttatttgaatgttaaatgaaattcagctgggttcctttttaaaacagctttattgtaatttgcataccacaaaattcacccatttaaatgtgcaattcaatgatttttagtaaatttacagagtaaacagcactacagagtaaacaccactacaatctaattttattttattttatttttattttttattttttgagacaaggtctggctctgttgtccaggctggaggacagtggcacaatcacaacttactgcagccttgacttcctggtctcaggtgatcctcccacatcagcctcccaagtagctgggactacaggcacataccaccattcctggctaatttttgtatttgttgtagagatgggatttctacatgttgcccaggctgtgcaatctaattttataacatttccattactccaaaaagaaaccttgtgcccatttgcaatctcttctggccccaggtgaccactaatctacttcctgtctctttagggatttgtgttttctggacgttccatataaaatggaacatatagcgtgggatcttttgtatctggcttctttcacttagcacattttttttttttcttttttgagatggagtttctctctgttgcccaggctggagtgcaatggcatgatcttggctcactgcaacctccgccgccagggttcaagccattttcctgcctcagcctcccaagtagctgggattacagtcatgtgccaccacgtgcagctaatttttgtatttttagtagagtcggggtttcaccacgttagccaggctggtctcgaactcctaacctcaggtgatccgcctgtctaggcctcccaaagtgctgggattacaggcgtgagccaccgctcctggttgcttagcataatattttgacatgcatctgccttgtagcacgtattagtatgtcattttttcctatagctgaatagtattcatggcgtggctgtagtgcactttgtttatccacttgccagttgttagacgtttgggcaagtttcttttgactgcagatttctcagggtctttgataagacaggatatttggattctccctgtggaggctttggcacccaagccagtttgcctctggaaccctgggttctaattaaacatccaaatgacaatgattgctgagatttacgagtgatttttattttcttcttttagggattgtgtaataaggtttgatcagagaaatccaactgataaatacatatatgcatattcataaacatatacatatattcatgcatacatacattcttgtgtgtgagaatgtatttctttttttttttttttttgaagacagggtctcactctgtcacccagactggagtgcagtggtgtgatctcggctcaccacaacctccacctctcagctcccaagctcaagcgattctcttgcatcagcctccccagtagctgggattacaggcatccgccaccacgcctggctaatttttgtatttttagtagagacggggtttcaccatgttggccaggctggtcttgatctcctgacctcaaatgatcccctgcctcggcctcccaaaatgctgggattacaggcgtgagccactgcgcctggccactgagaatgtatttcttagcacaagaatgcttaatttccatttttaggaaagattaaatattgttacttataatagggatagatggctcatcacagtttcagttataatcatggaaaattggactcaagggctcatagcagaggaaaatggagataaattgtagcgtaatcacagagtgttgggccaggccggccatgtgctcccacagcatggggaccatctccttttcacagtttcctgttgctttcctccacacactcatgagctctttggccgttgcaacgaggccctgagtacacagtgcctggcacagcataggccttcaataaacagttgaaacgtgctcaaagatgaggactgtatagaaaataatatttggcatgaaatatgctcatatgtcatggggtttatctcttagtattgggattatgggtgatagtttctcctttttgattttctgtattttcttcaatgggcatgcacttctcttataatatttttagacatcactttaaaaagaaatgtaaagactccctttgcttgcttcctgttcccccttccatttcaggggaactttgtgagattcttcctgcgttgcctgctgtaaaccggagggcagattggctgagctcattcagggcctgacattcaccagctcttcaggatttcatgctggggataggaacaagtttctgggagaagggcttatctgaacaacctgttaaaatgcttcaatgaacaggaaagaaaaaagactgtagagtgatgtctaggttgagctctttttatatatctaggaagaggaaaagttttctttaaagagcaataaaaaaattaaatccattagtgccctaatggggtcttttcatgcccttttgttcattcccttgggttcattttgtagtttggggctctaaaggagtgggctgggagggacccaggatgggagagtggccttgtgtctcctggatacccgttaggatcaaggcaggaggaaccttctccgccagctgacagagttctagttgctggggagactttagtggggtcgggtgagacggcccactgtgacctggtgtttatgtgaggtgtgactgaggctccatcaggagtcgtgagaaggggcctggatgtgaattctaattctgattcttccctagccaagtctggcacttgggtaagttacctgtgttgcccaggtttctctgggtgcttccagcctgagtgcaaaggaacaggcctctgtgcagcaggtcgggcccctctctgtgtgtgcccctggaggatgtctaatgtgttctcaggggacagtttgtcttatgtattggagctgcccgttccctgtggccatctgctggagccagagccactgggcctatgtcatcagcagtgcctggctgagcagagcttggtcagaatcactgggctacaggttcaagggctccagcctagagtctgatttagggtctggatgctacctggtgccacctcatgtttaaccagctcctctggtgcatctgaagcaggcatctgtggactagacagggagaagctctgctccagcctcgtggttcccatccttgcctgcacattgaaatcgcctggagagctttaaaagttactgaggcttggccgggtgcagtggctcacgcctgtaatcccagcactttgggaggctgaggcgggtggatcacctgaggtcgggagtttgagaccagcctggcctacatggtgaaaccatgtctctactaaaaatacaaaaaattagccgggtgtggtggtgggcacctgtaatcccagctactcgggaggctgaggcaggagaatggcttgaacccaggaggtggaggttgcagtgagctgagatcacgccactgtgctccagcctgggcaacaagagtgaaactctgtctcaaagaaaaaaaaagttactgagtcttgagtctcactcccagagattgtggtgtaattggtctgggctgtggcatccctgtagagatttttaaaaggtcccaggtggtcctagcgtatagccagagctgagaaccgctgcctggaataccttctctccctaagatgagttacttctaggatgctccttggtctttggtataggtagacccagaaggctgtttctggcccctcccactagtgccatgaccccctttccctcccacgtgcagtcattgtgagcagagtctaggttcaagctgtccttgctttattgtcttctacaagcctcatttttgttttctgtgaaaaatgttaggacttacccttctcaggtttcagtgaggttacatgtgataatggtgtgttacctgtctcagggcttggcctgtgacaaggtgcttaacaaagtccttgctctttttttcttctcccctttcctaatggtttccagtcagtgaccaagtgctttttttttctgtaaagcagtgaattcgattctagataacatatatgtgtttcctagcctcaaagccattgattaagctctcgttaaggaggcaggacacttaggcctaaaatctaatagtctgtggggttgaactaaggaagggcagagctgggctgggcagacaagctgtgtatggtttaggagttgacgtaaaggaggatctggtctggggggaccacatgagcctgccactcagggaggatcggcttatctgttattactaacaatgggaccttgccagtttcccgaggagggattttggtttacatgtgaaagtcttggactgaaccaattatgctggttacatgagccctttccgtagccattattccctgacattcccctgggtgcttgagttctggctctaatatgcattcgtcttttgccagatctgtgtcgagggcaatattgcaagtgggaagacgacatgcctggaattcttctccaacgcgacagacgtcgaggtacagcctctatgctaggtttgaaggaagcggagaaagcttgatgggataatttatagagggtgtggactaaccttgtccaataggactataatttgagccacaagtgcaagccacaggtgtaatttaacatttctaatatcctcattaaaaaaacaaaaggggccggtgcagtggctcaagcctgtaatcctagcactttgggaggcggaagcaggtggattgcttgagcccaggagttccagaccagcctgggccacatggcgagaccccatctctacaaaaatatgccaggcatggtggtacgtgcctgtagctccagctacttgggaggctgaggtgggaggattgcttaagcccaggaggtggaggttgcagtgagctgagatcacgccattgcattgcatcctgagcagcaggagtgaaaccctgtctcaaaaaaagaaaaaaacccacaaaaaataaaaaggacattttatttcacataacatatgccaaatgtgatcatgtcaacatttaatcaatataaaaatcatcaatgagctattttgcattctatcttgttatactaagtctttggaatatgatactggttgagcatcccttatctgaaatgcttgagaccagaagtgttttagatttcagaatttttcagattttggaatatttgcataaatgtaatgagatatcttgaggatgggacccaagccaaaacacgaaattcatttatgtttcatatatacatagcctgaaggtaattttatacaatattttaaataattttgtgaatgaaacaagtttgtgttaagtatttatgtgtggaatttttcatttgaagtgtcatatcggtttccagaaagttttggagtttggagcatttaggattttggatttttcaattagggatgctcaaactgtttgtatttgtaaaataagtgtaacttatagcatatcttaatttggactactcatatttcaaggtcttaatagttgcctgtggctcatggccactgtattggacagtgcaagtgttgactgcctcaaagtctggttaggaaaagagtctacatgggtaagaagaaaggacaggctattgagcagggctagaagtgtgacatctgagatagcaatgtctgagcagtgggtattactatgcataggcaattaatttaatttctagttcatttaaagcctagtcactaaaactaacctcagagatgtttaagaatcatctctacactaagacattgacctgtcttccttgttctagattttagtggtataatcttctctattgatggctctcttttgttactacagaagctacaatttctatacttttatagtcattttctttccttcttcccttcctttcctgtttttacttctgctagaaatatatgcatggccaggtgtggtggctgatgcctgtaatcccagcactttaggaggctgaagggggaggatcacctgagcccagtagtttaagagtagcctggccaacatgacaaaaccacatgtctacaaaaaatacaaaacttagctggatgtggtggcacatgcctgtagtcccagctgctcaagaggctgaggtgggaggattatttaagcccaggaggttgaggctgtggtgagccaggactgtgccgttgaactccaacctgggtgacagagtgaggccctgtctcaaaaaaaaaaaaaaaaagaaaaaagaaagaaagaaaagaaatatatatagtttgataaaaataataataaacattatatagcccttgtcctgctgtgttcatgtgctgctgtgcaggaaagagttaacatagcagacctaagactgctgccctttagaaatgcctgcttgcaagggtggtctttggctggcatctgggaacttagatcttgggagggcccccaccattcctaactgataacagtggctctctgcttaaattgtttctgcaaacagtatggtttatgctgacacctgctttcttcctgggagtccggaattttggtacatgtcaggaagtggttgtctgcatggctgagcgctgatgaaaaccctgaactcccaggttcaggccagcttgcctgctagacaacatttcacatgtattgtcacatcttgttgcctggggaattcagtgtgtactgtgcagctcctctatgagaggacccttggaagcttgtgcctggtttcctccagactttgcacctgccctttttccctttgctgatccttttttctttttcttccttttttttttttttttttttttctgagatggagtcttgctctgtcacccaggctggagtgcagtggcatgatctcggctcactgcaacctccgcctcctgggttcaagcaattctcctgcttcagcctcccaagtagctgggattacaagcacccaccaccatgcccagctaatttttttgtatttttagtagagatggggtttcaccatgttggccaggctggtttcaaactcctgacctcaagtgatccacccacctcagcctcccaaagtgctgggattacaggcgtgagccaccgtgcccggtcccctttgctgatcttgttttgtgtcctttcggtgtaatccatcttagctgtgagtatgactgcgtgttgtgtcctgtgagttctcatgaatcatcaaacctggggaggagggggggcttggggactcttgacccctgtcctgagtgatatgactcttaatggcactttagaagtgcttatagtctcactgaagaccttggacccgattaacaacgatagttaacatccagtgagtatactgctatttgcccaacactgtgttgagggttcatcataaatactaaatgatctcaccctcacaagaatagtccctctgaagtaggtaccatttttaccacagttttagatgaggaaaccatggcctaatgaggttaagtggcttgtccagggtcgctaggccagtgtatgatacagccagatcccagcccggatacagccagatcccagcccaggctgtctggttccaggggccacacccttgtttgattctgtggtacgaagagctttgttggctttaggaagaccactctcccttcagatctgagctccgtgtcccctgaccttcccagcgaggttatgcttcctgacagaggatcccctggccgctctgtacctctcttttataccacttcttggggtttgaaaacatgttggcttctgtgattacctgagtaatgtctgcttcccctggtaggcttaaggttctgtgaaggcagaggctgggctggttttgctattgttgtgtcctcagtgcctagcatggatatctggcacacagtgggcactcaataaatgtttgttgggtgacagtgctatggatggagcacccctgagctgggtcggggagcaaggctgcctgtgacccagactctggtgggcctgtgtggtgctgtgtatgctacttaggggctaggaagaagacctagaagaaggagagggggtttgagaggggcaggggaagggcatatttgaactggattttgaagggtatacaggagttttccatgtgatgaaagttgatgtgaagtggaatggggtgggaatgctggtcagaagaaacaacgtaagcaaagacacagagtatcttgcttgagggtggatcacttgaggtcaggagtgaagggtggggggtgattacttttcttttctttttagagacggagtcttgctctgtcacccaggctggagtgcagtagcgcgatcttggctcactgcaacctttgcctcctgggttcaagtgattctcctgcctcagcctcccgagtatctgggattacaggcatgcaccactacatccggctaatttttgtatttttagtagagatggggtttcaccatgttggccaggctggacttgaactcctgacctcaagtgatctgcctgccttggcctcccaaagtgctgggattacaggtgtgagccactgcacccagccagggtggctacttttcaagagttccatgcattgcctgccattggtcttttgtcacctatggccccttctcacatgtactctgaaagttcccagatggatcctggcactctgaagatcttggccccaagaacaccatttaaatcttttctagcacacacctgcatacccagaaaggctctagcagagtctggggttgtcccagatttgtgtgtctagaccacagatggaggctctagaaatgcccagcagagatcctgatatgtgtctgaaaacacacaggatgttggagagattggcagtcatcctaaaaggtacaaacaggaccagagggaaagaatgcctccaaaccagtgagacagggagcgtactaaagaaacagggactatcagcagccagtgcacccagtgcagtgatcagaggcaggaaacggaggcaggtggcctgccaaggcctagccctgtccagtgtccctcctggcttctcccacccacctgccagcttgatgtggtaggcaggcaggggtgggatagaatacacagaagagggatggacagagccagctctgaccttggggaggctaccagggcaatagagaggtaggatgtacctatgcttggcacattgggtaacatggatagagttattctcaggacatttctggaagtaatgtgaggaagccgtgtctagatagagttgtgacctcacgggggttgtcagctattttggcctaccttgggcacccaaatttggatagtctttttctctctttttcccttctctcctcactttcccctcaacacttacacacttttacagggttcagcacagagaaacagtagctctgatgttttctttccttccaggtgttaacggagcctgtgtccaagtggagaaatgtccgtggccacaatcctctggtgagtgggttgttggttgcatgaacccccggcttccccttaagcacctgagaatgatggtgcctctgcctgagccctgcctgcccaggcattctctgcgctcttaactgagttggagaagaccagggagggacaagcagaaaatggtggcatgttggtgttctgaggtcaaggatctctgaggcctgagtggctgtgcacagagcctagggacttcccgtcagctatcccatactattcccagtggccgaccttagccactaggggtgtccatttcttgttgctcattccagccttcccctcccctagaagaaacctatcagaacccgggacttctcaggcctaacccccccaggacctatctctaagtaaccaggatccttggtggacccctgacttgggtttgcaaacttggccctgtctggtaacaggggccacctctggcttacctggaagccaccagcctgctttcccaagggtgaacctagcaacaggggctgtagtgtgctgtgtcccttccttcaccttccccaattcgaggttctgctctggttgcttgaaagagatggatagaatctgggtcctgcaagagagagctttagaagaggatgttggttctgagctcccatcccatgaggtagggatgattagtctcatttttcagcttaggaaattgcacttatataagttgcctgaggtcacacagctagtaaatggacttggaagcctgtgctgccctgtgattttttttttttttttttgagatggagtctcagtctgtccctaggctggagtgcagtggcgcgatctcggctcactgcaacctctgtctcccaggttcaagcgattctcctgcctcactctcctgactagctgggactacaggtgcgcacgaccatgcccagctaatttttgtgtttttagtagagacagggttttaccatgttggccaggatggtctccatctcctgaccctcatgagccacccacctcagcctcccaaagtgctgggattacgggcgtgagccactgtgcccggccatgccctctgatttttagcaacacaattggcatctcctgtgtggttcattagactctgagttctactaggagcagggactgtatctactttgttcattgttatttgctaaaaccaaggcacactgcctagcacttagtaggggcttgtgcattcatccattcattcaaccaatattcagtgcatgtcagccatgtggcagacactgttctggatgatatggcagtgataaattcaaagcccttgctctcctgcccctaatattccagtgtggggaggcagaagtcaaacatataatctggcgggtggtgatagggcctaggaagaaaactaaagcaggtgaaaggatgtttcttaaataaggcaaaacctctcagtctttcaataaagaatcctaaagagacatgagaagaatttcttctctgtgcattcgggagaagatggaataccagtcatcttctttggatataacaaagaaacctctgtaacattcatattctctagaagccaaggaggaacccaggcttagttattaagtaagacagctagagttgcaggtgttagggatcataagtgacgtttcacgggacagaatcacagcctcagaagtcttagtgtccttggtacagatagccttttcaatgagagtttcctaataaaaaatacaatagaagtagccatttttatataagtttccactctagaccaaaagaaagatcgatacttttgtgaaaaatctcaattcatcactttatctgaattggttttctgatgcagaaaggtgactgtttctgcggccatcaggcaagagggagtgtttctcctagcctttatgagattttctctcaactgcagtcagaggagtctgcagttctcaatgaagaacactggagtttcattagtttgcaccaagagaaaaatgaaaagcaaaaatgaggaaaaggccgggtgtggtggctcatgcctgtaatcccagcactttgggaggccaagatcagaggatcacttaaagccaggagtttgagacaaccctggtcaacataatgagacctccatctctaaaagaaataaaagtaaataaaattaatttaaaaatgaggaaaggagcagaacaggtttcttagcaagtatgctggagcatgaagtgttttgcttctagaagggatggagagtgattgagtaggtgggttggcttctgttttacatgagataaccagggaatgtgtctatgataaggtgcttaaacatgagggtgtgagcactgcagatatctggatgaagagtgtttaggcagaaggcgctgcagaggcaaaggccctgagatgggaccatgcttggcatgtttgaggaatgctaagtaagctcatgtggttggaagccaaccaggccagagggagatgggtaggagatgagagaaagccttgtgggccatgataagggtttggatttcattctgcatgcaatgggaagccactggaaggttctgagcaggggagtggcaagaactgatttaggtttcacagactcactcttgtggctggatagagaacagactacagagggctcaaagaccattcactgaacgacttgaacgcatgttccttggtgattttattttattttttgaatttccaaagaaaagtaatttattttttgcagttagggcagctgagaagtccagggttgaaggggtgcatctgctgagggctttcttgctagtggggactcttcagagtccccaggtggtacagggtgtcacatggtgagggagttgagcatgctaggtcaggtctctctcccttttctcataaagccaccagtgtaagataacccattaatctattaatccgtgaatagattaatccattcaagagggctctgtactcatgatccaatcttttttttttttttttttttgagacagagtctcactctgtcgcccaggctggagtgcagtggcgcgatctcggctcactgcaagctccgcctcctgggttcgcgccattctcctgcctcagcctcccgagtagctgggactacaggcgcccaccaccacacctggctaattttttgtattttttagtagagacaggatttcaccgtgttagccaggatggtctccatctcctgacctcgtgatccgcgcacctcggcctcccagagtgctgggattacagacgtgagccaccatgcccggccgatccagtcatttcttaaaggcaccacctgctacatactgccacatgggggattaagtttccaacacatgaaatttaggggattcattcaaaccaaagtattatttgttaaagatgatcttaaagagcttaacttctttaaaaattttaaacttatttatttatttatttattttggagatagggtcttgctatatcacccaagctggagtgcagtggcacaattatagctcactgtaacctttaactcctgggctcaagtgatcctcctgccttgggctcccaaagtgctgggattataggcatgagccactgcacctggctctcttttctttatgctagaaacattcaaattattctcttatagctttttttttttttttttttttttgagatggagtctcgctctgtcacccaggctggagtacagtggcatgatctgcctggccagcatggtgaaaccccgtctctactaaaaatacaaaaaaatttagctgggtgtggtggtgcatgcctgtgatcctagctacttgggaggctgaggcaggagaatcgcttgaacccagaaggtagaggttgcggtgagctgagatcatgccactgcacttcagtctgggtgacagagcaagactctgtttaaaaaaaaaaaaagatttttatcaaaaagacaggtgataggtgtggagaaaggggaaccctcatacatagttggtgggaatgtaaattagtacagctactatagagaacagttatgaagtcaggcagtgtgatgcctccaactttgttttttttgctcaggattgctttggctatttggggtcttttgtggtttcatatcaattttaggattttttttttccctatttttgcaaagactgtcataggtattttgatagagattacattgaatctgtaaattgctttgggtagtattgtcattttaatagtattagttcttctgatccatgagtgttgaatatctctttttttgtgtgtgttctgttcaatttctttcatcagtgttttatagttttccttgtatagatctttcacttctttggttaaatagattcctaggtattttacttttattaattaattaattaatttattttttttttcgagacagggtctcactctgtcatccaggctggagtacagtggtacgatctcggcccactgcagcctctgcctcctgggttcaagcgattctcatgtctcagcctctagagtagctaggaccacaggtgcgtgccaccacacccagctaattttttgtatttttaatagagacaggatttcgtcatgttggccaggctggtcttgaactcctggccttgagtgatctgcctgcctcaacctcccaaagtgctgggattacaggcatgagccactgtgcctggctggtattttatattctttgtagcatcgcaaatgggattcctttcttgatttctttctcaggttgttcactgttggtgtatatacatgctactgatttttatatgttgatttgtatcctgtggtattactgagttcgttcatcagttctaacagttgtttggtggagtctttaaggttttttttttttttttttggtcatttcaacttttattttacttttagcggggtacatgtgcaggtttgttacctgggtatatttcatgatgctgaggtttagggtatgatggatcccatcacctaggtactgagcatagtacccaataggtactttttcaacctttgccccctcccttcctccccactctaggagtccccagtgtctattgttgccatctttatgtccatgagtacccattgtacccacttataaatatccacttaaagtgagaacatgcagtatttggttttctgttcctgcattaattagcttaggataatggcctgagtctttaagcttttctaagtgtaagatcatgttgtccgtgaacaaggttaagatgacttcttcctttccaatttggatgcccttcatttctttgtctggcctaattcctccggtccctcggagactttccataggctcctattatagctgttaccatactgtcctataattgtttcagtgtctgcctttgtccaccctgctgtcagagccctgtgatcatgctgggtttatctccagccccaaccctgcctgtgtaggtttcttgagctgtccttcagtgccttgtgagaccagggtcctcctgcagatgccactttgatggaaagtgctgtgttttcccttctgcagggcctgatgtaccacgatgcctctcgctggggtcttacgctacagacttatgtgcagctcaccatgctggacaggcatactcgtcctcaggtaggtttcagatgctcagtttcagccttcttaaacgttttcttcagacttggggtatgtgattgccaggaagggaaactttacaaggaagccaggctaggccttcagtgctgtgcaggcctctctgtgtggggccaaggtctctggcttctgtggttctcttctgacctgcctctagtgcccccacctgcaaacctcagccagccaggtggtgcccctgccaccattctgagctcacatctttatgacctgaccactgctgggcttaatgccgtttaactcagttcttctcaaagtgtggtccctggaccagcagcggaagcatcacctggaaacttgttagaaatgcacattttcagctgggtgtggtggatcccacctgtaatcccagcactttgggaggctgaggcatgcggatcacctgaggtcaggagttcaagaccagcctggccaacatggtgaaaccccatctctactaaaaaatacaaaaattagtctggcgtggtggtatgtgtgtgcctataatcccagccacttgggaggctgaggcaggagaatggcttgaacccaggaggcggaggttgcagtgagctgagatcataccactgcactccagcctgggtgacagagtgagactctgtctcaaaaaaaaaaaaaaagaaagaaatgcaaattttctagtcacatcccagacctgctgaattagaaattctagggatgaggcccagcaatctgtgttttatcaagccctccaggtgactcgaatgcatgctttgtttgttttcatatttgagaaccacttatttaaccttcatggggtctggctcttagttcaaattcttgagacaaagaatctgattggttcagctttggtcaggtgtccagccctggttcaatcaggtgttggggacaggaccccaaggcacaaacatggctgcttaggcctattccatcagtgaggatgcatctagagacagagtctcttagaagaaagggggctgtggaggtcctgatcagcacctatgtttcaaagctgtaagcacaacctatgatgccagctttaaggctctgcatgaaggagacagactgtccctacagccagttaacactggcacagctgctgggctggacagttcggtcccagtctgggtacctgcagcaatagctaccattcttctgtaagtctgtcttttaaaattgaaagatgtgagtgggccgtttttggtgaataagaatttccatctccccaaatatctgtctaaattgcacaaatccacaaatcgaaagatctgaggttagtgcattttgcctttgctaatttgcttttcctgagcaggcactcaattgcaaacctaagttgtatctaatgatatttgaataggaagggatataaatgcactcctctatttaaggaaatctacctcaggaggcagagagagatggacagaccaggaaagatgagcagaaggagaccagagggatgaatggggagctaggaagtaaggaaagagaggatggaagaatggaaaggaagatggatgggcagaggatggatggacagagggacagcagggagagggaggaagtgcctgggttatggctttgaatctgccttggatttgttggcccaggtcccatgggtgctgtgggccatggccaagtgagagtagtgttagtgtgcctggcatcaagggtcagggcgcctcttgcttcccagaggaacgctggacaaagggcaaggtcgtctgcagagggtttgagcatcctggcagaaaggggcactgtcaggctgtcttcctccctcttgggcatcgttcttaccagtttccttgggcagagcccccagaacgtcacccccaacccgaccctcttggggctgtacctcatgcatgtggtccctctgcttaagcaaactcaccctatttaggtccgtggtagtcaccacatgttgcctcaagtggacagctttggatggtttctccagggcttgaccgtgttctagttgagactcacctgccatcaaagaggcagctgctgatgagccctcagcctcggcattgctgggccatgcatgcagctttggggtgtggggcaggtcagggtggaagggggacacagcctgagcctggtggcagatgtggcttctcctcccggcaggggagtgaggaggtcctcctgcttcactctctctgccgccttgattctcatattcagcaaagtccccaggcagggggagtaacagacatttctcaaggcctcctggctgtctccttttcccctgagttagtgattctctttttgttttcctttaggtgtcatctgtacggttgatggagaggtcgattcacagcgcaagatacatttttgtagaaaacctgtatagaaggtactgtagtttgaatagttgataatttattaaaccactaatttttcaaaatgaaatagaaacttgtttattcgattgacagatatggagtacccgctgttgtatcagttatccattgccatagcaatgcggtgtaacaaacagccacgaatcctcatggcagacagctatctgcattcattgcccagtcagccagggtggtcaccaggcagctctgcttaccttggctaggctcaatgagatgtctggggatcagccgatgtaggatagcctaagcaagggtgactggaggtggctcatctcttttcctcttgcctgtcactctccttctgggaccagcaaaccagcccaggtgtccacttctcacggtgacaaagggtagaagcaacagcagagatgcaaggacatatttttcaggcctctgctccaagtttgctagcattccattggccaaagcagatcacatggtcacatgagcccagggtggaaaggtgggagggtccagtgagttacacagcatggtacaaggctaaagggaagggtggagagttgggcgagtcagacgcacagtgtgcgtcgcatttgttgtgtttttcactaaaagcttccctcatgagagcagactctgtgatgtatacctagttaggggcttctggtggcctgtcagtgccaagggctcaggcatggggccctccatccctgtgctcagagactgccgatttctaggggtcttggaaatgggttgcagaccccacctgtccctgccgcgagcttgggatactgctgtccttccctcgcagagctgttcggatgtcaacgctggaggcccttcctcccactctcatctgcagctgtcttcctaaatgccaccctgtctcccagccctccccgaccacgctgtctagatagggcaagctccttgttagtctttgtttcgtttttggttttggtttttgttttttgaggcagggtctggctctatcacccaagctggagtacgggggcacgatctcagctcactgcaacctccgtctctcaggctcaagccatcgtcctgcctcagcctcccgagtagctgggactacaggcacacaccaccacacctggctattttttttgtatttttagtagaggcaggatttcgtcatattgcccaggttggtcttgaactcctgggctcaagtgatcctcctgccttggcctcccaaagtgctgggattataggtgtgagccactgtgcctggtccccttgttattcttaaggactactttctgttagttttctttgtagtatttaaggcaatcatatgaaattgtttaaccaattatgacctacaaaaatggcagttttgtgtggttcaacttagtatgtgtctaattgtttattgccacccacccccccggaccataagctcctaagggcaggcaccaagtttgttgtccttgcctagggtggacccagcacagagcaggctcctcgttgatacctgttagctattgttggatgaggggacctgtggctgtgctttggtctccagcccaacttgttccccaggctctggtcccccactgttttgcacctttcatttgaggggccactaaaaaggcttctcctaggagccctgagctgccatggatcatgcctttgagcctgtgtcaccccccaaaatgagagcctctgccccaaatccacccagagcatcagagcaatgctgtgggctcaggggctggcagccaaggtgagtcctggccgtggctttgccccctggcctcagacttttcttgtgggctgcagcttgccctctgagcaggtggcattcctgaccttacggccccattttcacctgacaacctgggtttccaggtgtccactgctaggtttatccagccctctgcggtcctcagctcctgctccttagcacctcagccagagggaggacaggcaggacagaggagagcgagagcagaagggagcctctgttatgtttgtgtactgctctgattagaactgtaacccgaggcggaggttgcaatgagccgagattgcgccactgcactccagcctgggcaacagagcgagactccgtctcaaaaaaagaactgtagcctgaggaacagatcttggcagtggggtgggattacctatgaacctcgcagagtggggctgtgtctgtcttttaatcacattcagcttggcctgttctgtgtggggtcagtggctcttgttgctttttttatttttgagatgggcttgtgctctgtcacccagactgtagtgcagtgccatgatcatggctcactgcggcctcgatgtcctgggctcaagagatcctcctacctcagcctcctgaatagctggacctacagcacatgtcaccacttctggctaatttatttcttattttttgtagagacagggtctccctgtgttgcccaggctggtctcaaactcctgggctcaagcgatcctcctgcctcagcttcccaaagtactgggattacaggcatgagcctgattacagctctgctcggcctcgtggctctttttgaagcaagtaatctggaatggaatgaccagaggttaaggggagaggatagagtgtggcatttggtgggcctgggttctatcctggctctgaagtttgctctgtttgtgagcaagaccaagtttctaaatttctctgagcccatctctcatctctgattcctcttgtccatctctgaagagcctttggacctgccacctccttcgtgtcttaggacccttttgtgggtccttgcccaccttggtctttattaaatttgtgagttccccaatcctacccccaaacctgtaggccacccagcgctaggtagatttccccaggagccatttgtctttgtttggccggtcacagttcctgctgatggccatgggctttggtaactcacgcccatggtcctgcatcaccacatttctgatgcgtcagttctgtatctcccaatctctgtggttacggcattggtctagatgacatgggccttgcctggagctgttctgtgggtagtttaggaagagaatgtagcttttaatttttttagctcttttcctgtcctgatgactttatatttatgtctctccctggccctcccagaatgcatggcctctgtggttaggatttctgtgggacaatgaaccacagaagaaacttacagtgtcctttctgttcttgggatctaattgttttaagttcatatggctttcggggggctcagattcccctgaagaccttgttggggccttgagatccatcactgggatctcttgaagccaaaggctctcagtgggcatgtggcctcgggcactccagaggctactgggagcactgtggctgcctggagggccaggctatctaccatggtctccagagagatgagaaaaggcggtgttcctcagaccctttcatcggattcctctgaaggcagaggaaagctccccacagcactgcttcctcatcctcccagaccctgtggtccaaagcagccacctgccaacaacccagaagtttcttggagtctcctattttaacctagaattcattgggattttgcattttcctccataatatgttcttaagtttgtatctaaaaataataatttacataacttatcattgaggacaatggatgttcctgtattaaacaccatgctttgcatgtggcttggagttcccactccctcagccacataccccagagtccctaagtccaggaggcagagaaccaaggggtagcggcattcaaaacaccttcccagggcaagtgattcacttgtgaactgcacctgcttatgtgttccctggaaacgggggcatctgctctcatggttaaggaacagggcagggacccatggacaggagctgcatttactgtctggttgttgaccctattgggcagataaggaactgagaaaggattacaaagccagtgctccttcctgatcgggcaggaactaaccacaggaggggaaggtgttccgaaccctgctgtgtgggggcaagcagcaaatgaggaagtggcaggaggcatctagatttctctcatcaaggccaaaggcttcagggcccactgggttccccaaagctgagaatcctgaggtactagcccaagggggagactctgcctctttccagacaggctttaccctaagcttctcccacaaccacctgtgcatcttgtttacaggcagattccacttcagtagcactgaggtggggcctgagaggccacatttctagcaggtgcccaggtgggaccatactcctactggtcggggatcacactttgaggaatacgggcctcagaagaaggtggcagggccgggtgtagtggcttatacttgtaatcccagcactttgggaggcagaaggggaaggatcacttgaagccaggagttcgagaccagcctgggcaacaaagtaagactcccatctctacaaaaaatttaaaaaattagctgggcctggtggtgcacatctgtagtcccagctacttaggaggctgaggcaggaggattacttgagcccaggaggtcagggctgcagtgagctatgagcataccactgcactccagcccaagtgacacagtgggactttgtctcaaaaaataaaaataaaaaaagctggtagccaggtggtccacagggcgccctccatcccaatgccacgacccttttcccctggagttctgacggtaaggtgggcttccttggggcttcactggacctttgggggtcataagaacaagagcctcggcctgagggttgtctttgggaccatggtgaaaagttctgcgcagtgcaggatttcctgtttcctgcacctggcctgtggtttcttaatttcacatttgttgcttcatatttgggttgctgggggctgtgttgtgttatctttgtttttaaggtttctggacttattcctaggccaagaatcaggcagccatagggcaaagtaaaaagtatttttagccagagccacagaagggataaagggaaggaagactagagcttggccactctccggacaactccagctgccctcgatggagcggtcatccacaacgaagtattactgagaaagtagatgtggggtttttttgttttttgttttttgtttttttgattttgagacagaatcttgctctgttgctcaggctggatcactcaggcgatctcagctcactgcaacctctgcttcccagattcaagcaattctcctgcctcagcctcccgagtagctgggattacaggcgcccaccaccacgcctggctcatttttgtatttttagtagagacagggttttaccatgttggccaggccggtctcgaactcctgacctcaagtgatctgcctgcctcagcctcccaaagtgttgggattataggcgtgagccaccatgcctggccaaagtagatgtttttagaggtttcggctccttcaaaatgcagattactgtcattgtcactacctatgcaaaatgtagcatagaactgactttggctgggtcctttgcccatacctagaataaggtgtcttggttcccacctgcagggagttcagccaggtactgggaaccacacggtggcatgtggggcgtcagctcctgcctgggagctcgtgtttcctcatttcctgggatgctctaggaaaaggcttcccaaaatgccatgatggggagcccttcacaaggtgggagggcacattaccattgccccttcagtgcttgggttgatctttttctccctctcagaagctcttgcaaccttggttcaggatctgtgggggcctagacagaaggctatatggcaggctcaggtccccagaaaagcccacatattggaatcctgcatctcctcgaagtaaaatttcttgaagggtgttcttgctctttgggctgtgaacaaatgaagagctcgccagggaaaagacccacctcttctggcactgtctaccctggcgaggttggggtgtgcagaatgtaactgcagttatgccaccagggattcgagagggctgtgttaattgctggagaggaagattccagttacacagtatccttaaagacgggaacttctttttcttttttttgagacggagttttgctgttattgcccaggctggagtgcagtggtgcaatctcggctcactgcagcctccacctcccgggttcaagcgattctcctgcctcagcctcccgagtagctgggattagtcatgtgccacaacgcccggctaattttgtatttttagtatagatggggtttctccatggtggtcaggctagtctcgaactcccgacctcaggtgatctgcctgcctcagcctgccaaagtgctgggattacaggcgttagccattgcgtctggccaaagacaggaacgtgtaaggggcaggcagctggctggcatgaaaagctgaaggtggtgagcaagattcatgtagctaaagaggccacacaggtgactgtgtgggccgagtaatgggaagcaaaggttttacaagattgcctggtcgtccttttctaagaacagaagtgagggcgtggagtgggacccagctcgggaagtggcatgctgactcacctgtggcttgtggttggggacactgagtaagacctggtgtttggaaccacaggctgggcctcctcccctgctgattggcccaggggcttaagttcttcccagctcctgtctagactgaaacctcctggtgtgggtcatgcgcctaagagctgtggccttcctggagctcaggctagagagacactggacttgatccgagtcagctgacagactggggtgggcgggtggtgcaatggagagcatttgggtttgggggtagggagagccaggcttggacccctgctcagacagagttggccttcacttctctgatcctcaggtttcttctataaactgggactgaagccagcctcacaaggtcttgtgaaaacaaaaggaaataacgtatacaagggagctcttccattccattccgcacagactggggggctctcttggcctcagggaaggatgcaagaaattgtactgatgtaacagcaggattcatgtggatcaagaccttggttttgcccccttggggtcagggcaagggtgagacccccatgcccactgttgagttgtgtgcttggatttgccaagcttggatttgcttggtattgctctccgtgcattctgtagaaataaaggcagtggcttgtcttgtcggtggtgtggggagccccatgcttgagacagacacaggaggagctgggcagagttcctaggaggaaatacagttagagcagcgcccactgtgccccatgtccctcggagtcatggagatcaggcttctgtttcctcactcagctcagacactggtcattcagtcctcctggatcccccagcctcttctggcacatggttctagtcatggaagggttttcaataggtctggcctactgaccctgcccatgggaggccacccgaccaaggaccccttccaagagcattgggaagggagaggctgcccctcagtctgcaccaaccctgtgggggaagccttttgtttggctgtgatgggggtgggagtgggaggcccctgtgactacctggagccgattcccaggggagctgtggcaggggcagagccaccggagtctgtcagtcccagagtcccccacaggtgtgaccccctccccatgtctccatgtgcagacccccgtgtactgtgactgttttgcagtggtggttggtttggttttagttaacactgcttcatttgttctgagctgtggttcagttccatgatcatatctgtgggcaccctcccagctctgggattggacagagtctccctcgagctgtgcagacgcatgaggtactccggtggctagtccagccttggacacttgggagactgtcccatgggcagctcagcttctccccagttgctgctaactggccccacccctttggtgccacctcttctgtgccctcaagccatgagtttgctggagtaggcgagaagctaatcagcagcttcctcattgcacatcctcattttcttagagtcaattttgttctcagtcttctttttccagaaaaggaaaataagagatagtggtttggtttcttgaacatcaaatattcggagctgaactaactgaaacccaactcagggtagcctgaacaatgaggtgtcatcaactcccaacagatggcttatttggtgcctctggcctggtttctctacattttgctactgtgcatcctgttcgtgtcctcatgcagttctctcagggtgacaatgtagtcgtggcagcattgggcttctcactcgctggttggagtaagggcaggtgtcttgctagtggctcttccctaagcgtgcggaagtatcttttctgtaagtccctgcaaacctccctcacgcctgcctaatccaaattgggcccctggctgggggaggccctgcactgattgacttagcttggcttcctgaacgcattgctggaactaggggagacgacttcctttagaccgattgtgcctaccctaaagcttggaagcttggggtggggtgaggtttccctgaagcccttgggtctgtggatggaccctgaataaagaatgggctacttttaaggaggtaagcggagaggaggcagggaggcagcctgtggacacaaagttgtcacctgaacttgtagtgcctgagttttgttgcctgggagtcccctctgcaatgctgtaggatttccttcccactcctccagcctcccacgcagcttctccaggttttctgggagtcctggccgtcccacaggttggtctgccctggcctctgtgctgcagtctgctcaggccccgctgctgttctccgtccactctcccgctcctctgtcaaatactcttctcttctgaggacatgggggtggtctcagagactaggggagaatgtccctctccagttggtgccatgccttgctgttagggccccaagacagggctacttgtgcccttggcctcccagagtgcctgcctcactcttccagcctcttacttccttccatgctcatcccctcgtgggactggagtcagcccctccctgccccctccccactgagagcctcccattgcacatggctcaggtacggccactcccccatggccagtcttgccgaacccagctctgagcgggacccacatggagccactagtggaatggaggatgttaaagggagaattcctctgctaggcctgtgagggttgtctgcctgctgatgggcttgtgccctccagctgtgtccattcctgctctctctttcctgttcatttcctcccagggcacaggaaacccacaggaataccaggaatagatgccagatttctccttcaccctggctcgttcttccttcccactttcttgcctttttttctttcttttaaagttaacatttaaaatgtgtagtaggccgggcgcagtggctcatgcctgtaatcccagcactttgggaggccgaggcgggtggatcatttgaggtcaggagttcgagaccagcctggccaacatagtgaaaccccgtgtctactaaaaatacaaaaattagccaggcatggtggcgcacacctgtagtcccagctactcaggaggctgaggcaggagaatcgcttgaacctaggaggcggagattgctgtgagctgagatcacgccactgcactccagcctgggcgacagagtgaaactctgtcttaaaaaaataaaaaatagaccatcctggctaacacggtgaaaccctgtctctactaaaaatacaaaaaattagcccggcgtggtggcgggtgcctgtagtcccagctactcgggaggctgaggcaggagaatggcgtgaacctggggggcggagcttgcagtgagccaagatcacactactgcactccagcctgggcgacagagcgacactacgtctcaaaaaataaaaaaaaaaaataaataaaaactaaaatatgtagtaatgctccccaactcccactgctgatttgagaagtaatgtgttgttaaaatttggaaaatacaaaaaggtataaagaaaaaaagaaaagtctcatgtagtcctgcagcttgagaaaagcactttttacattttgatatttttctttcccacctttccaagatgcattggtgaatacttttggaaatgtggttgggatatacacagttttagatcctgttgctttcactgaacattagatttgaaatttttccatgccattaaatattattttacaatatcatccttcagttactgcgtgaattttctgttatatagatttaccaagatttagttttttattggtttaaacagtgccgcggtgagcatcatgattattttcacaaaataaatttttttgttttgtttgagtcaggggtctcactctgttgcccaggctggagtgcagtggcatgatcatgacccactacagccttaaacccctgggctcaagtgatccacctgcctcagtttcccgagtagctaggaccataggcatgcgccaccacccctagttaatttttttgtagtttttgtagagatgggggtctttccatgttgcccaggcagatcttgaacttctggcctcaagtgatcctcccacctcaccctcccaaagtgctgggattacaggcataagccaccaccctggtccacaaaataaatttctagaagtgaaattggtttgctgattcattgcctaacctgagcactgtctctgttctcagggtacaagctttaaagtccctttctctgcttagagttccaatcccaagtgaattctcccatcactccgtgccatggcccttgcagcattgtgccataagccgctcccaggcagcaggaggtcgggaatgcttagggtccttgtcactgcatgtccagtattgcacggatcacactgtgccctggtacccttggtgactcctttcattgagagccgtctcaagatccttttgggggaattgcatagcccagaagttttctcttaggtgaataagcccttacaactctcattgcagtgggaagatgccagaagtggactatgtagttctgtcggaatggtttgactggatcttgaggaacatggacgtgtctgttgatttgataggtgagatgcacccctcccacctccctctcttgtctctctcctgggtcccttgaggatgtgcttggctgggccccaacccttgggggcagtgggtgaggcacttgcccttggcagttccttccccatgggagttcagctttctccctgagggcagacagaattcgggacttctggtctctcatggagaagaaccctggcctttgttctttaaacttccctccctggctcagctactttcagacccaaatccactgtgatctgatgggtttttctagtttgcaaaggaacaggaaggacagagcctgaacattcactgagacctgctgggtgtgaggcctgttttgagctctgtctatgaacagaatcccattcagcctcaaaacgaccccacggggccgctgacactgaaagagaatgaaagtcgaggcggagggtcagtggtcaagccaagagctggccctccctgcttcctgctcgagctgtgcagaccttcctcccgcctttgcctgtgtgcctgctttgcttccaagccatgagcagagtcctgagagccacgtattcttttaacctcagtttaccttcggaccaatcctgagacttgttaccagaggttaaagaagagatgcagggaagaggagaaggtcattccgctggtaagaggcctctttgacttggttaaagacaaactgggaaaccacctctgtccaacccggcttcctctcccggccccacccccatgagatcattgtgcccttgtttgcagagagagaacaggaaccaagtgtatcagagggtgaactctgacttcctgtttggccagagacccacgtggatgtccagatctgcttggcttcctgtggtcgctgactcacagtttggcaaccctcctgcttggaggcgttcccctcccctccccacctgcccctccccatcttggcagcaccagggcttgtctgttctgcctcctgaagattgcctggccttgtgctctctgtgtcctccctagaatgcgagttccaggagggcaggacccagccctcttgttcactgctgcatccctagtgcttagcacagtgcccggcacggaggcggtgctcatgcttagtggtgtttgcccactggagagatgccatgcccttctgagttctgctcaggccacactgactctcatggggactctgccagtataggcccgggctgtgcatctcgccctggcccttccctccttgcatctcccttcaaaatctggcctccaggctgccgcccggctgatatttccaatactcatcaccactcgtgcaatttcccagcccagaacctttcagtgccttgctgctggctagaatgcagtccccactttgtaatacggcttatgacccggccccaactgcctctctggcgttatcatcctccattccctactttctatgctctggctataaggaactagttgtggccacacacaaacaaccacatacacagtggagttatgcaaatgtgcctttgcacagtcgtttcctttgtctttaaagtgttactcagatgtcacctcctccaggaagccacccctgaccttccttccattgtaaccccccccaaacccaccccctggctttctgtgatcatgggccttaggacagcatactgacactatttgtttatacctttgttccccatccctcactaatgtgagctttttaagattgggtcttattccctccgtgtcctctgcatgtgccttggggcctggtgcctagtagttgctcagttagtattgaactgaatgtcccatgtgagaagctgccactggagggagacagaggctgggcaagcattcagtggggtgtcaggggctctgagctcaggataggctggactgggggccctgggaagcctatccaactcctgaaatcctgctcagccttgtttttccttggtgccagcacgatgcattcctgccacgagggcccaggcgtcactctgggcagctcctttgaaatcttggagacaagaatgctaggaagatggaatgtggtggaatggggccaggctggaccatgctgtgatgcgcacagcagctctgtgcagtgacccagatgctccccaagcctgggggccgtccaagccgtgatccaagccattgtcttaagggtttgaccaggtccatgggacacatctggctcctattgccaagggagagctgggcaggagatgtaaaggctgctgcagagttgacacgcgagcctctgggatggcgagtggaatctgtgtgaggagccatcccactctgtgcctgggagagcacgagtatctgctctgcctggcatgcaggccccatggctcaggagggcctgtgccccttttcccttgggctccgctgcatcaggctttctgcagttggtggtctttatagtctggagggtctataggttacgagttgttgagggggtagaagggcaatgggtgagggtcacagtcctcttggtggcaagacagagcggagggtttagaggctgcccagggctgggcccctgcctgaaggaactgaggccctgctgctgcaaaagtggcagtaaatgggagaagccaggtgtgggtcctgcctttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtacttgagattagggaatggtgatgactcttaatgagtatgctaccttcaagcatctgtttaacaaagcacatcttgcatcgcccttaatccatttaacccttagtggacacagcacacgtttcagagagcacggggttgggggtaaggttatagactaacagcatcccaaggcagaagaatttttcttagtacagaacaaaatggagtctcctatgtctacttctttctacacagacacagtaacaatctgatctttcttttccccacatttcccccttttctattagacaaaaccgccatcgtcatcatggcccgttctcaatgagctattgggtacacctcccagacggggtggtggccgggcagaggggctcctcacttcccagactgagcggccgggcagaggggtcctcacatcctagacgatgggcggccaggcagagacactcctcacttcctagacggggtggcagccgggcagaggctgcaatctcggcactttgggaggccaaggcaggcggctgggaggtggaggttgtagcgagccgagatcacgccactgcactccagcctgggcaacattgagcactgagtgaaccagactccgtctgcaatcccggcacctcgggaggccgaggctggcggatcactcgcggttaggagctggagaccagcccggccaacacagcgaaaccccgtctccaccaaaaaatacgaaaaccagtcaggcatggcggtgcgcgcctgcaatcccaggcacttggcaggctgaggcaggagaatcaggcagggaggttgcagtgagtcgagttggcggcagtacagtccagcctcggctgggcatcagagggaaaccgtgcaaaggggagagggagagggggagggggagggggtcctgccttttgccttggctttgattcaggcgccaggggaagggccagtgtttgtgcccacgaacccccagtggagcagagcagggtggctggtgacacttgtgctgttttgctcagcctggccaccgagtgtgtggctgcgtctgccgctgtccacttgagccaggtttgctcttgcagggttcctttgtctgagtcactgcccatggtcattgactactttgaccccctctgcttgacacccttggtaggtggggtctgctctgtccactcccgacagactgcttgtgtttccctggcaggaatacctggaagcaattcaccatctccatgaggagtggctcatcaaaggcagccttttccccatggcagcccctgttctggtaagtaagactcccttacagggtacgagactgttctagaaagaggagtgacccggggaatgtcagccaccttgcagacaggggagggcacagtcctttagagtttgacaacttagaagaaggaaggtgggaaggctggtgctctctctcccagtgcctgtttctgggctgagtctcagagtgagttggccagacccgagggaaggcagtctgtgccagtgccatcacacctggcagttgtcactgatccagcatcttcagcgaagactctagacccgggtctcagttttcaccatttgggatagtagttcctctgatgtgaccttcctccttccgtggatgacacagagcctcatttcacctttgtttggtgactcaggtcatcagaaggaatgtcattgtctggtctgggctgtcacacagtgatgcccttaggaatgctgaggtgtgtggaactgtctgccctgcccactaatgtctctgcgttcctgtgtttactttttacagtaatcctcctttctcttgctgccatgtgtcatttctgactgatattgatgtgtctgtcccgtcagcatttccttacttccccatctccttgttttccagtttgctgtttccagatttctttactcagacaaataagcagtggcccagatgctcccaagaaatgcggagtctggggtccctccgagtcttgattggagggaacctaagatggttacatatacaacatgggattggctgtgaggcagggttgtgcgcaagctttggtgcatggctataggagcattgtttgatgggatgtgaggcagggctgtgcatgagcttttgtgcgtggccataggaatatctgtttgggctcaaacacttctgcttatggctcttgcaggcagtgaggttgccggaaagtgagatattactgtagtaattttttgtttgtttgtttttgagacagagcctcactctgttgcccagactggaatgcagtgacgcaatctcggctcgctgcaacctctgcctcctgggttcaaatgattctcttgcctcagcctcctgaatagctgggactacaggcgcatgccaccatgcctggataattttttatatttttcgtagagatgggattttgccacgttggccaagctggtctcaaactcctggcctcaagtgatctgcctgcctcggcctcccaaaattctgggatcacaggcgtgagccactgcacccggcctactgtagtagatttttaaataagtacagcttatttttctccctcattatggaaaaaaaggagggtagaaagtgatgagggaaaaaaacaaatcattcatgagcttacagggtctcactgtgttgcccaggctggtctcaaactcctgggctcgtgtaatcttcaggtctcagcctcccaaagtgcttggataatagacatgagccaccatacctagctcttgtagtacattcttaagtgaaaacctcattggaaatgtagattgccctagagctgaaagcgatttggctctaaccttcctttttatctgcctgcaaccttctgtgcccttccctgccccctgctgcctgcttccatctgtctgtctccagctgtgaaaggaggatgctgctgaggtcagtgcagccttgtgacccatgtgtctaatttccaggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagc

SEQ ID NO: 36563 - DNA, 19529 bp, Homo sapiens
gcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccaggtgactgccggagcgtagtgggatgggcgcggcctgagggtactcgcagcggcactttcagccgccggacccgccgagggacaggggatggggcgggcagagcagatgtgtaactctccagaatctctccttgccctaagatattccgcactttctgagccaggtagagcacgggggaagaaaggaaacggtagtgtcaaggcaggtggtggaaggcctttccctcactgggtcaaagaggagttttgctttgtgccaaagaatctcacgattgctgcctattggaatgcgaaaacgcaagcgtgacaaccagtgggatgccaggggttgaggactttggaatcgcagagtgtaatggccaaggggatctggagagcttagagttttgttttttgtttttttttgttttgttttgagacggagtctcgctctgactcccaggcaagagtgcagtggtgcgatctcggctcactgcaacctccgcctcccgggtgcaagcgattcttgctgcctcagcatccccagtagctgggattacaggggcccgccactacgcctggctaatttttgcatttttagtagagactgggtttcaccatgttggccaggctgatctcaaacgcctgacctcagttgatacacctgcctcggcctcccaaagtgctgggcgtgagccaccgcgcctggctgagttcaagcttcttgatttgtgcatttggatcctaagagggagccagaaagaaacctgccaagtgcacagggagatcttggcaaagccaggctagaagggaagtctctctggctcctgctgtggtgtccaacccctggcaagccctttccatgagcaggtttagttccagccctccgtgggtggtctgtcaacaagcttttctccctgcgctgcctttggatcacctcagtatgtgggtttggaggcgtggaagggcctggctgagggtttggaagatgtggcttgaagaggggcttttcctctgggtgtgtgaaacactgaccccagttaaagccttcttatgtgctgagagagggagggcttgctgtatctgtgggacctgacaggtgggaaggctttacaggttgggaaccgcaggactcaggagggtgtgcctgggtgggagacagaaagagtcacagaaaattgtgttcagcagatgttccgcaagtgatttttgagttggggcagagctggaactagaacctaggtgcccgctgcactctgcagccacactttcgtggagaggaacaggagagagatatgaggaaggcaccttgcatgccagcccagggtgtagccctgcatgttgaagggggccagcccctccacacctgtgggtatttctcctcaggtgggacaagagactgagaaaagaaataagacacagagacaaagtatagagaaagaacagtgggcccaggggaccaccgctcagtatagggaggacccgcgccagcactggtctctgagttccgtcagtatttattgatcactatctctaccatctcggtgagggggatgtggcaggactatagggtaatggtggggaaagggtcaacaggaaaacatgtgagcaaaggactctgtgtcataagtttaaggaaaggtgctgtgccttgatgtgtatgtaggccagatttatgtttgactttatacaagcatctcagtgcagtaaacaacagtattgtcaccagcatgtctcacctccagccataaggtggttttctcctatctcagtaaatagaacgtaggatcgggttttacactgacacattccattcccagggacgagcaggagatagatgccttcctcttatctcaactgcaaagaggccttcctctttcactgatcctcctcagcacagaccctttacgggtatcgggctgaggtatggtcaggtctttcccttcccacaaggccgtatctcaggctgtctcagtggggagaaaccttggagaatacccaggctttcttgggcagaggtgcctgcagccttccgcagtgcattgtgcccctgggtactcaagacgggagaatggcgatgactttttgccaagcatactgcctgcaaacacatttttaacaaagcacatcctgcacagccctaattaaaccttgagtcaacacagcacatgtttctgcgagcatagggttggggctaggtttacagattaccagcatctcaaggcagaagaatttctcttagtacagaacaaaatggaatttcttatgtctacttctttttacatagacacagtaacagtctgatctctcttttccccacacatgtgttgcggttttggctggctgtaatgtatgaatttactccaaaccatccctggggccaagatatctcatatttatttagtaagataaaaaatatatctggttccagcctccactcaccaagctggctgaaaagtccaccatcagtcagtttttagggtttcttccttccagagtgagagggccctggtggtcaacccaaattggccatctcccctacacaagcacaggttcttcactgtctagttgccctctctggctgggcgctggaggtcctccttagagatcctcctgtttatccctggctctgtgcagccagctgagttctgccagctccaagagcagcgtgggcagcactagcagggatctgctcacagctcttgcctgcagaactcccctcctggttgcaaggaatccacctggctggcaggggtgtgggatggtagcaggatgggtcttcctgcacttcggctccaaacagcagcatctatatggttttcctctggagcaactgctcttcattatttttacgaacagattattccaggacagaagttttggctctgaaagcttggctctttcaggaggagaagcgggaaattacctttcaggtttccagtgattgtggttttgagtaatcagcaaaggggtggggtcctgattgacaatagctttgtaggctttgcgggggagtaggatttttttttggtttttgttatttttgttttttgtttttgagacggagtcttgctctgtcgcccaggctggagtgcaatggtgcgatctcggcttactgcaacctctgcctcccaggttcaagcgattctcctgcctcagcctcccgagtagctgggattacaggcgcctgccaccatgcctggctaatttttgcatttttagtagagacggggcttcaccatgttggccatggctggcctcgacctcccgacctcaggtgatccgcccgcctcggcctcccaaagtgctgggattataggcatgagccaccgcgcctggccaatgcctggctaatttctgtagttttagtataaacggtttcgtcatgttggccaggctagtcttgaactctttttttttttttttttttgagatgaagtctcactttgttgccccagctggagtgcactggtgcaatctcggctcactgcaacctccacctcccgggttcaagcaattctcctgcctcagcctccctagtagctggggttacaggtgcctgccaccatgcccggctaatttttgtattttttagtagagatgggatttcaccatcttggccaggctggtcttgaactcctgacctcaggtgatccccctgccttggcttcccaaagtgttgggataacaggtgtgagccacctcacccggccaggacgtgggagttttagctgaacccagcccaggcttgggaacagctctttcccccgcctctcctcccttctgcctacaactcctaaggcacccttctgtttggctctggagtccttgaatgatgggcaggtaggatctgtgactgtctgggcaacctttcttctggggctcttagcccagccctgaatcacaagggggcacctgagataagcagggctccagcaggccctgggagaacacagcgatttgtagtaaagctcctgtctgatagattctggacaaagcgatttggcaaccaagattcttttttttttttgagtcagagtcttgctctgttgcccaggctggagtgtagtggctcaatcttggctcactgcaacctccgcctcccgggttcaagtgattctcctgcctcagcctcctggagtagctaggactacaggtgcctgccaccacatccagctaatttttgcatttttggtagagacagggtttcgccatgttggccaggctggtctcgaactcctgacctcaggtgatccgcctgcctcggcctcccaaagtgctgggattacaggtgtgagccaccactcccggattcttggctgtgtccaaggaggacacagctggatgaaggggtacctaaacaccttctgaattttcacaaaatagttcacctctctctaaactcttgagcaaatctagagaaaaatgtgtttctggtaattctgttgacgcttcacccattttttcccaccctgccccctgaataagttttgatatcttttctagaccgaagagaaggaccaccatcaatagaatagtatagctgggagagacatcacagaacacctatttatgcccttatgcctttgtacatgcagttttgttttaccctgaatggtttttcctacatctcttacaacccgcttatcaatcccactggcattgtggttcagaaggagaaaacaaaacagatggaggaggggcaatgcctcctaagtgattggtagagtatccctctcttgaaaaattgtgcatgcaggtggccacaggtttagatgttacctgtatactatacttccctgcattctccgcaaaatcaggtttccgcatgttcactgattggtcttctggaggtgcagacttactttggtgtctaggagaaaatgtctcagctgcctgacactagttgaagatttaaaaatagctgttagcagctgtgtcattaactgtcaacaggcaagaacataggaaagaatgaaaatgtgtgctgagcgtggaggggagcacattgctagctgctagctgccgtgcacaggcactctgtgggcgccttgtagcgaggtcgggggagttggtgaccggactgtcaggtggcagttattccagggtggtgaatgctctgctgatttcgatgtccttctccatactcttaggcattttttaaaatacaatgaacctgtatttatataatgaaaacaaaaataaagcaaaatttgattttcattgtgagatgggaaaggcaagatgcagtactgtgtgtatagtatgattcctttgtgcaaaaaagaatatatatagacaactgttgacatggtgggtttttcataaatattttcttttcctgtaagagtacaccagaaactgttaattatagttttcctttatagaggagggactgtgcaaggagaaccaggggtggagggaatgctcacttttcattttgtatacctttaaagaatatatcaagaggattatctagtgtgtttggggagaagtcttgaacccattttttcttctttgtagctccttgtgttagaaaaaaaatccaaagtaagtactctatcagttcaatgaattcagggaagtgctcctgacactgaggacatcagggggcagaggctgtggcatgtgctcggagagggcaggcgccaggctctggggtgtggggggtgggagggggcagtggtgcctgggtggggagaggtgcacatgagtctgagaggaccacagcttggaagcacctcctggaatatgctctggagcctgtggtgtgatgagatggggattttaaggggagaggcaaggccaggttgggttttgcactgtctggccctagtggaaagtgtgggttggaggtgcaggacctgggcagggcagcagttgggtggccgcgtgtgacctaggagacaaggatgagtctgaggcccggtgagggccttggtagaggggatggagaggtgaccatttttcagagctacttagcttggtgactggatgcaggtggtggtgggaaggaggagccagaaagacacctgtttcatttcctgaacacctggatggatggcggggcctcccctgagtacagggtacaggatacataaggaggagctggtcaaaagtcgggcaggtgatgagcttagaggaaggacagggaaggtggacaggtgacaggaatagcccagtgagctggtttgggctccattgcctcgggctgggtaggggatctgggggatgtgggatgagtggagagcctggagtcagaggtgcttaggggaggagtggaagccagggtaggggaggagggtaagaggggaggggaggaggggaagggtagaggggagaaggggaagcaaggggaggtgaggaagggaaggggagaagggaaaggaaggggaggggaggaagggaagggaagggtagagggggaggaggggaagcaaggggaggggaggaagggaagggtagagggggaggaggggaagccaggggaggggaggagggaaagggtagaggggaggagggaaaccaggggaggggaggaggggaaattggggagggaagagggggaagtggggaggggaggagggggaagcaggccaggggaggagggggagtagggggaggggagtagggggattagggggaggggaggagtagaagcagggttggaggggtgggaggaatggaagcaggaggaggggaagccttctcccagaatcagagagggaagagaaggtacccagagctctgtctctccccacatctggcatcttcttatccttcaaatcacagctgaaatgtggtttcttcagataggcagcctttaagaactggaacactcactgtgagggtctgcggcttcattcttgaagtcagtgagaccaagaacccaccaattccggacacagaatgaatgtgtaaacccttccttttgggtgtggccttcagtcacagacccagcctcccaagatggggtcttcttgtttttgcccttccctgctagaggttggcaaccccctgagtagtgttcagagctgctctgtgggtgtggggatggcatggggtcaggtgcaggcagatggctggtgggcaagaaggcacctctctctcagcctcagtttatctgtgcaatgggaatggcagtaagacttaatcaaaacatggatgacatcagcgtggtgttggcacacagaaggcagccactgctggtgtatatttgtagtggtttaatcatcagtctggagctaggcacagtagcatgtgcctgtagttccagctactcgggaggctgaagtgggaggatcacttgagcccaggagttcaagtctagcctgggcaacacggccagacactgtctctaaggaaaaaaaaaacctacttgggcaggtcggctcgctgggcaccccttcaacaagcttctggaggagacagagctgcattctctagggatggcaagggcctgcccaggctgggccatgtcagagctgctggggcatgggccactggtgtctgctgcaggcccatgagacttcggcgagtaggggactgatccgagtttgttccccacagaacccagacctggactcagaggcgctgctagccctgcccctgcctcagctggtgcagaagttacacagtagagagctggcccctgaggccgtgctcttcacctatgtgggaaaggtaaggccagccaaggccagcccctccctgggaaaggtaaggccagccaaggccagcccctccctttcccctccctctgtccgcacaggctgtggggaaaacctggcctggagttagtcctgctgggggccatggtgggacctacagtgccagggactgccagggagggaaggagccagagcgtgtgcgtgtgtgtatgtatgtgtgtatgagacactgagcatgctgtcttagctagtaacctggcttttagcccagacttccctctccctcctgcctccaccccattgggcaacaagtctggtctgttcccttctttttttttgagatggagtttcgctcttgttgttcaggctggagtgcaatggcacaatcttggcgcactgcaacctccacctcctgggttcaagcaattctcctgcctcagcctcccaagtagctgggattacaggcatgcaccactacacccggctaatgaaaagaaaaaaaattttttttttttttttgagatggagtctcgctctgttgcccaggctggaatgcagtggcatgatcttggctcactgcagcctccacctcctgggttcaagtgattcttctgcctcagcctcctgagtagctgggagtacaggcacctgctaacacacccagctaatttttgtatttttagtagagatgggattttaccatgttggtcaggctggtctggaactcctgacctcaagtgatccacccgcctcggtctcccaaagtgctggggttacagctgtgagccactgcagctggcccccaactaattttttgtatttagtagagacggggtttcaccatgttgatcaggctggtctcaaactcctgacctcaggtgatccacccgcctcggccttccaaagtgctaggattacaggcgtgagccaccatgcccgaccccgtctttttttttgagatgggagtcttgctctgtcgcccaggctggagtgcagtggcatgatcttggctcactacaacctccacctcccgggttcaagtgattctcatacctcagcctcccgagtagctgggattatagacatgcacccccatgcttggctaatttttgtatttttatttggccgggctggtctggaactcccaacctcaggtgatcctctgaaagtgctgggattacaggcgtgagccaccgcgcctggcctgttctcttcttttacccagccctctcctgtctccatcccctttggccaccctggcccgccaccaccatctcccgccatgcccaagcaccagcctcctggtcaggtgccctcttgtgtccccagctcttcaggccatctcttgtactcctcctctgtgtgtggcatcacctctggccaaggccttctggagcttgggtgtcagcagctctgcactggcttgggtggggctcctttacctggaaggctgtttccctcttctttgcccctgtccgtgccacgggctcccctggctgagccttcggggctcagagcaggaggcaccgtcttccattcgccacctgaggtagggtttcctcttccaggcctactctcattctaatagcacatttctcatcacagtgtcaggcttgtcttctctatctctttcccatggggggtctttgtggacagagcttgtctcatttgtctttgaaccttagtgctcaacatgttgcatttcacgtaataaatgctcaagaaatatgtttgaaaagaaagggagggagggaggaaagaaggagacaaattgtgctttgagtgtggcctgcatgatttcttgaaagggtgtgggacagtgagtgtgacccctaggcaggtgaacttgtctgggtgcagtgtatgtgacaatgctgtgggggctgcagctgaggaagcgagcgcatgctgggctggtgtcactgagagggggcacgtacatagtctcagcagatggtcttgcttcttccctgtcaatgtccctgaaaggctcctgcccttcctagttaatctagtctatctggttagattagccttctctgttcctgcctcgggtaccccggggacagattttgcacatgcctgaatatggcaacacagcccaccctgtttcccccagatactccccaggagcaggaatatttactgaaagctgcatctcactctgccctcacctttccttctgtaggaccctgtgtggtgaggtttgagcattctaggcagatttccactattagcatgttcttcccttttgtcaagctcctactccacatggcttgattatcaaattcaagatttcctgggtaaggggaggcttgactgggctacatgtggggaaggcgtggggttgaggagagactgctgggctccgggaggcaggagtctggtctagtcctgctctgtggttgcccttcagtgtgaccagtgatggggcgctgcccctgtctggtttctgtctgcctcactggcagagatgtggcttgggggaggtgagggagtggccagtggtcatcttcctcccagctcaccccctacctggggggcacctgaggccagtatcttgctcccttgagtgtcccggttgtgccctggtcctggttgaaggccagagacagccaggatgaggcctgggccaaatgtccctagtgaggcagatgctgagccctaggtcatcctctgtgccccaggctctgggccatgttgctggttacccctctccctgggtatactttaaaaggccagttctacatgatgtatatttcaccacaatttcttaaaaaggccagcctccttttatcttatgtctacttccccttcctcaggcctgggaagtgaacaaagggaccaactgtgtgacctcctatctggctgactgtgagactcagctgtctcaggccccaaggcagggcctgctctatggcgtccctgtgagcctcaaggagtgcttcacctacaaggtatgctctgcctcagcgccaggcctccatcgtcccctccatccctgccagcctgctctgcatcttgggtcattttgggcccttagaggaggtatcaggtccagaggccttccgaggggacactggtatacctgttttggcctgtgtgacagttgttggagtggacccttggctgcccacgggccctgactcactcccttctggtgcccatccctcctcccagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcaggttgggtcttggggtggggcggggcggggcaggggcaccggtcccagcatggcacgggctgacccattcttggctcctccagctatgactgcagtaaccccctctttggccagaccgtgaacccatggaagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcaggtaaggtgggtggagggcgcttctgggcccctcgctgtgtgaccttggcctagcttccaacctctctgggctccaggcggggattcggtctccggggttttgctgggaggaagcattacagtaccactggccgggcgtgggtcctagtttccaaagcggtgagtgttcagagctgctctgtgggtgtggggatggcggcgggtggccatttcctgtttccagcatcttatgtttcttatccagcaagagtggcctgaagggctgtgtctatggacaggaggcaggtgaggtccgtggtgctctcagtgccccgaggagggtgggggtcggcctgacccgcttccgcccgtgcttctcaggtggcagggcagtgtctggcccccaggctgctctaggtctgggttcctcgctccttgtctgcttacctccctcacctctctgccccacagtgcgtctctccgtgggccccatggcccgggacgtggagagcctggcactgtgcctgcgagccctgctgtgtgaggacatgttccgcttggaccccactgtgcctcccttgcccttcagagaagaggtgagcagggctgggtgggcatgaatgtggaccgctgaacccagacagccaccccaggccttgtgggcaggccttggagcccctgtctcctgagaaccgtcccccaggcctctgaggccagggcgggttgctcctccacagacggccaccagatggagcccttgcctgcatttggaaatcctcaggctttttttttttttccttttctttctttctttttttttttttttttgagactgagtatcgctctgtccctcaggctggagtgcagtggcgcgatctcggctcactgcaagctccgcctcccgggttcacgccattctcctgggttcacgccattctcctgcctcagcctcccgagtagctgggactacaggcgcccggcaccacgcccggctaattttttttgtatttttagtagtagagacggggtttcaccgtgttatccaggatggtctggatctcctgacctcgtgatccgcccgcctcggcctcccaaagtgctgggattacaggcttgagttaccgcgccggccggaaatccacaggctttcaaaggtgcccagcctcagctgctggcaccagggatgcaggaatcatttcccagcctgctgaccttcagcaaacagcagcctttctaacagtattcctgtccacattttgggagcagcacgccacgctgcctgcagaccccagctcatgtagcctgttcctgccagacttgctgctacgtgagccagggtctgcaagcagcgtggtgtgctgctccccaaaataccaccacagcagcctgttgctgagacaggctgggcttgttgctttctgtggcgaggcagcactgtcttgcaaagccttaggatcatctcagagggcaggaagggtggggagatctgctgagattttgaagtctggtttaaggtggatctttcaacatgggggttggttaagattggtttaagttggttaagattggttaagatccttaatccccatgttaaggattggtgggcacagcagggtgtggattttgaggcgagaggtgtcaaccgatgcttcctgttgaagagttggaatgaatcggaaggttatttgtgttatgtgtgttatttggaggaggtgggggagtggccagtggtcatcttcctcccagctcatcccctactgcggggcatctgagaccagtattttgctctcttgagtgttctggttgtgctctggtcctggtactctctctctctctgtctctgtgtgcgttggggttgaaggccagaaacagccaggttgaggctggggccagatgtccccagtgaggcaggtgctgggccctaggtcatcctctgtgcccactccaacagagtgcaggagctgtaaagttagattggtgcagacagaggaagagtgaagtcacgttaatgtagacagtaagctgtgtgacgtaagccccgtttctcagcagtccagcgattgtctatcttgtacagacctcttgccctcgccccagccaaggttgccttggaaaggctgagggtttgtggacgggaaggagagtgggccttggtgtttcttgggagtggggcagcagggcagatctgggctgggtagggtgaactccccctccccaggcagagggagatattctaaccgaacccacggggataggcagccgtgaagtccttcctcggaggagaggaggagatgaggtccctgtctggaagtctggaacagtttatcatgagagccaggacaggtggtggagagcctcagctcagaagacaggatgcctgcattccagacctgtcttgtcactctgcattgggtagctttgggcaagtcccagtcccacctaatctccctattgagacctcaagcctcagtttcctcatatgaccagtaggaatccttatccttgctctgcccacctgagtcactgtgaaggtgttttatgaaagggtcagatgcagaaggggctggcctcgctgactgcagcctcgcagctgtgtctggggctgagtagtttctctgatctctaggggtcctgcctagggttgtcttctcctgacctgcccctgtcccctgtgttttccctccaggtctacaccagctctcagcccctgcgtgtggggtactatgagactgacaactataccatgccctccccggccatgaggcgggccgtgctggagaccaaacagagccttgaggctgcggggcacacggtatgactgcagggtcctggaagtactggcatctcctcccctcacgggaagccttcctggtacccatggctactccatccctggcatcctggcactctgacgatgttgtcgtcggggtgaactgtgaccctgtgggacaagtatatagagggctgatcaagagtattggagtgagtgattgatggagaactttagccctgtgctgtgtgatgtgtgagcactgcatgtggggaggctcttcagctctaaacagtggtgcacagctgtccagaggctcccagggccagtgggttttggtctggtcattacacaactttatgtgtggctccagacttctctcatgctgtgcattccacagtgagttttcatgggtcagtaaggctgcctttgtagctctagtgagagctatcttgtgggcagggttggtccaatccatcctcagggccgcccagacagcatggggatcatgaagccagttgttaggtcaggaggccttacacccctcaatccctgcagctggttcccttcttgccaagcaacataccccatgctctggagaccctgtcaacaggtgggctcttcagtgatggtggccacaccttcctacagaacttgtgagtgatagtgggctttggggtcttggtgggatcagacaagtaggcagacctgggggagcagcagggtgtggtgatgcctggatgggccttagctgaatccaacaaaggcctgagcactctgggcagggacctcgctgtccctccagctgggcacattgagcctggagatcccttgccagggtgccagcccgaggggaggctgggttgagtatctgtggcctacccctgatctgagcttgttgtgaggtaggaggtgggcaggaggttgcctctctgtttgggaaggatttgggccaagggcaggatccaggcaggagggtgggggtttggacttgatgctgtgactccaggctctgtctgacttgagccaagtcttctttttgagcaggacctcagctttctctcctgtaaagtgggtgggttggaccagactccctttaagggactttgcagagctcatttttagagaagttcgttcctctgggatgcttctagtcattaaaggtgtcaggggcagagaacaggcctgcaaaggtgcctcctggtgacatacctctgctggatggactggaacccttcagaacacagtcccccttcctccacttcactgatggagaacttggccctgcagcctggagcttggccctgcagcttcactcagtcaagggcccagcctgtcatgttcctttccttcccctagcagccaagtgtggtccaggcttcagtggaaggggtcactcctcactctggccctgggaatgagtccccaggatcagctgcctgagacctttccctgagatcttgagccagagatagcctcagagccctgcttcatgggcagcccaccctcgatttccccacctgtgcctccaggctgtacctccctaaggggaggtaccctcagggaggcctcatcagggagatgttgccctcagttcttagagctctgagctgggtttgctggagagggataccctgagtcctgccttggggagctcccgtggatgtgggttgcagcccaggcatcccaaaggatcagcagaaacaaacggcatgtttggaaggagggagctgagtctggtgaggaggaggtggacaggatccctgcatagagaatgggattgctgtgggccgggcgagcaagctgggaaggatgtggggatgggagtgcctggaccgagcattttgtttcccagcaaaggtgatttcgtggacccctgcctgggggacctggtctcaattctgaagcttccccaatggcttaaaggactgctggccttcctggtgaagcctctggtgagggcacaaggagtggaggggctaggatggctgggggggaacctagggcctcctatcgcatgatcccccatggcctccctcagcctctcttggtttgggcaggcatggcctcctcttctctccagtccccacccagactgctctcctcctctgtcccctgcgatcttcagccaacccgcatgctgaaaggggtgccgacctgggccctggggggaggcatggagggaggggtccccagtggcttggcctgaagaaggttgacgtctgccgtggcccagagctgagtcaccgaccctgcgtctgtcctgtgcagctgccaaggctgtcagctttcctcagcaacatgaagtctcggtaagggttcttctgtgtctagctgccggcccctgcctgtcctgatccgagtctgggtctgggtagtttctgacaggaaaggacttgagggaagtagcctctgaggctggaagtggcccaggcaggggggcaacctttgtggccttcagatgggactttgaagttgtcttggcaaggtccagttctggctggagagcaaaggcctgagggggacaagaggatgggggagttggaggggaggaggttgacctggctggggcatgagtggaaaggaccaggaagtgggggttggcctgggccaagggtggggcacccgggagagatgccactgttagagatctgagctgacctgagctgcgccaggccctacttgccccttagtggctggggctggaaaagcagggcgtaaacctccctgtttcatgccctgacgtcccatggactcactccttcccttaccaccaggcttcaggactggcagcagctatggcctctcccgtgtcctgagggtagcgaggaatcgggcctgggctagtcctggctctgctgtggagtcaccaagtgccagcctgtgcccctctggggcctgattttctcatccagacagtaggggtttgaacttccctctcagagctcccatggggttgtgaagggtccacggaggggtgagatctagagggttggcagtaggggtctgatgttgctgatctccgtggctgtgaccatcatggctggtgaccacactccttctgcccagttcggctggaaaactctgggaactgcagcacgagatcgaggtgaggccagagcctctggattggagcagggtggtggggggagggtggagttggacagggtacccgctagcagtgtctcgtggccactgcccccatggggctcctagactggcctgtcatcccccttccactccctggaccaccacttgggcccagctctctgacccttacttgcctagatgcccatcctttgaggctgggtcagccccaggctcctgtcctggccgcctttttgcccctctggagctgcctttgtgtggctccgcctcagcgggaagaggtgtatccacaattcattctggaggcagaacgactgatgccctctgagaggcagcactgcctgcccggaggacctgtgtcccactgtggctctgttcagatccaggggcaggtgctggggccagagccaccccagccacagtccctgagttaaagagcctggggtgggctaggtctgagtgctttcacctggtgtgttgtgtcctccgcaggtgtaccgcaaaaccgtgattgcccagtggagggcgctggacctggatgtggtgctgacccccatgctggcccctgctctggacttgaatgccccaggcagggccacaggtgaggcccgacaccctgcctgtcccttctgtgaatctggccatgtgccctgcagggctgcgaggaaatggaagaagagccctctgggaggaccctgccctctcggggcccacagtctggctgactggagacatggcagtcatgtgggttgccctggcagggattgattttcctgtcatcagcactattcaagttggggatcttgagttacagaatctagtttggggaggtgatggtttgaagtccaggtgggatttagataaatcaagaaaataggggccagggcggtggctcacacctataatccgagcactttgggaggctgaggctggaggatcacttgagcccaggagctcaagagcagtccaggcaacatagtgaggctcctgttgctacaaaaaatagaaaaattagctgggtgtggttgcatgttcctgtagtcctggctactcggggggctgaggcaggaggattgcttgagcccaggaggtcaaggctgcagtgagttatgatcacaccactgcactccagcctgggtgacagagtgagactgtctcaaaaaaaggaaaaggaaaagaaaacaggaacagcattcccagtggagaaagtacatgggcaaaggcatggggcaaacatcagtgggttgtccagcccggccctgaaatctgaattcctgggctttgtcactcagacctcagtcctgggagagagcctttctctggctgtagacacagggtgccatttcatatgaggtttgactcaggcccggagttggcactgaagattctcagggcctgctgcagctgcctgtaatgtgttccaggggccgtcagctacactatgctgtacaactgcctggacttccctgcaggggtggtgcctgtcaccacggtgactgctgaggacgaggcccagatggaacattacaggggctactttggggatatctgggacaagatgctgcagaaggtgaggactgacctgcccctcaactggactcactccccaccctgactctggccgctgtggaggaaacagtaccagcactgcgggtttgccagcctttcttaagcaagacctgaaggactatggcctggccctacgttgtggcctctctctagctgggtgcttcctgggcctgggggtggggagtcctgccttgctaaccctatcctgatgcctgtatcccctatagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacagct

SEQ ID NO: 36564 - DNA, 68531 bp, Homo sapiens
ggcagaggagcgagtgcagcggccagcagcacatccccgctccacagtcgccgcagtcgccgcagccgccgccgccgccccgcgcgcccaaccgccgcggccccctgccccgccggcctgccagtgagagagcggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgctgctgagctgcggtagcggcagcgcggccccggcgcccggcgtggggcagcagcgcgacgccgccagcgacctcgagtccaagcagctgggcggccaacagccgccgctcgcgctgccccctccgccgccgctgccgctgccgctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcaggtcggtggcgccgggtctgggggccgcgggacagtcaggtgacgcggggcggggccggggcggggtccgggcagggggcgtgggccgggggggtcgggggccgggggagccggggccggggcggaggccggggaccggggaccgcagccggcgaaagccctccttctcccagccctgggtaatccaagggaagcgggttcgcggccgccgcaggccgtccacaaacaggcttttgtaaaaacgtcggtttcatgagaaaacgggtctgttctaggagaacaataccgttccatcacgaagtgcgtgtggtactgacgcttaagataggtctagaaagtctctgcggtttagggccttgaatgaaggtgttgtggctggctttaaaaacacaaaccactttttaacttttttctgttagtttttcgagttcgcgatttgatgtcttgttccctctccaagagtcattgttagtggaggagtagcattttctcatcccctaagagacatcactatagctgtgttactagacaaaggtgggaggcgtggctcctaaaataagagtaaggtagaaatgttttttccttttttttttttttttgagacggagtttcgctcttggtccccaggctggagtgcagtggcgcgacctcggctcactgcaaccacggcctcccgtgttcaagcgattctccttgcctcagcctcccgagtagctgggattacagacacacgccaccacgcccggctaattttgtatttttagtagagacaaggtttctccatgttcgttaggctgatcttgaactcccgacctcaggtgatccacccgcttcgacctcccaaaatgttgggattacaggcatgagccaccgcgctcggccattttttcctttttttaaacttgaaaatatttaatcttaaatttgaattacagaagtacgcgtgtaggtattcagacttaacagaagtctgaccttctttcaccactctgctccgaagacataaccattcaacgtagtgtgtgcatccttctattgagacctttaaagatgtgttcccgggccgggcgcagtggctcacgcctgtaatcccagcactttgggaggccaaggtgggcgggtcacgaggtcgggagatcgagaccagcctggccaacatggtgaaaccccatatctactaaaaatacaaaaattagctgggcatggtggcgcacacctgtagtcccagctacttgggaggctgaggcaggagaatcgcttgaacctgggaggcggcggttgcagtgagccgagatcacgccactgcactccagcctttgacagagagagactgtctcaaaaaaacaaaaacaaagaacgtgttccgtcattttctgccaattttcttttaattggctgacaggttgtgtgcagtatctagaaatttgctggctggctgccaccagtaatccccaagtccagttttggtcatttgattccttttctgtgcccactgtctttcaccagagccgctaatgcagcaaaattaactctttgagcttcacttcctctttgtgcttcagcccctctgactgcttatgagctaagagtgagagttaataggcagttggtaaggaagcagagaaaagaaaaccgaggctgtttagataatccctgaattgcttaatggcacttaaaaaaaattcagctctctccaaggtttactttaatctacttttagttaggcctgaaaattctcaactagaagggcgatcattttaggccatgtactcatcagtctgtgaaatggaaaacctaaaggagaagtgacttgcctgaggtcagtggctgtttactgccttcaaagcctgaactgccaggtctctggtgtccccttctcctgcaccagtgctctagcctgcggcctgtgaaaatgtttggacaccctagatccagccttaagatattttcatggctttctccagggagagtcactcagcagttaaacttttgcattttgctcaaaccagttattaggaaagcattgaggatgtcttgtttcttttctccaggagttagcagtcttggaaaacacagctttccttttggattggatgacctttttacataatgttgcaagagtacactctctcagtcctgtgttctgaaagagaacgtagttatggaataagtttaataaggagaaaaaaaggtgatttaggacatgggaaagtgggtgatgtctagcttttaaaaaagacacaagggcatttggaggtgcggagaaggagaggaattcgtctggttgaaattcagtgattctccataggcagttgcagttattatggctccagctatcaaattttactgacatttcccaatctgattctggtttttggtttttttttggagacagggtttcactctgtcgcgcaggctggagtgcagtggtgtgatcacagctcactgtagcctcgacttcccaggctctggtgatcctcccacctcagcctctcaagtagctgggactacaggcacgcaccaccattactggctaatttttgtatttttgtagagatggggtttcgccatgttgcccaggctggtcttgaactcctgagctcaagcagtccttccgcttcagcctcccaaagtgccaggattttagacctgagccaccatacctggccccgatccgtttctggagctccgtgtttcactgagtgccagtgcatctgcagtagttgatgagacttcaccacctcaactcagtgcattcctattccaaatttaaccctttggctcctccccacccaggaatgtgcttctgctttcgctctgcgtttgtagcagcagcctggccagagccccaggatcatttctaactctgcattcccccagaaatccctcctctgcacacagttgtaactcaaacctgatgagctacttttgtatccccaccttctgtctggtccctttgctgtccttgcttagacactagaacaggaggtgccttaggatcttcttgcattttgtgtgttccttctaatccattctgtatcttgttgctatggatttctcaaatattggaaaataaaatccaaacttgtttgcatggtctaaacttgagccttggcctacctttttattttttatttttaaatttattttttgagatggagtcttgctctgtcacccaggctggtgtgatctcggctagctgcaacttctgcctcctgggttcgagcgattcttgtgcctcagcctcccgagtagctgggactacagatgcaccaccacatccggctaatttttgtatttttggtagagatagggtttcaccatattgaccaggctggtctcgaactcctgacctcaggtgttccaccctccttggcctcccaaagtgctgggattacaggcgttagccactgcaccctgcccggcctaactttttagactggttctttttgttattactgttttaaaatcactccttctccagaaccacagcaactaacattgagctagttacactggagcctgcattttctgaatgagctttgtgttttcagtttccaggcctttctttgcccctaccctctgcttggcagcctttcccttggtgtgtttcctttaaaattcctctttcaaggcttaactcagagagaaccagacatactgaatttctttcccctctgtgtctcatccttagcactttgtacatgcaggccttgttatcacaacccttaacacgtttgtgtgtgtgtttattcattccattctcttgttagattgaattcctagagggcatttcacgttcatctttgtatctccagcactaggatagtgcctggcacaccggaactggataagtgtagaaattgtcatttttagcttaagttggcctctttgctgtgtgatgaacggagatccttgtctgagtctcttcaactatgagtggtatagggaaaaataaaaattgtcctaacatgagagttgttgttaatgagctgaccacttagaaaatttgttcatttccagacatcacaacttaatactaacttctgtccctgcctatcaaatcaatagtatgttattagcattttctttctttctttctttttttttttttaagacagtcttgctctgttgcccaggcgggagcacaatggcgcgatctcggctcactgcaacctctgcctcccaggttcaagcgattctcctgcctcggcctcccgagtagctgggattacagtcacatgccatgtccagctaaattttttttttttggtatctttagtagatacaaggtttcacatgttggccaggctggtcttgaactcctgacctcatgatccgcctgctttggcctcccatagtgctgggattacaggcatgagccaccacgcctggctacctggctaatttttgtattttttggtagccacggggttttaccatggtgcccaggctggtatagaactcctgggctcaggtgatccgcctgcctccgcccaaagagcagggattacaggcgtaaaccaccacacccagcttagagtttgttattttcattgctgattgataaggtcacagcagttgtgaaatgaagtttaaaatcttgtgaaggatacaagatttcatgaagttcaatgaatgaaatgttggagactaagtttcacacacatcttttgacattacgttccacagacccactaacagtgaaaagaaaaccattgaggaggatgctaccttgggccctgcaaaatagaatcatatcaaaagatggagagagtcccatgaaaagactggccaagtcctcagatactgtaaaattaatgcagtaaaactcacataggaagttaattgtgtcttatggtgccatcataatttttttggaaaaattgtgcccaaactccctacttttcattttaaacgtttgcttttcaaattaaacataaatatgtagttgtattataacctaaattatgttacatataagaacagaaacaattttcaatttcatttttcaagatacaattttatttacactttgtttttactggaaagttttgttccttgggtggctggcttgctggctttctttttctttcttcctttttaaactaatacactatattttttagagcaacttgtatttgtttgtttagaaatgggggatttcactgtgttacccaggctggtcttgaactcctgggctcaagtggtccctcctgcctcagccaccttagtagctgggattacaagtgtgtgccactgtgcccagttttagagcagttttaggttcacagcaaaattgagcagatagtacagagagttcccatataaccccctgcctgcacacaggcactgccttcccctttctcaacttcccccaccagaatgggacatttgttacaactgaggaacctacattgacatattatcactcagagtccataacacactacatcctattcttgctgttgtacattctgtggtttttggccaccgtataatgacatgtatccaccattgtattgatgctgctttacatgatgagcttacttcaacagggttatgccctgataaaccatcataaattgaaatgcatttaatacattgaatctactgaacagcatatcttagcctagcctacctttaatttgccagaacacttacacattagcttacagttgggcaaagtaatctaacagaaagtctgtttttataataaagtgttaaatatttcatgtaatttattgattactgaaaatgaaaaataaaatggttgtatgtttacttgaagtatggtttcttccgaatacatatcacctttgtaccattgtatagtcgaaaaatcataagttgaaccatcataagttggagaccatctgtagtgtcatacagaatagtttcactgccctagaaatcctctacttaatgtctgtttatccctctttccctcctaagcccagccaatcactggtctttttacagtctccataggttttccttttccagaatgtcatagaattggaatcacacagtatgtaagtcttttcagtttggcttttttcacttgataatatgcactgagtttccctgggtcttgtcttgtcttttcttcttcttttttttttttttcccgagacagagtctcgctctgtcgccgaggctggagtgcaatggtgcgatcttggctcactgcaacctccgccttccgggttcaggcaattctccttcctcagcctcccaagtagctggaattacaggcatgtgccaccccgcctggctaattttttgtatttttagtagagacagggtttcaccatattgaccaggctggtctcgaactcctgaccttgtcatctgcctgccttggcctcccaaggtgttggaattacaggggtgagcccctgtgcccagcctccctgtgtcttttcatggcttgataactcacttctttttaatactcagtagtattctgtcatctggatataccacagtttatttatccattcatctactgaaggacatctgggttacttcacggttttggcaattatgaataaagttgctctaaacatttgtgtgtaggttttcaattcatttgggtaaatacttaggagcatgattgctggtcatatggtgagagttacgtttagttttgtaaggaactgccaaactgtcttccagagtagctgtaacattttgcattcctaccagcagtgaatgagatttcctgttattctatgtccttactagcatttggtggtgtcagcattctggtgtttggtcattctggtaggcgtataatggtctctcattttctttttctttccttttttttttgagacagagtttcactcttgttgcccaggctggagtgcaatggcgcgatctcggcttgctgcaacctccgcttcctgggttcaagcgattctcctgtctctgcctcctgagttcttgagattacaggcacctgccactacgcctagctaatttttggtatttagagatggggtttcaccatgttggccaggctggtcttgaactcctaacctcaggtgatccacctgcctcggcctcccaaagtgctgggattacaggcatgagccatcgcgcctggctgttttttgtttttgttttgagacagagtcttgctcttttgcccaggctggagcgcagtggtgtgatcttggctcactgcaacctccgcctcccgggttcaagcagttctctgcctcagcctcctgagtagctgggattacaggcgcctgccaccatgcccggctaattttttgtatttttagtagaggtgggtttcactgtgttggacaggctggtctggaactcctgacccacgtgatctgcccacctcggcctcccaaagtgctgggattacaggcgtgaaccaccgcgcccagtcaggtatcttattttaatttgcaactttctaatgacatatgatgaaaatcttttcagatgcttatttgctatctgtatatcttctttgatgagatgtcagtttgtgtctttttctttttcctttttatttttttaagaaactgggtcttgctacattgctcaggcttgagtgtagtgggtattcacagatgtggtcctcctgcctcagtctcccaagtatctgggactataggggcatgccacagagcttcttgcccattttaaaattttaatttaattgtttttttttttcctgccacagcttctttttttttttttttttttttttttttttgagacggagtcttgctctgttgcccaggctagagtgcagtggtgcgatcttggctcactgcaagctccgtctcccggtttcacgccattttcctgcctcagcctcccgagtagctgggactacaggcggctgccaccacgcccggctaattttttgtatttttagtagagatggggtttcactgtgttagccaggatggtcttgatctcctgacctcgtgatcctcctgcctcggcctcccgaagtgctgggattacaggcatgaaccaccgtgccaggcacctgccacaccttcttgagtgggaaagtgttttcctattcttgagttttaagagttctttatatatttttgttaacagtcctttatcaaatgtgtcttttgcaaatattttttccttgtttgtgacttttcattctcttgacagtatcttttgcaaagcagtttttaattttaatgaagtctggcctatcaattatttctttcatggatcatgcttttgatgctgtatctaaaagtaatctggctgggcgcagtggcttatgcctgtaattccagcacttggggaggacaagatgggtggatcacctgaggtcaggagtttgagaccagcctggccaacatggtgaaactctgtctcttctagaaatacaaaaaaattagtctggtgtagtcgtgggcacctgtaatgccagctactcaggaggctaaggcaggaagaatcgcttgaacccgggaggcggaggttgcagtgagcctggattgcggcactgcactccagactgttgcgacaagagtgagactccgtctcaaaaaaagtaaataaataaataaaagcaatcaccatacctaaggtcatctagattttcttctatgttaccatcaagaaattatctagttttgcattttatatttagctttatgatccattttgatttaatttttgggaagtgtaacgtctgtctagatttttttttgcatgtggacgtcccgttgttccaggactttttttttttttttttttttttttgagacggagttttgctgttgttgcccaggctggaatgcaatggcgtgatctcggctcaccgcaacctccacctcccaggttcaagcgattctcctgcctcagcctcctgagtagctgggattacaggcatgcgtcaccacgcctggctaattttgtatttttagtagagacggggtttcttcatgttggtcaggctggtctcaaactcctgacctcaagtgatccacccgcctcagcctcccaaagtgctgggattacaggtgtgagctaccgctccgggcatgttccaggaccatttgttgaaacaacaaatggtttgttgtaaaagacatttgttacattgtattgcctttgctcctttgtgaaagatctgttgactatgtgagtgtatttctgtactctctagtctgttccattgatccatttgtcctttcttttgccaataccacactgttttaattaatgtagcttttttatttttattttttgagatagtgtcttggctggagtacaatggcatgatcttggctcactgcaacctctgtctcccgggttcaagtgattctcatgcctcagcctcctgagtagctgggattacaggtgtgtaccaccatacctggctcattttttttttttttcttgagatggagtttggcttttgttgcccaggctggagtgcaatggcacgatctcggctcactgcaacctctgcctcccaggttcaagcaattttcctgcctcaacttccccagtagctggggttacaggcgcccaccaccacgcccagctaatttttgtatttttagtagagacagggtttcaccatgttggccaggctggtctcgaactcctgacctcaggtaatctgcccagctcggcctcccaaagtgctgggattagaggcatgagccaccgcgcctggcctaattaatgtagcttcataatgattcttgaggttgagtattgtcggtcctctgactttattcttcattggctattctaggttttttgcctctcctgataaactttattattattatcattttttttttttttgagatggagtctcattctgttgcccaggctggagtgcagtggcgtgatcccagctcactgcaacctccgcctcctggattcaagcgattctcctgcctcagcctcccgagtagctgggattataggtgcatgccaccacgcccagctaattttgtatttttagtagagacagggtttcaccatgtttgccaggctggtctcggaactcctgaccataagtgatctgcccaccttggcctcccaaattgctgggattacaagcatgagccactgtgcctggcttccctgtaaattttagaatcagttcgttggtattcacaaaataacttgctggggttttcattgggattgcattaaatctacagatcaagttgggaagaaccgacatcttgataatattgagtcttcctacccatgactcaatacacattgagtgacataacaaaatacacattttgttagatttatatataagtatttcatttttgggggtgctcatataaatggtaatgtgcttttaatttcaaattccacttatttgtcactggtatgtaggaaactggttgacttttatgtattaaccttgtatcttgcagtcctgctatataatctcttattccagaaattttttttcacttctttctgattttctacatagataatcatatcatctacaaagttttatttctctcttcctaatctgtatacttttaatttccttttcttattagttaggacttcctatgatgttggaaaaaagtggtgagggggaacattgttaccttgttcctgttcttcgtagaaaagctgtgactttctcatcaagtataatgttagctgtaggttttttatagatgttctttatcaagttgaggaagttcctctctattcctcattttctgagagtttattatttaccatgagtgggtgttggattttgtcagatagtttttctccatctattgatatgatcatgtgatttttcttctttagcctgttgatgtgatagattatattaattgattttattttttattttttattttgagacagagtctcgctctgtcacccacactggagtgcagtggcgtgacctcggctcactgcaacctctactccctggattcaagcaattctcatgcctcagtcacccgagtagctgggattacaggtgtgcaccatcacattcagctaatttttgtattttcagtacagacagggtttcaccatgttggccaggctggtcttgaactcctgacctcaagtggtccacctgccttggcctccccaggtgctggactacaggcacgagccaccacatccagcctattgttgatttttgaatgtttaacctatagtcctatggtgaggtctcagtcttttggtgagcctgtgcacctagactgtgaactttacccatttttcttagttctcctccccgcttaggtgggacagaatggccagagggggctggaattgtgtatttgccctctctcaggaagtttaggctctgagaaaatcccaacaggttagacactggcaaaataatttctcctgagggcagaccttgttaagaacagaatgttctgtcgtatttaaaaatataagaggccgggctcggtggctcacgcctgtaatcccagcactttgggagcctgaggcgggaggatcacgaggtcaggagatcgagaccatcctggctaacacggtgaaactccgtctctactaaaaatacaaaaaattagcccagtgtggtggcgggcgcctgtagtcccagctactcgggaggctgaggcaggagaatggtgtgaacccgggaggtggagcttgctgtgagccgagatcgcgccactgcactcctgcctgggggacagagcgagactctgtctcaaaaaaaaaaaaaaaaaaaaaggaaaagaaaaaaggaaaggtttctttgcccctccctctgctggaagcatgaagggattttttccccccctcagttttcactgtaaggaactcgtagagctcctggaggtaaaactcgtcaaagaatggggctccccagtaattgggtctcctggagttttaaactctcacagttgtccacactgagcctccggcaatttgttagttatagttaaggttttcctaccctagtgctgatttggtggaggattttgctccagtaaactgtgattctctgtatctgccggtctgtctgtccaatttgggaggcagcagtttcccccttaacctcatttctttttttttgagacagagccttgcggtcacccaggctggagtgcagtggcatgatcttggctcactgcaagctccgcctcccaggttcacgccattctcttgcctcagcctcccaagtggctgggactacaggcgcccgccaccacgccaggctaattttttgtatttttagtagagacggagtttcaccgtgttagccaggatggtctcgatctcctgacctcgtgatcctcccgccttggcctcccaaagtgctgggattacaggcgtgagcctctgcgcccagccaccttatttctttaagagttgatttttcagttgatttagctttttacatgttgttaggatcaggtggcgacttctaagcttcttacacatactggactggaaaccagaaggttgagtggtatttcttttctttctttctttttgagacagggtcttgctcttgttgcccagtctggagtgcatttgtgggatcatagctcaactgcagcctggaattcctgggctcaagcgatcatcccacctcaccctcctcattagctgggactacaggtgtgtgccactgcacccagctaggagtagaatttagataataataataataaaagcacttcttctgttatctgtcatatattgctttcagtgatgcccacgttctccttcctgttttcccctccagtggagccccgtcagcctgtctagcgtccttccaggatctctccattctctgtcagtggcagggaatctcctcgttctgctgcgtggtggggcacaacccttatctttagttttccacaatgagatcgtaatttccgtgtctttcgtaatgtatttacacatcttaatgtgcctagtactctttttgtcgagtattgactgggagtcagcgtgggctagaagggatgcaagcactttatgagaaagtgggagggagtacttctgaccatgcctggtggaaggacctcctaggtgggaagggtaggcagaggcatgctgtgttccaaggactgtgctaaggacagtggcggcttgaaatttgtattttagaaacactttctaaggtggcctaggggatagcatagaggagagagggatcaagaagctgggagaccagagaggaggctgctgtagtgggggttgggggaggatatacatttgggcaggagcattgagaatggaaaggaggagagaatttgggagatagggagaggaccaggccattggaaacgaggaagattttgagcctgggtgagtgggaaaaaggcactactgttaactgaaataggcaaatcaggaggaagaaattattttgaatagaggaaggaaaagattataagttgggaatcaagttagagaacaaattggttttcaaattttggggaaggaaaaataggtaaaaactgcagaaagaatgataaaaaaagtagaggaatagtggggtgattttgtacccgcatctcgccatttggtaatgtttgaacatttttttttttgagacagagtctcactctgtcacccaggttggagtgcagtggctcaatcttgactcattgaaatcactgctgctcaggttcaagcgattctcctgcctaagcctcccaagtagctgggattacaggtgcctgccactgcgcccggctaatttttgtatttttagtagagacggggtttcaccatattggccaggctggtcttgaactcctgatctcgtgatccacccacctcggcctcccaaagtgctgggattacaggtatgatccaccatgcccggccgaacatgttttttattgttaccatgttggtggtagtacagctggcatctagtgaatagagggcagtgttgctgctaaacattcctgcagtacacagggcagctttgcccctcagcaaagaatgacctggccccagatacaaagcgtcaaggctgagccgtgctggagtagaattcttaagactgagctttatcctttcttccttctggcatcctcttaaacattaacctttgctttgcaattggtgctgataagtgaacagctcatatgatctcatgtaattttcgcagaaacttctgttagatactgctacattgttttatggtgtgaaaacagacttggaggcctgcccaaggtctgcacagctattttgtgcagagccagcactccacctgggctggactggtctttttttttttttggaggcagggtttttgtgttgcccaggctggagtgcagtgacgtgatcacggctcactgcagccccaaccttccaggctcaagcagtcatcccacctcaacttcccaagtacctgggaccacaggctcaatgccaccatgcctggccaattaaaaaaaaaaattgtagagatcgagtcttgttatgttgcctaggctggtctccagctcttgggctgaagcaatcctttcaccttgacctcctgaagtgttgagattgattataggtgttagccactgtgcttggcctagcctgttcttttaatggtacctcctggcttttcttgttttcagagaggtgggggttaataccgtcctgattactccgtagaggtgctgatgttttactgcagcactgtttttttcacctgagccatagctgcaatttgaattttagatggttagaagaaatttttcaaaaatctgcttttttttcttattttccttgtgctctaaattcagtagctgttttgatattacgctgtattctcttttccatgtagccagccctatggcttaaagatcatttctctgttgagacactggttatgtcgtgatttttttttctttctagtcattttgacttttagatgatagtcatggaactgcctgctctattttctcctaggtccaggccctcagccttggggactaagccctgtatgtgctagactgggtaccctgtgacttgtagacagtttgcggagctttcagtggcttttttgcttttcagcaaaatatagttggttaggtaacttcttatcttaatttatcaggtggaaatctttgtgttacaggttggagcagacagttcctcaggtttgtcatctgcctaagcattcattcagcggattcacatacatgaatcccaaaatatccccgttgctaaaaatgacaggggaaaaaacccaaataattaaaaataggtagatgtttgacattagagatggcatatttctttctttttcttttcttttttttttttttttttttttttttgagatggagtctcactctgctgcccaggctggagtacagtggcccgatttcggctcactgcaacctcctcctcccgtgtttaagcgattctcttgcctcagcctcctgagtagttgggactataggtgtctgccaccatgcccagctaatttttgtatttttagtagagatggggtttcaccgtgtttgccaggctggtcttgaattcctgacctcatgatccacccgcctcagcctcccaaagtgctgggattacaggcgtgagccaccatgtccggcctagagatgacatatttcaagaccttgggcagcctactaagttgttgtatcactgtagcatgtagcatgggtttttcttgttttatagtgctatagaatgtaacaggcattaaataatctctttttttttttgagatggagtttcactctgttgccgaggctggagtgcaatggtacgatctcaactcactgcagcctccatctcccgggttcaagcgattctcctgcctcagcctcctgagtagctgagattacagacatgtgccaccacgcctggctaattttgtatttttagtagagacagggtttcaccatgttgatcaggctggtcttgaactcctgacctcagatgatctgcccgtctttgcctcccaaagtgctgggattccaggcgtgagccactgtgcccggccagaattttataattttataacctgtgtatttgatgtaagtgctgaggcaatggagcattattcataatgtttataattgacatgtaataattgtacatattggtcgggtgcggtggctcacgcctgttatcccagcaatttgggaggccgaggcggttggatcacttgaggtcaggagttcgagaccagctgaccaacatggtgcaaccctatctgtactaaaaatacaaaaattattagctgggcatggtagtgggagcctgaatcctagctactcaggagactaatgcatgagaaccgcttaaacctgagaggcggaggttgcggtgagccgagattgcaccattgcactccagcctggatgatagagcaaaactcagtctcaaaaaataataataataataattgtcctatttatgaggtataaggtgaatttattccttccatctgactataatattgtaccagttggccaacctctccctgtctcccctcccctcgcctctggtaagcactattctcaacttctatgagatcaacttttttagattctacacaagtgagatcacattgttactgtctttctgtgcctgacttactttgcttaatataagtactgtcctccaggttcatccatattgtcacaaatgacagaatttcctgcttttataaggcttaataggattctactgtgtatatataccacattttctttattcatctgttgatggacacttacatttattctataatcaattgatggcttttgtgactagtgctgcaatatacatgagagtgtagatgtctgatgtactgatttcatttcctctggatgtattaccagtaatgggattgctggatttttaattttttattttatttaattaatttatttattttttatttttttgagactgagccttgctctgtctcccaggctggagtgcagtggtgtgatctcggctcactgcaacactgcctcccgggttcaagtgattctcgtgcttcctcctcacaaatagctgggattacagatgtacaccaccatgcgtggctaatttttttgtttttttaatagagacagagtttcaccatgttggccaggctgatctcgaattcccgacctcaggtgatctgcccgcctcagccttccaaagtgcggggattacacgcatgagccactgcaccaagcctggattttttttttttaaacttgctttgatgagcaggagctggatcttaatggtaattctatttttaattttctgaggaccctgcatactgtttttcatatctgtactaacttacattgccatcaacagtgtgtaagggttcccttttctccacatccttgtcaacgtttgttatcttttatcattgaaaatagacagtctaataatgactagtggtggtcagcattttttcatatacctgttggccatttattttattttttttaaatttactgagacagggtcttgctccgtcacccaggctggagtgcagtagcacaatcacagctcatttgcagcctcaacctcccaggctcaagtgatcctcccatctcaacctcccgagtagttgggactgcaggcacgtgctacctaccacatgtggctttctggccatttatttgtcatcttttgataaatgtctgttgggtcttttgccttgtttttgttattgagggatggaatcttgctctgtcatccaggctggagtacagtggtgcattcatagcttacttcagcctcaaactcttaggctcaaacaatcctcctatgtcagcctcccaagctgggaatataggcacacgccaccatttagggcaaatatatttttttttttttaaacagggtcttgctctgtcacccaggctaaagtacagtgcagccttgacttcctgggctctagtgatcctcttgcctcagcctcttgagtagctggtgtccattttttaattggtttcctttcctttctttgctgtgagttccttgtatattttctatattatccccttaactgatgtatagtttgcaaatagattcttccattctgtaggttgtttcttcactcttgtttcctttgctgtgcagaagctttttagtctgctataatcctatttgtttatttttgtttgtgttgcctgtgcttttgaggtcttttaaaaaaaattcctggctcagaccaaggtcatgaagctttttccctatgttttcttatggcagtttcatagtttcaggtcttactttaagttttcgatccattttggagtttatttttgtatatggtgtgagataaggatctaatttcattcttgtgcgtgcgatatccagttttcccaacactgtttattgaagagactgtctttttccctattgtgttcttgacacttgttgaaaatcaggtagctgtaagtgtggattaatttgtgggcttttattctgttatattggtctctgtctgtttttatgccaacaccatgctgttttggttactatgactttgtagtatatgttgaagttaggtagtgtgattcctctagctttgttctttttgctccagattgctttggctactggggtcttttgtgatttcatataaattttaggattggttttcctatttctatgaagaatgtcattggtattttgatagggattgcattgaatgtatagattgctttgggtagtatggacttttttttttctttttttttttttgagacagagtcttgctctgtcacccaggctggagtgcagtggcgtgatcttggctcactgccacctccgcctcctgagttcaagagattctcctgcctcagcctcccgagtagctgggattacaggcgcccaccaccatgcccagctaatttttgtatttttagtagaggcaggattttatcatgttggcgaggctggtcttgaactcctggcctcaggtgatcagcccacctcagcctcccaaagtgttgggattacaggcgtcagccacgcgcttggccagtatggacattttaacaatattaattcttctaatacatgaacatgggatattgttccatttatttgtgtcttcagtttctctgatcaatattttaaagttttcattgcagagctctttcacctccttggttaaatttctttctttttcttttctttttttttttgttagctattgtaaacaggattgttttcttgatttccattccagataatttgctattagctggcatgcagtggcgtgatcacagctcactccagccttgacctcctgggctcaagtgatcttcccacctgagcctcccgtttagaaataatactgctactgatttttgtatgttgattttgtatcctgcaatcttactgaacttattagttctcatagttttttggtggggtctttagggttttctatatgtaagatcatgttgtctgcaaacagggataatttaacttcatttccaatttggatgccttttatttctttctcttgccttgtttttctggctatcaagagaagctgaaatgattcatttcatttttgctcaacaatttatgtaaaataacctctttggaccagcgtggtggctcacgcctgtaatcccagcactttggggggctgagacaggtagatcatgaggtcaggagatcgagaccatcctggctaacacggtgaaaccccgtctctactaaaaatacaaaaaaattagcccggtgtggtggtgggcgcctgtagtcccagctacttgggaggctgaggcaggagaatggtgtgaacctgggaggtggagcttgcagtgagccgagatcgcgctgttgcactccagcctgggtgacagagtgagactccgtctcaaaaaaaaaaaaaaaaaaaaaaaaaaaagaacctctttatactgcttgttattcccttagtattctgttttaaggaatcatgggttgacagttagtgatgcgtgcaccactgggtctggagggcaggggtgagaattcctgccagcaggtacttcctgcttttttctgtttccttcctgtcattgtgttgagtgtggaataagtgtgttattgtcactgtatttgagattttgcttgagtatcttgtgcctctcatatatatgtgtgtgtgtgtgcatatatatatttaaatttatttatttatttattggagatgatgtttcgctcttgtatttatttatttatttatttatttatttatgtatttatttattggagatgatgtttcgttcttgtcccccaggctggagtgcaatggcacaatctcggctcactgcaatctctgcctctcgggttcaagtagttctcctgcctcagcctcctgagtagctgggattacaggcacgtgccaccatgcccggctaatttttgtatttttagtagagacagggtttcaccatgttggccaggctggtcttgaactcctgacctcaagtgatctgcccgcctcagcctcccaaagtgctaggattacaggcgtgagccgccacatccagcccatgcctctcatatctaattatgacttataaagctattatgccaggtgataaagtttgtggtttcaaaacttcttgcaaatccttgagagctcctggggttttacttgggaggatatttttgacaaattatatgataaattgaactgttacatttttgctaccatttctggcatttcttcctaccacattttattgttcctggtcatattattatttgactcattggtagttggctttttttctaggtaaatttctcacagtttgggttattggtgccagtcaccttgcttcatttattttgactgtcactaaaaaataattgacaatttattcactaaaacctattgaacaatagaggctacaggtaataaaaagcagttgaagggtttccaggttgtgagcttgtttctggccaagctagtctgccttccttctttagcagtacgggggtaaactttgaatcaggttacacaatttagaacagtacttcatctgtttgcctttgcatttgactgagatttccagagtatgtgaccggaagaaaaactagggcttttaactctgttttaatgcccgttctgttgcttggtagccagaaacccatgttggctgtgaccagacgcggcagggggattctgataagccacacagttgaggcgccacgccaagtttaacagaaaggttaaggctgcttttggttcctttgatctacacgctgtcggcctgcttcacagcttgctttgggaaaacaagaactttgggttcccttttatttttgttctttttaactaaggtagacaaccttctgggaaaatagatcctgactcttgctgtcttgttcctagagactcatgatggtttttcattttaagtaacctttgaaaaaacctcttaaatatgtcttacttaaatctgggaaaaaattgtttgtgctagaagcacattcaaattttttatttggtaagaaaatgagatatagttcacaaaccatacaattcacccatttaaattgtacagtccagtggcttttagtgtaatcacagatacttgcagctgttaccacagtcagttttagaacattttcatctttcaaaaagaaacttttagctatcatcccctacccctaagtaccccttcccaccccagctcctggcaaccactaatggactttatagatttccttgttctggacagttcatatgaatggaatcatataacatgtggtcttttgtgactgtcttctttcacttagcataatgtttttaagtttcatgttgtagtatatatcagtacttcatacttttttattaaaactgtggtaaaataaggtcaggcatggtgtgcctgtaattctagcactttgggaggccgagatgggtggatcacctgaggtcaggagttccagagcagcctggcaaaactccgtttctaccaaaaatacaaaaattagctaagcatgctggcatacacctgtaatcccagctacttggggggctgaggcaggagaatcgcttgaacctgggtggtggaggttgcagtgagccgagattgtgccactgtactctagcctggatgacagagcaaaaccctctctgaaaaaaataaataaataaataaaatcaagtaaaattgtggtaaaataagcagcattaaaaatacaattttaacaatttaaaaatatatagtttagtggcattaagtacattcattgttgtgctgccatcaccaccatccgtctccagaatgttgtcgtcttcccaaactgaaactctgtacccattaaacttaaaccaactccccatttccacctagttacccttatttttaaaaattaatgagctcgatcagaatctgttttcagttttaagccactaaatttgtagtaatttgttatagcagtaataggacatggagatgtttgtgtcatagaggtttatagagagtagtcctgatggaaggtgattttgcagctcacgcagctcctatgacatttttcttttatcttttctttttctttttttttttttttttttttgagataggagtctcactctgtcgcccaggctggagtacagtggcgcgataacggctcactgcaacctctgcctcctgggttcaagcgattcttctgcctcagcctctcaagtagctggtattacaaggtgtgtgccaccacacccggctaatttatatttttagtagagacaggctttcaccatgttggccaggctggtgtcaaactcttgacctcaggtgatccacctgccttggcctcccaaagtgctgggattacaggcatgagccactgcgcccgacctcctgtaatgtctttaatgtggcacatggtgctctccagctttgcctcctatctctttgacaactcttcatggttagttacaagcagggactcgagccatatgcctgggtttgattccttgcttagctacttacttggtgtgtgattagagtattgaggtctcctgtttcatctgaaggccgtggtaaccagttaatgttgggagttttttgaacaagctcctagtcaaaatcagttgacagatttttagtaacactagcgtagaagatcttggaactattaatacatatcaaatggaaagccctagagaagaaggtttaaatattgcctcaagatttttttttttttttttttgagacggagtcttgctctgtcgcccaggctggagtgcagtggtgccatctcggctcactgcaagcttcgcctcccgggttcatgccattctcctgcctcagcctcctgagttgctgggactacaggcacctgccaccacgcctggctaattttttgtatttttttagtagagacggggtttcaccgtgttagccaggatggtctagattccttgaccttgtgatccacccgcctcggcctcccaaagtgctgggattacaggcgtgagccaccgtgcccggcccacacgggcaatttcaaaaacgcttccccacctctactgcagaaaaacagaaagggaatttgtctgtttttaatgtgactcatggagttaaattgagagaataaatcgagataagatgagaacagttcttgtgtaaccctgacttttcatccatatttatccaagaagagtgatttagctcacctgcaataaagatacttactgtcctcttatttctgacagaggcggccttagcaacatgctgttccagtgctccctacctgacaccacagccacccttggtgatgagcctcggaaagtgctcctgcggctgtatggagcgattttgcagatggtgagttggtaggctactttgggagggggggatcctgttaacattttaaatcctctttgctgagataccttggaaagagattttaaatactttaatggtgttactaaagatatttgagtatattgcttttacttttactttaattgggctgcacagcttggtttgcattctaagttaattcgtgttttttttagttattatttattagtaaactagtgcaagtattcccagttttacatccagagaaggtacaatgttggttaaatcttcaatagtgcttgatgattcttggttctacatattgattaaaattttcagctcagatttagattataaagttctaatgtggagaaggtattgtttttataacattatccaaaagattttagaggatagtcccagttaacaaagtatgatctcaacgaagctgaatttaataactgtttctctgagatttctttaaaactttgagttgtttgttacagtcataatctttctaaagttttatattagataatctaattcttaaagtacctattgaattatccagttataggatatcccaacttgtctgggtttattattattattattaatgtcatgaatttactatttcattgagcacggtagaaatattaggttgatatatatatttttgagatggagtttcactcttgttgcccaggctggagtgcaatggcgtgatctcagctcactgcaacctctgcctcccgggttcaagtgattctcctgcctaagcctcccaagtagctgacgttatgcatgccaccacgcctggctaattttgtacttttttagtagagacggggtttcaccatgttggtcaggctggtctcaaactcctgacctcaagtgatccacccgccgtggtcccccaaagtgctgggattacaggcatgagccaccgcacccggccaggttgaggtatttctgtggtagaattttttttttttttcctgagatggagtctggctgtgtagctcaggctggaatgcagtggcacgatctcggctcactgcagcctctgcctcccgggttcaagccattctcctgcctcagctttccgagtagctgggattatgggtgtgccactacacccgcctaatttttgtatttttagtagagacagggtttcaccatgttggccaggctggtctcaaacttgtgacctcaggtgatctgcccgcctcaccctctcgcggtgctgggattacaggtgtgagccaccacgcctggcctgtggtaggattttgatacctgttgttttttttttttttttttttttttttgcgacggagtcttgctctgtcacccaggctggtgtgcagtggtgcaatctcggcttactgcaaactctgcctcccgggttcacgccattctcctgcctcagcctcctgagtagctgggactacaggtgcctgccaccacgcctggctcactttttgtatttttagtagagacggggtttcaccgtgttagccaggatggtctcgatctcctgacctcgtgatccgtccaccttggcctccaaagtgctgggattataggtgtgagccaccgtgcctggctttttttttttttttttttttttttttgagatggagtcttgctctgttgcccaggctggagtgcagtggtgcaatctcagctcactgcaagctgcgcctcctgggttcacgccattctcctgcctcagcctttcaagtagctgggactacaggtgtccgccaccacgcctggctaatttttgtatttttagtagagatgaggtttcaccatgttagccaggatggtttcgatctcctgaccttgtgacctgcccgccttggcctcacaaagtactgggattacaggcatgagccaccgcgcctggccctgatatccattttaatcttctttggaagggcccatttttatcttaatgaaatagagcagagtagttttcaaactaaattttttaaaagaccggcctatttcagctcaatctaaaaagtagatcatatccatatgatatttgattatatgtttagaaatattaaagttcaaattggcagtctagatgttaattcattaaaaaaattgtcataatgtgaagaaaccctttaattggatagcttttccttgactctgtcaagctgtggaaatggttaagatctaaaaatgctgggaacaagttagtatgtttgaaggtacgtagctattccacacacgtgtgcacttgctgaggatatctgaggtcactttgtcattaggtgcagatagctggcatccagctaggacaacagttgatgccagctgaaaacacagaccccttgctgttaatacacaagcagaaaagattcttgtgttcaccatgcagcttgggttttaaatttaatcaggttgcagtttcaaagtatagtttttgaaatctttcatcattattttggcacttttactggtgtgcctttattttttgagacaggatctcactttgccacccaggctgtagtgtagtggcacaaccatggctcactgcagcctcgacctcctgggctcaggtgatcctcccacctcagcctcctgagtagctgggactacaggagtgagccaccacgcccagctaattttgtattttttgtagaggcagggtttcaccatgtttcccaggatggtctcaaactcctggccttaagtgatgcacccgtctagtcctctcaaaatgctaggattacaggcatgaaccactgcacttggcctgctatgtcttgatagtcattttttctttgaggactgtttacgttctgcaacgattaagtcccatttctgctgttttttgtgttttgcatttatacaacacttttacaataataagtagatgctgaaattacatgtgatttaaaactattgtttaaatctgatttatgaggctttcatttctaacttaagaagcattttaaatgtgttacaaggtgctcctctgtgggctagactaacctgggagtttaatcctgtgctctagaacagtgctatagtgatgggagtaatggagggttctgcatctgtgctgtctgatacactcgtcatcagccacatgtcactaacgaatatgtggaatgtggcaagtgtggctgttgaactgagttttaaattgtttttaattttaattaatttaaattaaaatagtcacatgtagctcgtggccactgtattggacagcccaactctagaatgttctggtttattatatgagtcacttagtaaaagccagctgcagcatagcctactacttggcaattagccttcctctaataaagattcattgtcaattgttagtctttcttccattttgaaattttagcagtctggaagtagtacctgacagtagttaaatacagtagaaatgtctggaaataaaatttgtttgaacagaattctatgtcccgatttatttctaagaaaaaagactattaagtaactaagaaaaataaaaagaataatttaagccacttaaaatgtaattagctcttaccaaactaatagaatggagtatgttttacatataattccaatttggggggaggaggtaccctacatttagcttctcagttatatttttattaggcaaatgttaaatgagtttccattcctgaagctatatctactgatgtaaggtagaaaccatacttgaaagcaccttggatagaaagggaaattagggctggtcatggtggctcactcctgtaattccaacactttgggaggccaaggcaggtggattgcttgagtccaggagtttgaaaccagcctgggcaacatggccaaaccctatctctataaaaaaatagctgggcgtggtggcatgtgcctgtggtcccagcaactttggaggctgaggtgagaagatctcttaagcccaggaggtggagattgcagtgagccaagatcatgccactgcactgcagcctgggggacagagagagaccccgtctcaaaaaaaaaaaaaaaaaacccaaaaaaaactggatgggaaattagtagttttctatacggataataagcatacctctaacaatctgacagttgacatagacaacaaactgatttttgttagaaaaaaactatttctttgcttcttaggtgggaatctatattttcaatataattattcagttggtcgagtccttagttcaaacacacttttttggttgtagtttaaacttaggaaaccatgaagcctagagtctcagagttaagtatatttggtttcctagctctgcagagtttagcagtcatacttgttgccagttaagagtttcagatattaatggccattggagactgttggtcattgggagtactgtgacaacatgaggaggggaaccaaaatcaagaactccaaaagatggctatggtacaaaagaagcaaagtagagaacaggcttagaagcttctaagatgcgagccaggcaacagctgctgtgtgctttagaagctgagctgccacacactgtgccgaggattttaaattcctttccaaatattttcaaatcagctttaaagtttctattatttatttttgctgtgatctagctgtgatgaaattgctaatgtatagccagctctttagaatgaatctggcctataatggaaggagatatttatggtctacaatgagggttttgttcctatcacaacaaaaaaagccagaatttatgataaattgtcaggattgataaaaaattgtcaagatttgcattaattgagagatgtggctgagcaaatacagagcccccaataataaatcacatcatggttaaagagagaattaaatatagtatgactcaagtcttctgctttccttctttttgctctaccttatgggaaagcatacacatatcctatacatgtatgtgtacttatacaatataactggtatctcccaagccaactttataaatgcagctataatgtcctttaagatgggttagaattcactccttctttgaaaaatgttaattgaagtctactgcacaaataataggtctatgtattttttcagagtattttgcatttttccttaattatatgacagatttagtttagtatgtcccttctttccatttctcttccttgtttttagcttttgaacattttacctctgtgagaatcagaggtggtaacattttacacgttctttgatcagcaaatgatttacaggtgacttggtttaaaataactagatgattctcaactttctcatttttcttcatcttggcattataagatgtctgatttcctttatttccatagtgacactgaaatgactgctctttggtacagttctctaagggttaagtgccagaaagccaaggtaaaactttctgattgggttcagctccacagcttctgtcccacaaacatctgtctcttctagcccctatttctatctaagatgagacggaaacaaacttcctgactgtatcctggagtttttgtttagtatttgtgttagttttagggtgcttatgaaaattcctgtgtttggcaaggtcaagaatgggtccttttgaaaatatgaacaagataagacacacacaactatacaatattatttgtaggaaattattaaacataaaaatattggtctgatcttaatgcatgtgagtataatttagcgtctgttttacatagactgtctttaattttaatggaaatgagattattttcattagctacatagattatgaaaaccaaactcaactgtaaaactaccctgaactaaaggaggataatttaatagaagttttgagaagtaatagttcagcctttgcattgtggaaagagatagaattgctagaagagagcgtaaatgtataaaattagctataaatgtaacttgatttttttcctttctgatactgggaaggaacatgagctctgcaacgtccagtagcagccttttcagagaagcaagtttggctgattacaaataaccagtttgcttatttatcatgaattgtggaagacacaaatgtcagtacgtattgttcattcaatgtaacctgtgccagttggcggaagtctcagaggattgctttgtcccttcctctgtcagaacagtgactctgtgttaagccacttccttctgtgcatgagtggagagatttggcctcaccgttatgagcggtctcacaggcatgaacgtttataatacacatcaaagatctctcttgaatgttgtctggaaaattgtttttgtttgttttttgagtaatagaaggctaatattagtgcttgtttgagtactaaccataataaaggcatcaaggcacaacgcagatatgtattagcaacttaaaagagtcaaatttgagacactgtcctttttaaatctagaaaacaaatgtcttcctccctattttctcttagccccagtttaattaaaaattaagccacaataaaatatggaataactcataaatagttaatattaaactaccagctactgagaaatcagctgctaaaacctatttctttatgttactaaggtcacaccatgcaaagaccagcattgctggtactccttgaaggagtcatgtccctggtaactgaattctatgaattgccactgttttcctcattgtgttaggatcattaggaatttaagttgttctgttcactctgctttaaaaaaattcccttatacttttgagtatggtttaattctgtgttcctaaggcagtcaaaacttccttctcagaagtaaaacatttttctagtgttgtgcgttcccatttggtctaacctaatatttctttagctgatactctcccaagatagttgccaaattactaccaatagtccttccatacctgctttggtgccttcttttgataaccaaataaaccacagactactatgtctaatttttacatattcagagtgtctttgtcttgctggtattaaatgtttgggatttatagcatgaagccaatgcggatttctggtccatggaacgatggtttgaccgcagcccacccctctttgggaaggaatgtctttatgttgggtggagtgaagggcgttgggggtaatgtaccactttagctgtatgtgcatgtgttctctgctgcaggcttgtccatgcgatcgtgcctggagcactctggtttccaggtgacagacacgattcacggtatagtatgagacctctgaagttggagcattctctacagctttaatttctttcttttagttcttggattcaagaattgcttttaaaaaagaaagttgtaatgcttgttaagtagcaccagctacagtttgtgctgtgcttaaagaggtacagtgattaagatttcagaatgttgtgtaataaatatatcacttattttttttgtccaaagcaaatcagattcctttcttctgtttcctcagtagaaaatgacaaacatttaggaattttagaaatttatgggcctcaacttgataacttaattgaagtaatcaagttcttccttcatatcacttccagcattaaggagacaccatatatattttgatattttggtcagaattagaaacaaaccttcttctttgtccttaccagtcagtatactttcatatgtcttagctgggtacctgagaccttagggagctctgcagtgctgacttgatgtagtgaaggcacacttcccgtaaaagtgttgcttgcaagtcaacctttgggatacttagagggagggtattttatttagtcttggaagtctgaggagtgttgggtcagcaggttgccctagatcagacatagattttgagaaggtcctgaaataggcctttttaaaacctgggcttccactcacctgtctttctgctggcttgtgttgcctaaagtgttttagaagttctagtttcctacggatattcatcaagtcatccaattttgaaattattaatgtccaaaaagatcaaggtgttttaggctggtccttgggataattgaagacactctagagactaccataaaatgttagaaatcacttatctgtttaaattcttgtaattcatatgtgcttattaaataatcacataagctatactttaaatcattgcattgagatctcacattttaatgtgttctgtaaaatgttttcagaaagtgctaaaagtggccgggcatagtggctcacacctgtaatcccagcactttgggaggctgaggcgagttggatcactgaggtcaggagttcgagaaagaatgctgtaagaaaccataaaagcaagaaatacgggatgatttcattttttttcatagaaatcaggaagaagtaaggttagggtccatgataactctgagaagaaaacatattgccaagaaaatatactgcaaaatgttaattgaaagagtcacataactctttcaattctatagaattgaacacattctatagagtcatggttctcatgctttttcctgccccacctctcctgagatggaacatagcttcatcatcaacagggacttggcaggccagggattataacagatgccacccctgtattaaaaattatttctctcctagagggttgagtgtggtgagataaccagggtgggtattaagggtctccgaagccacaggctacacagtaaagaagttcatgccactccaagaccaaatgggcatcacagctactgaattgaatccgaatgatgcaccatatcctcctattctcagggtgaatacgatgacctgggagttgtttcagtactcagctcaggaagataataccagattagtagaaagatggattattttccgagaccaaaatttacatatcctagaaactgaggaaactgagtctagctaacagtaggaattttttttttttttttttttttttttttgagacagcctcccactgtcgcccaagctagagtgcaatggcgtgatcttagctcgcggcaacctctgcctctcaggttcaagcgattcttatgcctcagtcccctgagtagctgggattacaggcatgtgccactatacctgactaatttttgtattttaagtagagacagggtttcaccatgttggtcaggctggtctcaaattcccaacctcaggtgatccacccacctcggcctcccaacgtgctgggattacaggcgtgagccactgcacccagacaggattattcttacttatttatttataggtctcaaagcatttttaaaaggtcacaatcaatctaccgttttatgtaaagcctttaaaagagacagtaagctgaatgatccatttagttattttttggtgaggaaggggtggtaggaagaagagaatgtcatccatgtttcttaattttctttttttgtgtgtatttttctttttttctattaaaaaatggatggcacaattttttttctataaaaaacctgtactcttatttatatatcattttagttcagcagccaccattatatttaacatagtacctatttctattctatattatgatttttttgtgtgtgtgtgtgagatgaagtctcactctattgcccaggctggagtgcagtggtgtgatcttggctcactacaatctctgcctcccaggttcaagcgattctcccgcctcagccttccaagtagctgagattacaggcacttgccaccagacccggctaatttttttgtatttttagtagagattgggtttcaccatgttggccaggatggttttgaactcctgacctcaaatgatccgcccccctcaacctcccaaagtgctaaggttaccaatgtgagccaccatgcctggctcatattatattatccataattgataatgatttcgtttcttaaatagcatttccaatttattttgctattgatgacatgctattctttgtagctgattcatcactttttaaaatctgtctcacagcagctcatgtagtattggacgtttaaagatactttgaagataaatgttttgggtgttaaagatgttttaaatgacattttttttttttgagacggagtctcgctctgtcgcccaggctggagtgaagtggcacgatctctgctcactgcaagctccgcctcccgggttcacgccattctcctgcctcagcctcccgagtagctgggacaacaggcgcccgccaccgcgccaggcaattttttgtatttttagtagagacggtgtttcactgtgtcagccaggatggtctcaatcccctgacctcgtgatccgcccatcttggcctcccaaagtgttgggattacaggcgtgagccaccacgcccagccaaatgacatttaaatgataactatatgtgacttaatgacactttctttatgccgctttcacccattcttactatacacagactctagggaaaactgaggtgctgctttgttttcatctcccaaatggggctttattcatttagtcataaacctacttccctcagtattagagaagtctttcattaagtactggccaaataagtttattctgtctgatggcttaaataggttaaaagaaatatacctgctatattgtggaacattaggtaacttaaagtaggtttttgaatcctaaaatcatataacacaaaatacaataaagggacatctcttcctccttggtcctggagttgtcttaccacttattgattttttttattgtatttttattttatgagacagagtctcgctgtcgccaggctggggtgcagtggcgcgatcttggctcactgcaacctcggcctcctgggttcaagtgattctcctgcctcagcttcccgagtagctgagacttacaggcgcacatcaccacacccagctaatttttgtatttttagtagagaaggggtttcaccatgttggcaaggatggtgtcgatctcttgacctcgtgatccgcctgcctcggcctcccaaagtgttgggattacaggcgtgagccaccgtgcctggcccattttatttttaaagcatgaagtagaacattttgaaaacctgtgctctgtaatatgaatatttactgcttttcatagtctcatttaaaatacaaagcctaaatagccgggcgtggtggcacacacctgtaatcccaactattccggaggctgaggtgggagaatcgcttgaacccaggaggtggaggttgcagtgagctgagattgcaccactgcactctagcctgggtgacagagtgagacgctgtctcaaaaacaaaaaacaaaacaaacaaaaaaaccccaaagccttaaattgcaattttgttagaaaagtaacatttgaaaccttgtatcaaatgtatttattataaaaataatacacgcttttaagcactttttaaagtatagaaataaagtaaaaatgaaagtcctctattttctcattttactccatagctaatataattcagactttcaggaatttagtttttaaatttaaaagttcttggccaatcaaaaaatctttttcaggctggtcatggtggctcatgcctgtaatctcagccctttgggagactgtggcaggaggatcacttgagctcaggaattcaagagcagcctgggtaacatagtgagatcttgtctctacaagaaaaaaaaaaaggctaggtatggtggcacatgcctgtggtcctgctacttgggaggctaatacaggaggattgctcgacctggggaggttgaggctgcagtgagccctattcctgccactgcactccaacctgagagacagagcgagacccagtctccaaattttttttttaaagtttcacctcttaaaagctaactttaaaatagtaagtatgcctcctttattaatgctgtcactgtagcctcatttgtttcctacatcacaggctaatgaatatatgactctaacttaagattctcttgaaaactaagcccaaaataggaaggaaagaaagaaggtgggaggaagccagtggcaatatatttttcattattgtgtgccttttaagtgtagaattcagtggttttcagtgtatttatggagttgggtgtcttaggcataattgagacattctgatttcttaggtcttgaaatttcaatgtttattttttaaaagtttttattatggggaatttcagatataccctaaagtagaagagtataatgaaccccagtgtccattcctcatcttcccctcacagccagtcttcttccatcttttccctcatttactccaccagggttattttgaagcaaattccagatgttatattattctgtaaatatttcagtctgtatctatataagatgattttttaaaaatgaccacagtaatgttcacattaaaaaaatttaataattacttaatattaaataaccagtgttcaaatttctaataaatgtaaaaagcttagttttgttttataacttatagaggataatttttattaacttgttagagaaaagttggatgtcatactaaatatttatacaatgtattttaatatctacttcaaatgaatttatgtcactgaagtaaaatcccacggattcctatatatatatacacacatatatatacgtatatatatgtgtatatatatatacacatatatacgtatatgtgtgtatatatatacacatatacgtatatatgtgtatatatatatacacatatatatacgtatatgtgtatatatatacacatgtatatacacatatacgtatatatatgtgtatatatacgtatatatgtatttttttttttttttgagtcagagttttgctcttgtcacccaggctggagtgcagtggcgtgatcttggctcactacaacctcttcttcccggattcaagcgattctcctgcctcagcctcctgagtagctgggattacaggcatgcgccactatgcccggctaatttttttgtatttttagtagagttggagtttcaccatgttggccaggctgatctcaagctcctgacctgagatgatccacctgcctcagcctcccaaagtgctgggattacaggcatgggccacccccgccggccccaaaatatatttaacttcctgtcttcctggacgaaaaagttattctcttacctttccatgaatatacacttggtttgagatttcctcgtcttacacttcttatttacaggacttagggagcctgaacattctgtactgaggaaacagaacagagggctggatattgcagaagtccatcttgccttcataatggtgctcttatggtataagtgatgaattcatctgggggtggagtgagggagtgggcaggggagattatcatggatttactaccacttatagtgccaatatgtttaaaaaaaggaaagactttggggcctcagccaatttttaactttggatgaagtaacttgcttttgcgagcgccattagataagggaaagggacttctgaaggctaaataacccattaactgtatctccctaagaagatacagttagagtaacaacagcataggaataaccatagtcatttagaattgtgtacaggtcaaatcccgttacaacaatttcagaagagtatctaacttatttgtcttaaagcttatactgcaaagtattaatatgtaatatatcagattatagaacttttttgttcttaagtttctttggagaaaaaaacacaaggacttttgaaggggcatttctaattaaccccacagccagcttccttgttaccaagaccctggatgggaatttgctatcactggttggctgcgtggcaccaggcagctcgttgggctcacttgcctcgtgctataccactccggagtgttcatttattcatgcagcctaaaaagtgtagtgggcatcgagatttgcttggtgctctgggagaagactaacatcaataaaagacgcagtccctattcattaggaatttacagactgcttggaagaggcgacccgcaaagcagagtctaaggaacgatgcggccacgagagtgtttggaattagggtgaagggaagctttccagcgcctaccacatcgcacatcaaaccatctgcaaagatctgaaagcatttttgtagtattttgatttttatagctttcattgtaacgggatttaacctgtaacatcttttcatcagagaactgcagattacacaaatgaaaatatcataaatccccatttgtactttctgtactttgtaccaaatgtacttaactgtatgctaaatatagtattgaatatgtatcagtgcaaacgttaagagccttttgcaaatagatttatgaacatggatacttattttgtttacttttatattacatgtactgtttatacaaaacatgcattaaaacgtctgtaatgttatttcagtgtgtgatggatgagtggttgctttaaatcactaggtttttgattggtgctagagtagctggtgttgcttaacgtggcattttttttcctgtccacactttccacccttggtacaggtatttttgataaagctgtggaatggaaaggtatgtttttcatggggtgttcaagaatctgttaccttaaatttttttaaagaggtttcctttctgggattccttttgtgtctggcttaagcagacttagtttaatttaacaagtaacatttttagaggcagtatttgagtataaaagtttgacgtgacacaagtttctgactttacttttccccattcccttattaaagatagtacgaaggattttaaagcatttggggtggggggttgctcttaaaatatatgatctgtaccatgagaaagaatgtagcccaagggttgtttatggtagttaatgatctagtgtgttgttattgctagaatcctggttatcataaatttgcaatttcattgaggaaagtgatataagtatttcttaatatattaatatatgaaataattttagagactttattaaatacacacagtcctctttatggtagaggaacagttcagcttgagctggtgaccggctgaactagaggggttactctgggaaagtggcgagtcggcagggcatgtctgcacagattttgtgccaggtttcctgcctgcacagcgctttcttctctgtccaagttctgtgctgaccacagctgtccacaggcatgtttacactccctgttcttgcaggttgacttgagagaaccacgtagctaaattggtgagagactcagcctgaccgcttgtctttagaaggcctgattggaagagtgcactctattgactttcctctaacaatgaaattgtgaaaggtacatggggcggctgtgagacgtgcagctatcgggtctcaccggcacatcccttttctcgtaaagcaatgaagcactttctaaggtgttggtactagtgctggaggctgctggtgcattagatgctgcccgtcacatcggtgggctgagaaaccttccttaaagacctgtgatgttttgtaaaccctgactgttctggtggttgcaaagttagtgtctgtttagtgttccccatctcaccagaagtgtttcctttttctcattcatagaggtcctgtaataaagagggatccgaacaagctcagaaagaaaatgaatttcaagtaagtaattcagtctttctgcatctgtgtgagatgtgaactagtgttagccacccttcgctactccagggcttggcagtgcctcttatctacccttggaaaatcctgatctatctttctacgaggaggggctcttggtatatctatcagaagccaccttacggagactgagtgagcggtgggtattcctcattcctcctgagagtgtagactgtggaagtttggtgtctttatggcaatcgaaacagcattcggatgttggcagatggcagccaggggagcattcgtgtgtggtacctgatgaggaggccctggctgccgctgctgtgatgcctctctcaccccctttctggtcgttcccacacttcccatcaggaagcgggtcactgcccagtggttttggtggccacccattttccatgggctaacagcaatgttttttcctatggatgatacccaagttggaaaagcttcttcctagacttagagaatgtgaccccactctctgaaacacacatgtgcagatggcttgaggccaagagcactgaccgatggagcctcagaggcaggggtctggggtgttggtctgcatgccccagcgtaagcaccttttgagcatctctgccattatgtgcaggctcacagagaagggtgcatgtgcacacatgcccaacatacgtgggtctaagatgtagatacacacatcgccacatcacttttaccaattgtatattgattattaaaatggtcaagaaataggctgaatgcggtggctcacacctgtaatcccagcattttgggaggctgaggcaggtggatcatgaggtcaggagtttgagaccagcctggccaacaaggtgaaaccccgtctctactgaaaatagaaaaattagccaggcatagtggtgggcacctgtaattccagctacttgggaggctgaggcaggagaattacttgaacctgggaggcggaggttgcagtagaccgagattgtgccactgcactccagcctgggcgacaggagtcgtccccaccaaatgcaaaaaaaaaagaaaaaaatcaagaaatagacattaaaacggttgagataaaaaaggaatgaaagtgatgatattttttccacacttttcagcggcttgttttacatgtgtcttgctctgggtgccctgctagaggatctagaacttgtgctctctggagtgacagtgactgggaagtccttgggtgggaagtgattgacaatctgttgtgaaccattccaagccctttgtgcagaggcctttggacatcctgttagctgaaaatggtggatcaccaggacctgcgtgatgctaaatccaaagtacttttcagttctcattttattttgacttctcagtagcatttgacatgacccccacccttttgaaatgtttcctctcctgagggcagccatgacacagagacacaaagtacagatctggctgtctacatgctagggcgccccatgatttgaccataggccctcttctcatgttgtcctgtctccctcggtcacctgatctataggccaaagggccgctacattcttcctccagccctgacctcgacttggaactaatgccattggctagcagtctctcctcggatgtctcacatgcccctcaaactcgccatgaaatcgcccggccgatttcagtcttttttatgtgaattttatatgaatttatttttaaccttttatttcataccaattttagacttacagaaaaaatttcaagaatagtacagagaggccgggcatggtggctcacgccgtaatcctagcactttgggaggccaaggtgggtggatcacgaggtcaggagatcgagaccatcctggctaacatggtgaaaccccgtctctactaaaaatacaaaaaaaattagccaggcgtggtggcgggcgcctgtagtcctagctacttgggaggctgaggcaggagaatggcgtgaacctaggaggcagagcttgcagtgagccgagatcgtgccagtgcactccagcctgggcgacagtgcgaaactccgactcaaaagaaaaaaaaaatagtacagagatttcccatgcacccctcacccagcttccctaatgcgaacatctcacataaccacagtgcaatggtcaaaaccaggacattaacgttgatgcaatagtgataactaaacgtctgtaatcccagcactttgggaggctgaggtgagctgatcacttggggtcacaagtttgagaccagcttggccaacagggtgaaaccctgtttttactaaaaatacaaaaataagctgggcttggtagtgaatgcctatagtcctagctactcgggaggctgaggcaggagaatcgcatgaacccaggaggcggaggcttcagtgagccgagatcttgccactgcactccagcctgggctatccatctccaaaaaaaaaataataataataatatctccaaaaaaaaaataataactgaactatgacctgaattgaatttcagaagttttcctatgcatattttcttttgttctgtctcgagatttagctagatctcaagattgcattggctatttctctttagtctttttcagcctgtaacaattcttttgttatttgtaatctttatacttgtgaagagtactgatccgttattttggaaatgtctcctcaatttcagcttgtctagtgttttctcacaattgaggttatgcatttttggctgaaataccacagaaatgctgttatgtcttctcaagaagttcataacatcaatactcttcttcctgggttttaaataaatgaaacttcatagataaagtgaaaagtcagtttaaaccccttgttccattctcaaccacttctctctcccgtttctgttcactcttcacatgctccaatctgacatctgtccacccatcactctgaagctgttcttttttttgtcaccaacaggttccatattgccaaatctaatggccacttagcagcaccattagggaataccactctccttcctggcagtggcgcctgcctcaccttgccttctgccctggcccctctttttgctgcctgaacttaaaccagtttttcaagttgtggcttgtgaacctctagtggggcatgaaatgttagcatgttgattgctttttaaaatgaaatagagtagaaaatattaataagtgttgcccagttgtgagagtgagtattgctgtggggatagtgtttgttttgggggtgtatgcgagggtgccctgtagaaagctttcttactgtggtgacagtcacataagaaagggcattttaaggcctgtgctggttcctcctcttctgtccccaggggatcgaacccagtttgtgagctgtaaacatcaacaacatgttgaggacttgtgaattggtatctgtaagccccagtccacccggcaatctcatgctctgctcttccttttccttgattgtcctgttccagtgagacaggcctctcagttccttgaaggcgtcacacttgttccttcctcatggccctgtgctcccatggggctgctgtggcttttcacacctcagatctcaggtcagttcagtgtggcctccttagaaatacccacaccaccacaccagtcacccttgtttccctcatggcagtgagcccagtccatagctgcgtgtacttgcttactgtccatttctctctctctccccatccctccttctctgtcatgtaagccccgttgtgggcaggggccttatgtatcttgttctttgttggttccctggcgcttagcacagtgccaggacatagtagacattgagtaagtgtgttttaggcaaatgtattaatgagtctttatttctgaagcccaagtaaattgttccaagttgagatatctgaaaaagtaggaccaattttccctccactgtcaccagctgtggctaaaccagtgcgtggtacaggagagaacccagccatgtctgtccagccccctttttaccatgctcactttcaggagcaatcaggaaggtgcctggagacatagtgatgacaagaagaccaccagtagttggtacacttattctaggattctctgctgtccttaacctgtcatttttcttgcttgtgcctgggtgttctctttcattttcttttcttttgagacagagtcttgctctgtcacccaggctggagtgcagtggtgtgatctcggctcactgcaacctctgcctcccatgttcaggcgattctcctgcctcagcctcctgagtagctgggattacaggtgcccgccaccatgcccagatagtttttatacttttttggtagagacagggtttcaccctgttggccacgctggtctcaaactcctgacctcaggtgatctgccctcctcagcctcccgaaatgctgggattacaggcgtgagccaccgcacccggcctcattttcttcctctccaaatccttctctccatacaccatctccccctttcttcctactgtgaataaatattgaactacagtattacgtaagaataagtgtgtttttgtttacaatgtttagggcagtgctaaagagaattggaaagttcttacatctctttccctcttctctatgtcctttctgggttgactcagctctggagaggattctggctagtgctggtgacatgtgttgacgatgccacacgtaaataaagtcacctccgagaatccttcccagtggacatgatgtgcaaaatgctgaacttccgagtccagcacccccttgtcctgccatgcccagcccctgtttacttttgtgttttacacagcatgagggtggtggtggggaccacagtcttcagagcaccaggaccgtgctgccccctggggagcaggggagcataatgtctaagcagagacttggaggaggctttgcagacccttgcttaaatgccccggatactttctgtgatgttgggcttggagtaagatggggactgcatctctggacaacactaccataggactaaaaagttcttggaaaccttttgacaactaaatagagatactagatctttgttttcattctctaaggttttaagaaataaaacctgtctgatatcaaatcccaccctaaaattcattagcttgatagatagatgttatcagtttattgtcatatacacaaaaccacaaattaggaaagattgagcctcacaagatcacaggccataattgtgaggattatacgaatgatggttgtagacgataattgtggggggattaccggcaaatccatttacccccacaaaatgtaaaagtgaccaaaatactttttgctttaatgtggtctgatatcctttggaagtagcttttcttttttgttttcttcttactatagtactgtatcatttcctaataagtttgtcctcttggtttctcagtttttggtaacgtgaatgtgttttagaggtttctctgggatcatgttcctccacagcacattgcttcacagggggtgaattagaatcatctgaaagctttttcaaaacagccctgctggtgcctctcttttaatacttggagtaagacctaggaatctctttgcaaaagctcttttttttaaaaagagacttcggtggtggtggggcatctcactatgttgcccaggctggtctctaactcctggcctcaagtgatcctcccacctcagcctcccaaagtgttgggattacaggcatgagccaccgcctggcctgtaaaagctctttaagagattcaggtggacctctgggtaagcgtgactccttcactccaacagatggaaaccattatgctgtaatgtgctgtttaagggggaaagaccaaggactgaatttgctttgagatcaaagcatggattttgaaggcaaaatgatgatagatcccacgttaattattaggacgaagatagaacagacagcatcatagagatttcagcaagacaacaaacattcaataacaggaaaaggtcgggtgtgccaactgaaaatagcaatctaggatgctccatgctagggtgctctttggactagaaagccgtagaccctggacctaaatcagtaattttcaagcttgttggacccatgagcccaatttagtaggcagaaggtcctttggatcctttgctttaactagacacactcaaccaaaagcaaatcaacccttaccagaatggatggtgttgtggcctttggtgagataccaagggtgagactcctatataggttgcgaaataaatagaagcaataaaagcactgatggatatttttctatttttggatctagtgacctaaattaaactcatattttaaatcttatcaatatagcatagtgcttgcaagcatgaatcctgcaaatgacacgatgtgtgactttggaacctctgtttcttcatatttaaaatggggatgatgataacagtagtgcccacgtgaaagaatactcatgaggatcagatgaaacactcctgtgagagtgcttctgatgcctggcgcttagcaaacactcagtaaacacctgatttgttgccatctgttttagggggctgaggccatggttctggagagcgttatgtttgccattctcgcagagaggtcacttgggccaaaactctatggcatctttccccaaggccgactggagcagttcatcccggtaagatttgttcataaacgcttagttgacatatgccacagacagaagatggcttctttgtctcattgctgcaagaacctgcaatgctgtgttttcactgttaacctcacctatgtcattaaactgtatcagaaatcatgaaaagcaacatttattttgtacttacatccgaacctctttcttttctgtaaaggtgtattcatccaaatttgaaatatatatgaaacttaccattttattgtcccctgaggctgtgtaccctgagactttgcccttttcaccgtgttcctctcaacttctagggccctgctttatagaacttgctgctagaacaccttggccctgctcagtctctgactgtagccctgtgggggccatgcctgttctttcccatcacccttccttggtttgttttgtgcattcctactgagtctccctacctcccatcttcctgtccccatatgctggtcaaattcttagatttcaaggccttgctccaagaccttgcagtcttatttctaagcagtcaggattattttccctttcttattgtcccaaggcagttttaatgttgctgtaacatttaccagtataccatgtcttagagttacatgtacatatctaaagcataggtcctgttcctctacccacccacccctgactccatgccctgcacaatgcttcatgcccagaggttctcatgaaccctaagtgttgaagtgtggctctgagccctggcaatacttctttgattggcaatgctcgtctttgtcagcctgcactctcttcctagatagatcagatattccccattttcattgagcgtaagttccttgaggactagaatcataagctgctagcttttcctgccctgctgcatgagatatcttatccatgagaggcctgggcatgtccagggctgccctgtacatctgtgcagatggagcccagcactaggatgcctggcagaggggtgctctgctgcgtctggctggggaccaggggcaggggtttctttgtctaatcccacagcccagaaacagagaggctagttgtgctctgtctccccagaagaggtatcctcttctagttgacagtggcactgtccgtctgtgctagtgttgtgctagctgccagtgctgaggatgtgtttagatgagtggatggtgccttcactgcgctggctttttcctttagtttgctccctggcacctggctatgttttagtagagacagggtttctccatgttggctaggctggtctcgaactcccgacctcaggtgatccacccgccttggcctcccaaagtgctgggattacaggtgtgaaccaccgcgcccggccgagatgataagtttttgaaagaattttgtaaataatagaacctcatatggttataagtggcaatataggtgaatcttacaaacataatgttgaatgatcaaactgcaggagactgtaagtagtatcataccattctataaagcctgataaattttaaaaattgtttaagaatatgtgcacatgtagtaaaagttctctttttggaaaaggtaagggaattgtgttaacacaattcagaataataaaaatatcttggggacaaaaagggcaggcatcaggacacatagattatagtatctgtggaactgattttgttctagttcttaagttctatctatgctcttgtatgtattgtttattatatattaaattttttgagatgggagtctcactctcttgcccaggctggagtgcaatagcatgatcatagctcactgcagcctcgaactcctggactcaagtgatctttctgccttagcctttcaggtagctgggagtacaggtgcacaccagcacacccagcttattaaaaatttttttttgtagagatgggtcttgctgtgttaccctggctggtcttgaactctcctggcttcaagctcttctcctgtctcagcctcctaagtcaccaggattacaggtgtgaaccactgcacccagccatagtgaagatttttttaaaattctgttatatactaggtttgaaccatatgacgccgccggtgtttgactgtttttgaccaacaagaatggcagtttcatttgattcaacctaataccgtatgttatttctagatttgcttttttttttttttttttttaagatagggtctcactctattgcccagtatagtgaagtataagtggcctgatctcagctcactgcagcttcaacctcccaggctcaagtgatcctctcacctcagcctcccgagtagctgggactacaggcacgtgccaccatgtttgactaattttgtttatttttttgtagagacggggtctccctgtgttgcccaggctggtctcaaactcctgggctcaagcagtcctcccgccttggcctcccaaagtgctgggattacaggcatgagccaccacgcctggcttaggtttactcttcactgcttgggatcaggtgatttagtttcatgattcctgtagccatctttcaaagggcatgtgagaatagccgggccactagggatagtaggtagtctgtttctctttctctactggggaaggaatttggaatactgagatttgttcatatctgagcatgttagcttcagattttccttgttgccaaattaatggcagttttgaaagctgagtgagctaccttaataagtcctgtgtgtcctgctgctggaagtggaggccctgttcttattgcagcatggtaatttgttgacagtgctgtggtgacagtgctttctggagggagttgaatagaaggttgagtccaatgcttacagtgagctcttagctctcagtagcagacatctgccacttgctgagctgcaccctgggctaggtgctgtcccagagacctcatctgcattctctcctccagctctcctggcaactctgtgagagaattcatgtcctgattcccatttgatagaaatgggaacacacagatgtatgaggtaacttggatggccatgtagctttgaaatgagaattaaagccacaatttcaactgaggtttccctgagttgggagcattcactcttacccctgtgctgtacttctttgcattttcacagaaacctctctttagatttctgcagggtggcaggttgcatgaggaagctctggaggtctcagttgattgtgagctcccatgggcctcctgtaaaagggcagccaaacaagcatggcctcgggctgatttaggggaagtgcaggatgcagaggccaggaggaagtcctctagacactgtttctttgcccaactttgccctggacacctgctctgtgccaggccaggtgctgacaccaccactgggagcagctggagacggcccccctgtctctgtgacgcatctcctggttaggacctattctggaccccacatctcacctgcaacacatcagagtagaatgtcccagctgatggaggagctggaagtggggccatgtgataaactgctgaagacatggacttcagcattgggtagtgaatagacattcagtgtggttttagaggccagaataatagatgatagtgtagtagttcaataaaatttaaggaaggagttctcatagttaaaaagggttcaaaatgaaatagatctttggaggtggccggctcctcactgtagaaatgccatagcaattgctgggtcactgtctgtagggacacagtgtccattcttaagggaatttggggcattgggtgagacttaaatgcactacaaaaacacttctcgttcctaagactgtgtgatctcactctttttagtttacttggtaaatgtcagtttttaactcccttttctttttcagagccggcgattagatactgaagaattaagtttgccagatatttctgcagaaatcgccgagaaaatggctacatttcatggtatgaaaatgccattcaataaggaaccaaaatggctttttggcacaatggaaaagtaagtggtcaaatcacttggtcctaacatagttttacagtggtggctcccagaagtaccataagtgagcatttgtttgccacagtagtcagaggtcttcctagttcactgaagtgcagggtgtcagctggtgatacttgtctcataagtaagtctttcttgtgtgtaaaagtcaattcctaaaccaggaaagaaggcttatgcaaaaatgctattgaacgggtgaagggacagaagaaagtcaccttcctagaatgccacgaacccccaaggccactcctcttcccctcagtcatggcagtcagaggggtcccactggcattgtgactgcgctgggattgaatgtttaaccaaagccccaagaacagcaagccttggtgaattgatcggtgattctttgttctgttcttttttgaaaattttttaataggtatctaaaggaagtgctgagaattaaatttactgaggaatccagaattaaaaagctccacaaattgctcagttacaatctgcccttggaactggaaaacctgaggtgagttttccttctatttcctgactttaaatattcttagtcactaaaactgttgtcagtaaacattgattgagcttgccttatgtctggcattttacattggttttacaggatgaatttaaaccataagttttgtcatctggaattatggttctctagaggactagagattatggactctatggactagaagcccacacgtggcctctggtcagtttgtgaaggttccattgagaaggaaaatgtcaaaggagtggcttggtggccagggcagtagagtgtctggtggggtggattttctctggtggggagaagggagtaagggcaggctggggagtgtgaggaagatccttcttccttacagttcaaccttggcttttgcgagaaacagagtcttcatactgatctctgaagcaaggccgtcattgtcctcagagtgatgcttggcgcaggccactcacatctgtacactaacaagtatttacaccttttttttttttttttataagacggagtctcgctttgttgccaggctggagtgcagtggcgcgatcttgactcactgcagcttcaccctcctgggttcaagtgattctcctgcctcagcctcccgagtagctggaactacaggcatgcgcccccacacccagctaatttttgtatttttgtggagatggggttacaccatgttggccagagtggtcttgatctcttgacctcgtgatcggcccacctcggcctcccaaagtgctaggattacaggcgcgagccaccacacccagccacaagtatttacacctttaattactcaggtttgtgcctcctctgctaggcttgatgatcgctgctgagggaaaacaagtaaacaaataaaataatgtcaaattgtgataagtgctgtgacagaaacagatcaaagtaggcccttagtctgcataggaggacctgcttgggtcactggtaagagaagggctgtctaagggggtgctatacaagccgagaccagcagagaaaggggctccaggagggagcggcacatgcagaggtcctccgggggaagagctgagtgcagagggcctgtggagttgttgccacgtaatgacgcagttgtcagaattcacatcacagatactactctgaaactgtgtgttgctttggagcacgaatttggtgctggccatgtggagaaagcaagactgtgtgcagctgactgagaagcgtgatgggtaacagtgaaacctttcttttcagatcattgcttgaatctactccatctccagttgtattttgtcataatgactgtcaagaaggtaagaattgctatgttctgttacagatgaggtttgtgtgcatacttagaaaattactggcagtgtgtctgaaaaatgtaaggtagcatcaagagtattaggtacattaaagtatgatacaaccagacaatgaggttttgtattatttttatagagtatgaggccagtcacaatgtctcatgtctgtaatcccagcactttgggaggccaaggtgggaggattgcttgagcccaggagttctagaccagcctgggcaacatagcaagaccccatctctacaaaaaataaaaacattagccaggtatagtagtgtgcacctgtagtcccagctacttggtaagctgaggcaggaggatggcttgagcctaggagttcaaggctatagtatgctgtgatcgcaccactgtactgtagcctggatgacagagcaagatcctgttaaaaaaaaaaaaaaaattacatggaagaaatccgaaagaatattcactaaacttgggaactgggatgaagaacttaaactttctaagtcacatattactttttcagtgtttaactccttacagtaaacatgtatgatttttttttaacctgaaaaagcaataaaagaacaagatccactgcctaccccattgagtcccgggcccttcccccttctgcaccacacagcgtagtgttgcttatcgcaacacgtgtaatcctaacacctcctctcctagtatcagtgcactgtgctattaattatttcgggcttctctgctttgaaaacatgacagtgatatgttccttactgtaacaaaacttcatcccatgcaattgcacattgaacagtctcatcagaggccccccactatgcagctcccactggtgctgctgacatggcctctctctgccttgaccttgcctcccctagtcacagtagttcaggtcccaccttgagcccttgtttgccaggctcagcagtttgcttttaatcctgagaacagtttctcatgaagactcgtcatccataagccattcatttgagccaaattaccttttactaattagctgctcatcgctggctaactcaaggagggtgtagacattacagctacagctttgtgtattacccttgcccttctggtggtgagggggtgataaatggcacagacatcactagagagaggggactggaggagatcggctgtgttgatgatggcaaagtgtaggaaggatcgaagaggtaacagttgtacattaattttgttgtgctactttgggcgtctgcctccaatttgccttttttttgagactgttactgtgtcacccaggctggtgtgcagtagtgcagtctaggctccacgtaaccttagcctgttgggcttaagtgatcctcctgccttagcctcctgagtagttgggatcacaggcgcacaccactacacctggctaattatttgtggagatggagtttctctgtgttgcccaggctggtcttaaactcctggacttaagtgatcctcccacctccacctcccaaagtgctgtgattacaagtgtgagccaatacacgttttctggtctccagtttacattgtaattgctactctaaatggaaaaagtatgctgaagagcctagacactatacctccactagaaatcctaaggagagagagctgctgaaaacctagcgaaggttggctcactggtgccagcagcaggatgtcggagatgctgaacatcatgtcgagtgtggggatctcaggaacgcaggcctgcagagccaggctgatggctgaccaactcctgacccagaatccaatactaaagcaaatagtcttgtaggaatgctgcctgtggtctccttgggaaggaaaagcaggcaagaacaaagcaggggatcccctgtggcagctgagctctcccttgcctttcttaccaggagggcactcccacagcttcccagctggagtgctgcagccagctggcctgcagacagcaaaccaagtcccagggctgctgagggtggtgtttggctagcacgagctcctgcatgccaccatgcagaacatttgggaagtactgtcctgacagcagagcaagaggccaggctttgttccacagtgatcctgggggtctggcgaggactagggctgtgagcaggggttctcatggccaggtgggtcaggagccaccctgcatagggttatgcctcccgtgagcacttctacgctctgtctaggccctggtgatgtccacagaccaaaagccacattcagttaggattccctaagggatcaaatccattctctcggctctgctgttcaaggacttgagccttctattgtaaaacataaaccatgttatccaaaccttttgcaggtaatatcttgttgctggaaggccgagagaattctgaaaaacagaaactgatgctcattgatttcgaatacagcagttacaattacaggtactgtgttacagtccagtgtttccatctcaatattgatttatcattacgatatgcttaattaacagttattagagaaaataagtcaaaatgccgctctgagttgcaagctgcttcacctggaatcagtggcttctcgtccagtggccggtgatggttgtggtgaagcagcacagccttctttgttcctagcagacagcgctagttggggacagccatgccattcagtccagactttggcattttcttttggcttcagaggtcattttcttctcataaatcctggtctaggagacacaatgttctggagtagtggttcaggtgcacctgtatagctttagtcagctgtgatgctgatcaaccacctgttgtctctctctgtcattaaagcagctacagtcctgctccctcagcaagtccagatggcaacaggagtggcgtgctcggaactcagcctttctttcttctgcagtcagggagcctccaggcatacggtttgcctcattgtgtgcactgtcttatgtcttatttcaggggattcgacattggaaatcacttctgtgagtggatgtatgattatagctatgaaaaatacccttttttcagagcaaacatccggaagtatcccaccaagaaacaacaggtaggagatgagtttttgtatacttgataggaaaattacatgtcaatttcatgcagttagaattacatcttcttttttattttttgaggcagggtctcactctgtttcccaggctggagtgcagtagtgcgatcatggctcactgtacccttgaccttctgtgctcaggtgatcctctcgcctcagccccccaagtagctgggaccacagacgcatgccaccacgcccagctaattgtttgtattttttgtagagatgggatttcaccaagttgcccaggctggtctcaaactcctgggctcaagtgatcctcctgcctcagcctcccaaactgctgggattacagttgtgagccaccatgcctggcctacatcttcatttttaaagataaccttttaaaatttggtttatgttaaaaaatgttattttgttcctgttaaatgtagacacaaacttgaccttttagtccagcttattaaaaatctctgtgccagagatacttgtattcagagaagagctttgtcatcctttgtagttccttgtagtatttttttgaaaagcccagccttgattctgctttctggccatctttttggtgatcactgacctttttctattcatttcacactatggagagagaagtaatctttcgggcaccagggtttagtagtgggaggaaatatctttggtgttaacagttccctttcctgtcctgaatgatgggaggaggctggtgattgtgtggagaatcagttctcatgggaatttcctcctgagatctttctctcccattcctcagcccagcactgaaaccttggtagcggtgctgaagctgagtaggattgggagggtgcaccaagcctgcctccaaaatagtggtctccagtttatgttttaagtgctactctaaatggaaaaagtatgctgaagagcctagacactgtatctccactagaaatcctggggagagagagcggctgaaaacctagcaaaggttggctcactggtgccagccccaggatgtcggagatgctgaacatcatgttgagtgtgtgtctcccagtgtgtcacagtagatgcatatgcttagtgacagctattgacattgtctattttaaccatcattgatcctaacacaattacttttttttaagctccattttatttccagttacttgcctgcattccaaaatgactttgaaaacctcagtactgaagaaaaatccattataaaagaagaaatgttgcttgaagttaataggtaacatttttccttttttgatttgtaaagatagctttcctctttatagactatatttgggagatgctgacttgcaattaggagtattttagagcttcttcttctttttttttttttgagacagagtcttgctctgtcacccaggctggagtgcagtggcgcaatctcggctcactgcaacctccgcctcccgggttcaagcaattctcctgtctcagcttcccaagtagctgggattacaggtgcctgccaccatgtccagctaatttttgtattttttagtagagatgggtttttgccatgttggccaggctagtcttgaactcctgacctccagtgatccacccagctcggccttcccatgctgggattacagatgtgagccactgcgcctggcctaggagcttctttttaatcgtacatctttaggacttgcactttgtcaaaaatagaatctgctacttctccattgtggccgagactatgcagagctttcagatctgagcatacagcaggcaaagtatattagtctgttctcacatggctacaaagatattacctgagactgggtaatttataaagaaaggagttttaattgactcacagttctgcatggccagggaggcctcaggaaacttaacaatcatagcagaaggcaaaggggaagcaaggcacatcttacatggcgccaggagagagaggggcagagagatagagaagaaggtaggactaccaaatacttgtaaaaccatcagatcttgtgagaactccctcactattgtgaggacagcatgggggaaactacccccatgatctaatcacctcctgccaggtccctccctccacacatggggattacaattaaagatgagatttgggtggggagacagagccaaaccatatcacaagaagagttcccatgtccaagaagggtcaggacactttgtggcattctgaactgtcatccagacacaacaacccagccatacagggctgctgccacccagagcctatagaattttttttttttttgagatggagtcttgatctgtcacccaagctggagtgcagctatgcgatcatggctcactgcagcctctaactcttagcaagcctcttgcctcagcctcccaagtaactgggactacaggcacgtaccaccatgcctggctaatttttgtatttttttgtagacacgaggtcttgctctgttgcccaggctggtcatgaactcctgggctcaagtggttctcctgccttggccccccaaagtgctaggattacagatgtgggctactgcatctgtccctgcaaacttgtcactgatgcttctggagtggcggccaccatatgctgtgttttaactcttaagtttctcctagaaaatgattaaacttatgtttatcggttttaagtcttgcttttaactgttttctcaacagttttcaaagcagggccctgaaacttccagattgtgcaaaggtctagaccactatttgtccatctctttagtcaagaggcctgtgggttgttcctattatttggggtctcctgtgacattttttggtagaatggctgtttaagtcactgtggcccctcatctttccacgcacttagcacagtcatctcctcgtggcctccagagtgctcacccccaacactaagtgtgatgtcacacctgcctacctgctgggcttcaccgcagcatacatcatctctttctgtttcttgaactggtggaaatagaaaaaaacagatggaggagaacccagacagaaagggtagcacacgggactcttgtgggccggggaccacaggatgaacagagagtagggttggaggatactagagcaggcactcctaaatttgagctttatcttcatgtggatgagccctcagggtattgtttgaggaggaacttggattcacagtgacttgggggcttggtacagcttagagatggtgacgtggctcacgctctctgatctgctcttttcacttctgtgtgacaggaggggatgggacaaggatgggatttgagaattctcttgctcaaggagtgagagcttcatcccgcctccagcaaagggctgcctcttggttgctatggtgtgcaccctcccttgtagcaagcttgctttcttttctgccagcatggccacccaggccttcacctgcaccctgtgaatgtgaatatattcaccttgtgaatatattatggccaagtggcatttacgtgtgccatggccaggccagctgtgtgtgttcacactcaccagtgcacctgtcactagcagatgagggaagggtgtgggagtggtattcccattgttcttagttagtcccgtggaatatagacccatgatttgccaacactaactaggtttgcatccacacaagttaaaatgtccatctggcatgaaatcatttcatcagtcctgtaactgatactgtatgtctcttatatgtttcttgcttttatcattccaggtttgcccttgcatctcatttcctctggggactgtggtccattgtacaagccaagatttcatctattgaatttgggtacatggtatgttttagcagcgtttttgtttttttttttcttcctactcccaggtaaaaatgctatagtatttgtgaatgttggcagcaaatgactgttccttacagagggttctctgtctccccaagtacccgaatgtggtgacctggtggcatcaggacagtgtggctcagcccaggaagccgggggagaagccgctgtcactgatgctgtggttgcctttggaggttgccctcacttccaggccagctgaccttgcctcccctgcttcagagaagtgcctgcaatcctgatggggaatgtaggcatctgcaccctcgaagtccagctctgacctcagtcccttctgacacgggacagtaagtgaagaagagtgggtggctcctgcctgtgctgtggaaggttttatttatcggttaccacttcattctccagcctgtagtgcccgactttgggttggaagctggtaattattgaattagacctcctgtttttcataggcatgtttgtaaccaagctaggctgtcatttaattttaaccttaagaattgtcagccgggtacggtggctcacgcctgtaatcccagcacttcgggaggctgaggtgggcagatcacctgaggtcaggagttcgagaccatcctggccaacgtggggaaaccccatctctactaaaaataccaaaattagcatgcatggtggcgggcgcctgtaatcccagctactcaagaggctgaggcaggagaaccgcttgaacccaggaggtggaggttgcagtgagctgaaatcatgccactgcactccagcctgggtgacagaacaagattctgtctcaaaaaaaaaaaaaaaaaaaaaaaaaaaaactgtcactgacatagaaatagaaagtatttttaaccttcagacaaacctttctgttgttccatagtgaatgaatgttggtgagttgtcttggggtgggggataacacaaatgtccacagtctggtgagctgccttcctttgggacagggatgggactagttcattttgacctcctcagtcttatactacaatgatttctacttctaggcagaaggtttggtaatgcaaggatgatattaggtaaaagaaggggacattggatttttaaagcagatttgagtcatggtcaaatgatactgtacgacaaagcacacttcgtaacaaggaatattactagagataaagaagggcattttgtgataataaaggcatcagtacatccagaggacattaaaaacccttgtcttgcttcaaaagacatgatattaaaactgacaaaagtgaaagaagaaaatggcagattcacgattaaagttggtgatctcggccggttgcagtggctcacgcctgtaatcccagcactttgggaggccgaggtggttggatcacttgaggtcaggagtttgagaccagcctaaccaatatggtgaaactctatctctactaaaaatacaaaaattagctgggcatggtggcacatgcctgtaatcccaggtacttagggaggctgaggcaggagaatcgcttgaacctgggaggcagagtttgcagtgagccgagatggcgccattgcactccagcctggacaataagaatgaaactctggccgggtgcggtggcccatgcctgtaatcccagaactttgggaggccgaggcgggcggatcacgaggtcaggagatcgagaccatcctggcaaacacggtgaaaccccgtctctactaaaaatacaaaaaaaaaaattagctgggcctgttggtgggtgcctgtagtcccagctaactcgggaggctgaggcaggagaatggcatgaacccaggaggcggagcttgcagtgagccgagatcacgccactgcactccagcctgggcgacagagcgagactctgggtctcaaaaaaaaaagagtgaaactctatctcagaaacaaaaacaaaacaaaacaaaaaacatgggagatctcaccactcctcttctgtggttagaacaaaggaggaacacacgcagaaggagggatagggccttacaactctccctgccagcctggcctcatgcatgttcattaaaccccccagcaactgcagggtgcacattcttttcaaatgaatatggaatattcctcaagatagaccatatgctggcccatcagacaggtcttgataaattcaaagggattgaaataatactggatatgttctcagtgaaatttaagtggaaatcaacaacaaaagatagctagaaaattctcaattatttggaaattaaacagtacacttctaaataaaccctgggtcaaagaaattaaaaagaaaatgagaaaatattttaaactgaattataatgaaaacatagcatgtcagtatttgtgggatatacataaagcagtatctagaaacttacggctttgtagcttaaatgtttatattccataagaagaaacattacacaaaatccctatcaaaacattggcaaaaattaaatccactaacatatgtaaaaggataatatattatggtcaagtggcatttatccctggaatgcaaggctggtttatatttgaaaaaatcagttcatataattcttcatattaacagaatgaaggtgaaaaaccgtatgattatctcagggaccacaggaaaaagcatttgacaagatccaatgtgataaaaaaaaatctcagcaaactaggactagaggggatcttcctcagccagataaaggcatgtatgaaaaaccctcagccagccaggcgcggtggctcatgcctgtaatcccaacactttgggaggccagggcaggtggatcacctgaggtcgggagttcgagaccagcctgactaacacggagaaaccccgtctctactaaaatacagaattagccaggggtggtggcacatgcctgtaatcccagctactcaggaaactgaggcaggagaatcgcttgaacccaggaggtggaggttgcagtgagccgagatcacgccactgcactccagcctgggcaacaagagcaaaactctgtctcaataaaaaaaaaggaaaacccacagccaacattatcactagtggtaacagggaaaatgtcccctttgacccccaccccaagtacagaacatgcaaggacgcctgttctcactgcatgtcttctgtgttgtactgaagctcctagctggtgcagtgaggcaagacaaagaaaggaaatataggtgcactgggaaggaagaagaaacactgcctttattctttaggtgacatgattgtgtgcttttaaaataataaaggaatcaacagaaaagttgcttaacctaatgaatgagtttatcaaagtcacaagatacaaggtcagtatacaaaaatcagttggatttctacatggtagaaacaactgtacatggaaaaatgtttaatagtgtaagatatgtacattggaaactatgaaagagtgtaaaaaataaagaagtgaaataaatggagaagataccaccttgatggatggaagccttaaggtaaagatgctcattctccccacactgacctgtacattccccacaggcctaatcaaaacccccacaggcttctgtgtagaaattgacatgctgatcctgaaatttatatgaaaatgcaaagagtctggaataaccaaaataattttgtaaaagaacaaagaagacttctactacctggttataagacttctctgaagcacagaagtcaaggcagtgtggtggtggcataagtaatgtaaatcatccaggtgtggtggctcaagccagtcatccagcactttgggaggctgaggcaggagaatcgctagagcccaggagttggaaaccagcctgggcagcatagcaagactcatctctacaaaaaatacgaaacaattagctgggtgtctgtagcacatgcctgtagtcccagctgcgcgggaggctgagctgggaagatcactttagcctgggaagtcaggggagctgtgatcacaccactgcactccagcctgggcaacagagcaagaccccatctcaaaaacaaaacaaaacaaaaaacaaatcagatggaacagaatacagtgtccagaaattgatccatgtgtatataatcacctggtactcaacagaaaggccaaggtaatttaagagggaaaggattgtattttcaaaaaatgatgcaagaacatttgaagagtcatgtggagaaaaaactgaacctgattctgtgccataaacaacagtcaacttgaaacagataatagacctaaatgtgaaggctaaaactattaagtttctatgagaaaacacaagagaaaagcttagtgacctagactggtcgcggtggctcacgcctgtaatcccagcactttgggaggccgaggctggtggatcacgaggtcaggagattgagaccatcctggctaacacggtgaaaccttgtctctactaaaaatacaaaaaattagccgggcctggtggcaggtgcctgtagtcccagctactggagaggctgaggcaggagaatggtgtgaactcgggaggtggagcttgcattgagccgagatcatgccactgcactctggcctgggcgacagaatgagactccgtctcaaaaaagaaaaaaagaaaagcttactgacctaagcacagatttcttgggttacataaagcactagccataaaagaggaaaaaatagagtaagttgctgtgagcaggaaacacataaaaaccaaagtgctttttcccattcctttcatcagcaacaatcatcaccacagaagactaaagtgaccacgtcaggggtggttctccccgccaacaaacaagtaatcagttctggagtggacaccagatgggtgccctccaattccattacgacactgtctacgtggggacagagtcagaccccacaggttgagggttgagaccttaagactgccccccacttccaacaccagttgcaagtccaggcctctggaatttctgaccaactagccatatattggagttcccacgttcccctcgggttcaattaatttgctagagcagctcacagaactcagggaaacacgtaagtttaccagtgtattacttttttttttttaagacagggtctcactgtgttgcccaggctggtctccaacttctgggctcaagcgatcctcttgtctcaaccttccaagtagctgggactacagacattccgccaccatgcctagctaacaaagggtattttaagggtgaagagataaataggtggggtgaggtctgaaaggattcccagcacaggagcttctgtccctgtgggtgggttggggaactcattcttgttcaccttcctgtcagcctccacattcagttctctagaaactccccaaaccctgtcctcttgggcattttatggagatgtcattggataggcatgattgaaatgtggacaaccgtgttgaaatgtgattggacaaaaaaggtgtgatctaaacctagcaagacctgaccaggttcttcgggcttctctgtacagcattccttatcccagggtatggtgcaggaccccctctggaataagagtcttatgacccacagtcagattagagtctagctttgggcaggtgaaaggacggcagaaggtcagagagagagattctgtttactgtagtaagggctatgggagttatgagccagggaccctggacaaaaacacacatatatgtcatcacagttggactttatcaaaatgagtaactctgaacgatatcatggagaaaatgaaaaggcaagccacagactgggaggaaatactacaaatgtatatttaataaaggactcatatttaggatatataaagaactcataactcagccagaaaccaaacagcctgcttcattattattattttgagatggagtttcgctcttgttgcgcaggctggagttcaatggtgcgatctcggctcaccacaacctctgccttctgggttcaaacgactctcctgcctcagcctcccaagtagctgggattacaggagcccaccaccatgcctggctaatttttttttttttttaagtagagacggggtttctttgtgttggtcaggctggtctcgaactcctgacctcaggtgatccacccgccttggcctcccaaagtgctaggattacaggcatgagccaccgcgcccggcctcagcctgctttataaatggatggaagatttggacacttaagagaaacacatggccagtaagaatcttttcatgtgttttgtataattagtcattaaagaaatgtgaatcaaagcctcattgcgataccctacacacccacagtgatggctaaaacttgaaagaactgacggtcccaaatggcgagcacatggagcaatgggaatgcgcatgcgctgctgctgggaatgcagtcgcgacagccagtgtgaagatgggttagaccacccagcagccctcctggggaatttttccagaacaaatgaaaacaaattccacaccaagacttgcactcaaacactcatagcagcttcatttgtttgtctgtttttgagacagagtctcactctgttgcccaggcaggaggagtacagtggcccgatcttggctcactgcaacctccgcctcccgggttcaagcaattctcctgcctcagcctcttgagtagctgggattacaggcgcccgccaccgcacccagctaattttttatttttagtagagggggtttcgccgtgttgaccagtctggtctcaaactcctgacctcaagtgatccgtctgccttggccttccaaagtgttgggattacaggtgtgagccacctcgcccggtctgcaccttcatttataatcgtcccaaactggaagcagcctaaatgccagtcagcaggtgtgtggatacgacagtgccagatccgtgtactgagaacactcggcagtgcaaaaggaaggtggcaccagtgcatgacagcacaggccactcagagacagcacgctgagtgagaagccagacacgaggctgcatattgtatagtggcatttatgtgctactctaggaaagaaaagtccagtccatagtgacagatattgagtcggtggctgcctgtggccaactgcaagaggcccatgggagcttgtagggatgctggaaacacaggtctcctgactgcggtggtggagaactggctggatgcatctgtgaaggccctcaactggacacttaaaatgggctcatgcttgtagagtagaaattacagctcagttaatttttcaaaaaagttaattgtaatcttcctggcttctagaattgcagacttttagattaggagtgggtctttgagattgtgttgtcctcacacaacacaatcccagaaaaatagtggcagaaacagaacaccaagccgggttttctcccttgcctctcagtgtccttcttaaaagtcatgctgcaggagatcccgggaaataggcgatgggcatcctcttctccccttctgttctagactcgcctgtgtcccaggggtcttttgctctaaaaggtgtgttatgtcggtcagtcagtgcccacagcacccagggttagcaaggtgatgaatggtagcagtgctaagcatgtggatgagacgttcatcctgagaggcagggctgggctggcccatgcctataaaccaggcctcctgagaatgaaggtgtgtggggtgggctgggagcttgaggagcctgcacctgtagagcagcgaggcccccgagcagccctgctgcacaggccagtcctgtgcttttggtctcatgggtccgtgccctcagctcttgcctggggtggggattgggggacacatgggcagggttcaggccagcaggattccttgctgaggccttctctttgctgtctcctaggactacgcccaagcaaggtttgatgcctatttccaccagaagaggaagcttggggtgtgactgtggggaggactccatccacctcatcactggactgcatggggaggcagcagagcggggtcccctctgtgcttcgactactgctcctgtggcaggaggctttgggtggctcactactgaacacatgtgtatgatactaaagacggtattaaaatggagcgacgtttatttcatctcttgtttacgatttcactaggactcagaaacgagatcgggaagcagaaatatagtgcaatagtgcaacatctctgaatccttttaatctagagaaggcatttcatatttgggggctaaggtttccagtcagatgaggcaaacagcaagagtaagcagtgttacttgcaggtactttggttaatgttgatttaaattttcatgaatgtgctggtgaacactgtgaccaggcttttgtagatggcgatgtgttatagacggtgctcactcccaagggacagcaagtgagcagagatgtactgcaaagtcgccagtcactgctgcaaggtggcctctgcctggggcctccagaagctgctcctttaccctcttggtcccatggctgaagctggagcagcggattgctctggagcagccaaggccgccagcgtgtggagcagagctctcccctcctgctgggcgtgtgtgacactgatgagtttcactgtactgcatgtgacttctcccctgcccttcctcctgatggagtgtgcagacagccatgcgtggccacgggggcagtgtgaggacctccctgtctcccggctcccctcccaggggagccagctgcttgacctagctctttgggcctctcctgccctctgctctgcctggagtgtcggatcctgtgagtaggctgggcctcccctgggcagggttctccaagggcccggtttcccggcccttacctttcctgatgcccctgacatcatcattcttgtgggagacagcagcctgtatgtggtgtggggcgtggatcgagtgtagctgtgaaatccatatatatgaaatgtcctgcgggatacagtcttagctgacttttttttactctgaactcttatttgaattgttttttgtgcatatatttctgctaccacagagattgtactatacaaataaaaaaataaaaaccc

SEQ ID NO: 36565 - DNA, 3843 bp, Homo sapiens
gcgcgggcggctggggaatggctgctgccatggtgccggggcgcagcgagagctgggagcgcggggagcctggccgcccggccctgtacttctgcgggagcattcgcggcggacgcgaggacaggacgctgtacgagcggatcgtgtctcggctgcggcgattcgggacagtgctcaccgagcacgtggcggccgccgagctgggcgcgcgcggtgaggccctggggccgcgggacgcggggacgcgggcgcggacctggctggggtggcagggacccggcctgtccgcccccccgacccccggcagctgcgctcccggcgcccggagcccgccctcctaccccggtgctccatccagcgccccagcccgagaaggaaacgggccggggctcgggctgcgtgggtcccagcaagcctgcgggtgtaaggcagactcagcattatcttgacctttggttccttcttggagaactctgtcttcagctgctttcagagcgtttgtagggtgcaacagaaagaaggtagattgggctgctttgcttgggctcagttcccacctcacccgctggaatcttttccaccacccaacacgaaaggtatcctcctgcctccccaccaactttttttgttttgttttgttttgtttttgaaacggaatctcactctgtcgcccaggctggagtgcagttgcgtgatctcggctcactgcaacctcgacctcccgggttcaagtgattctcttgcctcagcctcccgagtagctgggactacaggcacgcgtcaccacacccggctactttttgtatttttagtagagacggtgtttcaccatattggtcaggctggtttcgaactcctgacctcaggtgatctgcccgcctcggcctcccaaagtgctgggattacagacaggagccaccgcccagggcctgcctcccctttttctgtgaagacatcagcactcttttagacctggctgaccccagttctcactattaccctctctcacatttttgttttgttgatacaagggcctctctgtcgcccaggctggagtgcagtggtgcgatcatagctcactgcagcctcggcttcctaaactcatgatcctccagcctcagcctcctattagcaaggactgcaggggcacgacaccatgcctggctcaaaatttttctgtagagattgggagtctcactatgttgcccagtctggtcccgacctcctagcctcaagtgatcctcccgcctcaggcctcccgaagtgctgggactatagatgtgagcccccatgctggcctcatattctctttcaggccattattgtgttctgctcctggctgctgggtttttctttctctttctatttatttagttatttatttggaaacagtcttgttctattacccatgctggagtgcagtggcaaaatctcagctcactgctaacctctgcctcccgggcttgagcaatcctcccacctcagcctcccaagtagctgggactacaggtgtgtgccgccatacctggttaagttttgtattttttatagggacgggattttgccatgttggccaggctggtcttgaactcctgagcccaagtgatctgcctgcctcagcctcccaaagtgttgggattacagacatgagccgctgagtctggctggatttctctaaagcatatttgatgtgctggtctggaatcttgcagatccttccagtttgaaaattgtatcttgaatgcttgtgcttctgctcagaaaaccttaagtggtttccacttatcctacccaagagcagacccacaatttgtgggacctcatgcaattctgggagacctctttaaaaagacaaaaatcacaatacaaagttgctgatggtttggaaagggcctgtgcaagtggaggaccctgaagcttacagctcattagttcatggtatatccagactgcctggtggctctccaggtctttagtgtcatctgagggagcctgttaaaaatgcaggttctgatcatctgggataaagccttcgaatatgtacttttttttttcccccaagacagagtcttgctctgtcgcccagggtggagtgcagtggagtgatctccgctcattgcaacctcctcctcccaggttcaagcaattttcctgcctcagcctcccgagtagctgggattacaggcgcctgctaccacgcctggctaattttttaatttttagtggagatggggttccaccatgttggccagactggtctcaaactcctgacctcgtgatcctaccgccttggcctcccaaagtgctgggattacaggcgtgagccaccgcgcctggcccgaatctgtactttttcttgttttttttaagatggagttttgctctgttgcccaggctggagtgcagtggtgcgatctcagctcactgcaacttccgcctcctgggttcaagtgattctcctgcttcagcctcccaagttgctgggattacaggtgtgcaccaccacacccagctaatttttgtatttttagtaaagatggggtttcaccatgttggccaggctggttttgaactcctgacctcaagtgatccacccgccccagcctcccaaagtgctgggattacaggcatgagccaccgcgcctggccctggaatctgtacttctaacaagctccccagtggtcctaccctgatgcggtgggctgagcctcactgtcctggaagataacatttaatcaagctaagacccgagatccctaccttctgggcctaggatgcctctcctacttttggctaagtgcccatgcacctttccctaatcaatgtcatccacagttagtgctgctgatgttcctcattcggccctaatcacatgtcccaccttgcatagggttgaatttttctttttgtggctattccatttcctcgctgctttgatgagattgtcatgtttggtcaggtcatctggcacaaggctcccaccctccctgagcagggtgggtatggacatacaagggcataggagttactgggagccagcatgaggcatgtccttgaccagctttccctcaacacaggggaagaggctgctgggggtgacaggctcatccatgagcaggacctggagtggctgcagcaggcggacggtgagtggcgctccctccttccagcacctaactcctctggagtgctgggttcccctggacatcccagcctccacacctagaagggactcccagagttccctcctcaccacagccacaccgtcgtcttccttatgaacctcaagtgcccccaatgctgaggcttcctctcatctttcctcccagtggtcgtggcagaagtgacacagccatccttgggtgtaggctatgagctgggccgggccgtggcctttaacaagcggatcctgtgcctgttccgcccgcagtctggccgcggtgagcaccccaagcctccctcctggctttctatggacccagccctcagctccttccctggtgggctctgagcaccgcgcctctcccaaggggtaagggagctgtgagggtgtggatgggaggcagcttcacctttccctgccctttccagtgctttcggccatgatccggggagcagcagatggctctcggttccaggtgtgggactatgaggagggagaggtggaggccctgctggatcgatacttcgaggctgatcctccagggcaggtggctgcctcccctgacccaaccacttgacttaatctcactttcttaaattcttctattctcagacactgctctagtaccattccttcctcttagccccaggagcaaattaaaaggtacagttaaaatcct

SEQ ID NO: 36566 - DNA, 12221 bp, Homo sapiens
cgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtaggtggaagccttccaaagagcggcggttgtctgggagccgtctcagttggccgcgacccgggcgcatgcgcggggcgggcggtgcgccttgggtagcttgtcctctccgaccccgggcgctgagggcctctgtacggcgccgcgtagggtctcggccgcagaacgtggccgagaggcccgggcgagacttcgggaccgtgtcctgagcgctctccatgcgcccggcgcgaggtgagcgctaaatagtggttgttgaaaaatattgaaagccacccaagtgctcagcagtaaggatattgagctttttaaagtgattgatttagtccaaaaattgtacgtcgcacgcccactgtgcacgacccagtgttttagggccttgggaaacagcagtgaacaagatagcaagattcttggagtggacttttgttggggtggggaggggaagtacagataaagataaacgagttacataattgtcatagaaaaaggcaaatgctacgaagaagaaagcagggacggggcatgggggtggggtgcggtgttagccgagaagggcactgggccaacccgattgagatttgagctaagccaggaagggggcaagggtgtgagtccggtggctgcctggaggaagatctttcccagcatggggaaaagctagagccgaggcccagcggtgggagcgagactggcgcgtgagaaagagctaggctaggcctgtgtggtggcggggattgagcggagggagaatggcaggacatgaagtcagaggtgtagagggagcagtcctgcaggtgaggcagagccttgcaggctgctctaaggactttggccttactctggataaaacgggaaccatagcaagattttgagcagaggaatgatgtagcttgagtagatgttaatagactcactggccgccgtagggatggagaagcgggggagtagggagaatcagatttattactaataggtcagattaggagcatccctgcgcagccactaaaaaaggctgactctaggccgggcgcggtggctcatgcctgtaatcccagcactttgagggggccgaggtcggcggatcacttgacgccaggagttcgagaccagcctgggccaacatggcgaaaccccatttgtactaaaaatacaaaagttagctgggcgtgatgacgtacgcctgtaatcccagctactcaggagactgaggagcgagaattgcttcgacccaaagcactccagcctgggcgacagagtgagactccatctcaaaacaaacaacaagactgactttaaagatgacgatgacagtaacttcgtgagcccacatctgtggagagcctggtgaatatatttaataccagtctgtacaaaataatttcccaggtatcctctcctttaatgtcagaacagcctgcagagggcagtgctgtcatttgtaagtctttttttttttttttaattgcaaaaaatacgtgacataaaatttatcgtaagtagcattgagtacattcacaacgctgtgcagccatcaccactgtccatctcgtgaatgttgtgtaagtcttcgttttactggcatctaagccctgggtctaatttcactcccctattttaggcagccagctccatcaaggcagtaacactaaaaaacatttatgtgccaagcaatgaaagaaacagatgaggtttcttgttctccctgcccttctagttaggggagactctagtgactgggaaagaagcatcaggtaactatttccgctgtcctgaaaccaaggattcttttgaatatataggcctataccactatcacttttctctcatttgaatacctactttgtgtcatagtattacagtattttttgtttgtttgttttggagacagggtcatgctctgtcacccaggctggagtgcagtggtacaatcacagtgcactgtatccttaacctcccagactcaagctatcctcccacctcagcccctggagtagctgggactacaggcacacactaccatgcctggttaatttaagtttttttgtttttttttttagtgacagggtctcactatgtttcccaggctggtctcaaactcctggcctcccaaactgttgagattacaggcatgagcaccacgccaggccccaaagtattaatgtttgttgaatggattggtagatgtagctccttgaccctgacttcttttctccagaggtcatcatctgggagtggttggaactgggtctaacccagagtggttttgaaatgctggtccatagctctgtgaccttggataagtccctttccttgattgggcctcagtttcctgttccctgtagtgggggatccatatattaaacaaatagacagtgttaagagattgcataacatgggggcttaacttagagaagggtgtcagagaagaccttcatgaagaggtggtatttaaactgaaagttgaaggatgaataggacctatccagagggagagcaaggttggcatggagccaaggaaaggaactgtctacagagagatgagcatgttctacgttcttgaaagttcagaccttttagaagctgcattgagtgccccttccaggaatccctcttctcaacccctgtgctgtttaagctcagttgttcacagatagtcttgcacagacctggcttttggactgagagcaggcagacacaggatgggaggagacggcagaacgaccatccctcattcttctctttgtgttctgtgttgactgagagtaaacaagaagaggaccttcaaatcttagattttactcctttatgtcttttctttttctttggataaagaggcatcgtaactggtcttgagtgggctcagagtggttggaatctctgggcacccttgggcagatgttacctacgtttactaaacctctgtgtcatcttctcgaaaatgggaataataatacctcttacctcaggagcattttgaagacaagctaaggcatgtgaaatgtttagcaaagagctgggtgctcataaggaaaattgttagccaaaattatgttgttatgttttaagtaagagtacagtgatttgacatttatagaatatagaaacttattttgtattcgtatgggtaaccttagtttgatcagaattagatgagttactgtgctcagaagtcttaaaaaccaaacaggaggccaggcacagtggctcacacctgtaataccggcactctgggaggccgaggcaggcgtatcacgaggtcaggagttcgagaccagcctgaccaatatggtgaaaccctgtctctactaaaaatacaaaaaaggtagccgggcgtggtagcacattcctataatcccagctactcgggaggctgaggcaggagaattgcttgaatccgcgaggcagaggttgcagtgagccaagattgtgccactgcactccagcctgggcgacagagcaagactccttctccaaaaaaaaaataataataacaggaaggccgggcctggtggctcacacttgtaatcccagcactttgggaggctgagttgggcaaattgcttgagcccaggagtttgaaaccagcctgggcaacatggtgaaaccctgtctctacaaaaaatacaaaaatctgctggatgtggtggcacgtgcctatactcccagctactcaggagtctgaggcaggaggatcacctgagcctcgagagccagaggtggaggctgcagtgaactctgattgtaccactgcacttcagcctaggtgacagggtgagaccctgccttaaaacaaacaaacaaaaaaaacccaaataggccaaattctcatcaaaactctgaaaaatagcatgtgcattggtcatttctagccctcttgacttactgtaggtgtgatcagcactggaaaagatgcctgcccctgctgccacatatgaaagagtagtttacaaaaacccttccgagtaccactacatgaaagtctgcctgtaagtttagtttcctaagttctattttagattacttttctaacatgaatctgaatagaatgaaatttaatatgacttttttttttttcactttttttagagaatttcaagattgtggagttggactgaatgctgcacagttcaaacagctgcttatttcggctgtgaaggacctgtttggggaggtatggaatcacttggtagattgaacattccaaagatctttgtaagaaatacagaaagaggccgggcgcggtagctcacgcctgtaatcccagcactttggaggccgaggtgggcagatcatgaggtcaagagatcgagaccatcctggccaacatggtgaaaccccatctgtactaaaactgcaaagataagctgggtgtggtggcaggcacctgtaatcccagctactcgggaggctgaggcaggataattgcttgaacccgggaggcagaggttgcagtgagccgagataacgccactgcactccagcctggcaacagagcgagactctgtcacaaaaaaaaaaatcgagaaagaatgcttttcaaacatcaaaaaaaaaaaaaaaataaattatacaactctgtatttttaaatttttattcatttattgtaataaacacatttgtattcctttttttcctccttcatcctctctaccctcctacccttcccagcctctgataatcaccaatctactttctatcctcatgaaatctactttttgttgttgttgttgttgttgttgttgtttttctttgagatggagtcttgctttgttgcccaggctggagtgcaatggcacattcttggctcactgcagcctctgcctcccagattcaagggatcttcctgccttagcccccctggtagctgagattacaggcacacgctaccatgcccaactaatttttgtatttttactagagacagggtttcgtcatgttggccaggctggtcttgaactcctgacctcaggtgatccacgcgccttgggctcccaaagtgctggattacaggcacgagccactgtgcctggcaagatctgcttttttagctctcacatatgagtgagaacatgcaacagttgtctttctgtgcctggctggcttcacttaacaaaatggcctccagttctattcatgatgctgcaaatgacagaatttcattcttttttatggctgaataatattccattgtaatatataccacttttttttttttatccattgatgggcacttaagttctacattttgcctattgggaatacaataaatatgagagtgcatatgtccttttttttttttttccccaccttggcttcccaaagtgctgggatgacagcatgagccactatgcccagctgcacatgtctttttgaattgatttcctttctcttggatttatgctcagtagtagacttgctggattaaatggtattctatttttagtttagtttcttttgttttttgtttttgagatgaagtcttgccgtgatgcccagggtggagtgcagtggcatggtcatggctcactacagcctcaacctcccaagctcaagtgattctcccacctcagtatcccgagtagctgggaccacaggcgtgtgccaccacgccaatttttttacttgtagaggcaaggtctcactatgttgcccaggctcctggactcaagcaatcctcctgccttggcctcccaaagcactgggattacagacatgagccactgcacctgacctatttttagttttttgggaaacctccatactgctctccacagtggttgtacatttacattcctcccagtagtgtgtgagggttcccctagagattattttattttatttttatttatttattttttgagacagagtctcgctctgtcacccaggctggagtgcagtggcacaacctccgcacccccccccgcccctcccggattcaagtgattctcctgcctcagcctcccgagtagctgagactacaggtacctgccaccacgcccagctaatttttgtattcccctagagattattttaaaactgtgtttgaaattgcagaagtaaactttcagaagtgatgaattttgttgggtttattctaatatgccttctgtttgacaaggaacacgttagacaaatgattgttgtagcacagtgctactcaaagtgtggcctagactggcacctgcaaactcttttcccatcttgaagagataaggaatttgcagcagaaccacttttaatgagaaagtctccttatgggccaggcgcagtggctcactcctataatcccagctcttcgggaggctgagatgagcagatcacttacagtcaggagtttgagactagcctggccaacgtggtgaaacgctttctctactgaaaatacaaaaattagctgggcatggtggcgcacgcttgtagtcccagctacttggaagactgaggcaggagaattgcttgaacctgggaggcagaggttgcagtgagcagagatcacgccactgcattccagcctgggcaacagagcaagactctgtctcaaaaaaaaaaaaaaaaaaaagggctgggcacggtagctcacgcctgtaatcctagcactttgggaggccaaggcaggcagatcccaaggtcagccgatcaagaccatcctggctaacacggtgaaaccctgtctctactaaaaacacaaaaagccgggcgcagcggcgggcacctgtagtcccagctactcgggaggctgaggcaggagaatggcatgaacccgggaggtggagcttgcagtgagccgagatcacgccactgcactccagcctgggcgacagagcgagactcggtctcaaaaaaaaggctcctcatgaaaaaaagatgaactgaactaaacatggtgattaatgatactattggtttatattctgattcaactcattattttgtcatagaccagcattttaagcaactttgagaacagaagtagagaagtagagtttcagaagttgaaagaagacaggatgctcaggaaattattttgtgattcatatagtctgtcaaatcaaaatatgctaagtacctcatcaaaatttaaaacttttactctgcaaaagactcttaagaggatgaaagggccaggtgcagtggctcacagctgtaatcccaccacttttgagaggccaagcgggtggatcacttgagcccaggagttccaggccagcctgggtatctggtgaaaccccatctctacaaaacaatttgaaaaattgagctgggtgtggtggtgtgcactgatagtcccaactagtcaggaggctgaggtgggaggattgcttgagcccaagagctcaaggttgcaatgagtggtgatcacacctccatggctgggggtaggggtgggaaaggatgaaaagatgaattacacactgggggaaaatatttgtaaaccacgtatccaacaaaggactatagtgtctagaatatataaatgacatttggcctggtgcagtggctcatgcccgtaatcccaacactttgggaagccagggcaggaagattgcttgaggccaggagtttgaggctggctgtggtaaactatgattgcactactgcactgcagcctggtcaacagaacaagaccatgtctcaaaaataataacacatggggcgtggtggctcatgcctgtaatcccagcactttgggaggccgaggtgggttgattgcctgaggtcaggagtttgagaccatcctggccaacatggcaaaaccctgtctctgctaaagctataaaaactagccgggcgtggtggcacatgcctgtaaccccagctactcgggaggttaaggcaggagaaccacttgaacctgggaggcggaggttgcagtgagctgagatcacaccactgcactccagccagggtgacagagagagactctgtctcaaaaaaataatagtaataataataaaaaagaagtatcagaactcaaccaaacaattcaattagaaaatgggcaaaaacattaacagacattttgctaaagagaatgtgtggttggcaaagaagcacatggaaagatgtttaacattagccattagggaaatgcacattaatgacacaatgagataccactgtgtacctagcagaatgactgaaataaaaaatgacaacactaagtgctagcaagaatgcaaagaaactagatcactcatacactacagtgagtatgtaaaatggtgcagccactctggaacatagtttggcagtatttttttttttttttttttttttttgttgagatggagtctcgttctgtcaccgggctggagtgcagtggcacaatcttggctcactgcaacctccgcctcccaggttcaggcgattctcctgtctcagcctcccaagtagctaggactacaggcacacaccaccacacccagctaatttttttgtatttttagtggagacggggtttcaccatgttgaccaggatggtctcaatctcttgaccttgtgatccgcctgccttggcctcccaaagtgctgggattacaggtgtgagccaccatgcctggccagcagtatctttaacaaactaaacgtgcatctgccatagaacccagcattagcactcctgggcatctgttccagaggactgaaaacttaagttcacacaaaagcctgtacatgaatattcatagcagctttatttttaataacaatgaaactgaaaacaccccatatatccttcaatgggtgaataaactgtggtacattcctactatggaatatactcgacagtgaaaaggaatgacctatttagacacaatatgaatgaatctccagagaattatgctgagcgaaaaaaagccaatcccaaaacatgacatactgggtgtttccatttatagaagactcttgaaatactatatataatctggagaaaggttagtggttgctggggtgaggagtaggggaggaggggtgggtgtggctgtaaagggtagaataagggagtcttatgatggtacagttctttatcattgattgtggtggtagttatatgaagctacctatgtgggaaaattacatagagccacacacaggtataaataggagtagacatacaattggtaaaatctgaataacctctggtttgtaccaataccagttttgtagttttgctactgtactgtagttacgcaagacattgacattgtgggaggctggatgaagagtgcatgaacctccctgtacatttcttttttatttatttatttatttttgaaacagagtttcgctcttcttgcccaggctggagtgcaatggcacgatcttggctcaccgcaccctccgcctcccaggttcaagcgattctcctgcctcagcctcgcaagtagctgggattacaggcatgtgccaccacacccggctaattttgtatttttagtaaaaatggggtttctccgtgttgatcaggctggtctcaaactcccaacctcaggtgatccgccctccttggcctcccaaagtgccgggattacaggcgtgagccactgtgcccggccaatccctgtacatttctttgtgatctcttgtgagtctataatttttttaaatacaaaattttaaaaaaaaatatccctgtgtgtacctgtgtgtcaggtagaaaacctcgttcctggggtttatatagctgcaaacaaacagacatggcctctgccacatggactaatgtcttggttcttgtagtaggaaaacatgttggacaattagtgacaagaataaagggaattatgaaagagaaagtatggtgtcctgtacaagaaagaacatagcaagctgactttgtctcatcttgaagatcagtcaaggaacaatttaaatgaaggctcaaaggatgagagacatcagccatatgaagaggtgtaggcagaacattctaggcagggggagctgtaagtaggcaactaaagtgccagcaccattaaataaaatactgcttatgtggaggagaaaagctcaaaactcatttgttgtcaaaagttgacaagcattcaagaataatggtgagaatagcctgctaatagcattattccatatgcaggttgatgccgccttacctttggacatcctaacctatgaagagaagaccttgtcagccatcttgagaatatgtagcaggtatgacagagagtgggaaatttctagtataacagggcagagagaccgatggagcaaaaatgctctcttctgagaatgagaataaattttttgttgtgaactctgagcagcttttgggaatttaaactgggatgaatatgaacattcatccaccagaaacttgtactctagagagggcaaaacttacgatttggttacagctgtagttttcccattgatggttatagttgcaaagtcagaagtgaatattttagaaaccttagttgaagttcattttgttctctgtctatgacacactatgtattttcttgatctttctgcagtggtcttgtcaaattgtggagctctttgaccctgttaggatcctataaaggcaaaaaatgtgctttccgggtgattcaggtaaagactattccctcacatattccaaacaagactgagtgatgggtcaactgcttcttaatatacacaactcatttttgtgcttgcataaatgtaatatggttaaaatgatctaagtaggggaaaataaaggacttgattgtttccaaaaatgtgagacagagcacttagattttaaaatctatgggagatgttttgggataaaacttgcaaccctgtggttaaggcttactttttttatttaacacttaatgccttgtgtgttatatattggtacgctctttttgagatgtgaccacttgttatcgaaggcttcctctcaggatgctctgtaaaatgctcctgcatcagctttgtttatcctgtaaaactgggcatgtttccccattgccctgtgcttcagtgtggtttctcccaatgccttaacctttttctttctcttctaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctacc

SEQ ID NO: 36567 - DNA, 6968 bp, Homo sapiens
gactgacgtcccgccctctggctgtttcctggccgaggtgggtcggtagtagcgatggcgggtctgactgacttgcagcggctacaggcccgagtggaagagctggagcgctgggtgtacgggccgggcggggcgcgcggctcacggaaggtgagtagtctggtccggtagtccctttctggagcagagcaagagcggtccactgtcctggccctcgggatgcaaccgctccagtcctgttctccgcagcccggcctttgaaataacaaaggtccgggacctcccagagctgattggaccatcggggtccactgtcatagggggctctgcgggtggttaagccagcctgagagtgggctccgtacctactgtagctgagactccgcccttgccctcgcgagctatagttggggagacctgacacgagaagctgactaatgagagtttcaataagagctgaagtccacgataggaaggcccgtcatagagccctgcataattaattgctaaatgaattgtgcaggaagaggtccatgggacccctggggaggcagagcagaggtggataaggaaaacgccaaagggtgagaagtgaggtctgaaaggaccaggattaggaagggaagagactgggtactgggtattcagatgtggactagcactgctttataccagtgacagaattttgacaactacgaagctcaggtgccctctcctcccctttctactatgggaagatcttttattgaagaacttctgatggcgtgtcaggcatgtcctggagctaagtgcgtccaaggtaatgatgtctgtttgtacactaaatgaggaattagttgtcactagcagactgtgctcccatttcagaactaacttctcaaacattctcttcctttgggatctatgacgctgaccctcctggttttccttctacctcttacggctgcttctcagtgttatttgcctcccccctggcattcctcatcctctaccctaaaaactgggtgagtgcagtcacttccttagtctcctcctctatttgaccctttaatattgggattctttacattctacccctaaactttaggtaggctcactcgcttccatggtgtcaattactatttacatgtcaatatgtctcaaatgtatatctctggtccagatttctgttctgagaaccagacttttatgtctagttgtctactggacttttccacttggatatccaatagtcatttcaaactcaatctgtatgcccttaactgtactctttctctcccctaacctgattctcttctgtattccctaattcagtgattgcaccatcattgggatcccagttgtttggactcttccatctcccacaccaaatttgatgtggaggggatagggctagaggtaggccagccaatctagaggtcatgaaggcttgaatgaggatgcttgtgtttctcatgcccaaacccaggacttaggaaccagaaaatatattgtgtatactctatattccatagactctaaaatagttcgttatcttccccatcagacttgaaactccccaaggagtacatgattctctctctccactttaaggattcctggaaggtggggctgcatctcctttaatattagagaagggaggccaacctagattactgggattcaggtttgagagtctgggagaatgagggttctttaacttttccaagccttgagccaggtagtatatcttggaattaaccaccacttcccttacaggtggctgacggcctggtcaaggtgcaggtggctttggggaacatttccagcaagagggagagggtgaagattctctacaaaaagagtaagtgcttccatgatgtgcctgcctgcccgacatcccacccctcagcttcctggtacctggccctagcccttcagttcattaggtcactggaatagccctttggggatagaaagattatgaggacatttacctacacccaattcaattggtaaattgtggtgtgcttttctaccttgtggctaaacctcaagcccatgacagtgtcctaagttatgaaataagagctctacctgaaagcttctcttggtgaaggagggtaaaaagggtatgggatttcccaggcaaggttaaggggcaggaaacaaattagacactgagatcctggttatgtcagaactagtaacctgcttagtaactagaaattagacaaagctctggcttgtctcggtgacatctaggagaaaagaggccttctacccttggtgaggataggtcagtgagaatgctaagggcccagagtggtggtggcaattgtgttttcagctctgaagcttgatgtcagaagagacttcaagagaagagagtggagagatagggaagtggggatagggagcctggtggagccctgctcatgtggcactgttgggtatcagctcctcattgaaggctctcctcaaggctgaccacttgtcaaacatccttcataaggcagagctctactgcccaaccctattccattttccatcttgctacttttctagttgaagatctgatcaagtacctggatcctgagtacatcgaccgcattgccatacctgatgcctctaagctgcaattcatcctagcaggtaatgctggactacatgtgtacatgcatctgaggatgtgggtcgtcggggaggttaagcacagagatggcctctccatccagtcttctggtggatacaagccctggatgctgctctctggaattgtggcctggttctgggttgaggatcctatggatcctctagtagacattgagtacagtatacctctgcaccagctgcaggccatggtgccagccacagtgggagctagtccagtgttctatcaatagtttgcctcttggattttccttcagaaccttcctcacttctgctcactagacagaggagcttctaggaaagggtaggggcagagagcattgccattaaagaacagagagagtattggcatgagtttcaacatctttctttcatgtgagaaagctctgcagtgtcagagttctaggcaggaactattgccttggcaatgtctgctaatcagtcagccattctataagctagggttttttgagcttcgttattcatccaaaagatgtataatgatcatctactctgatccaggttctttcctaagtgaggaagcatacagtggtgaaccagaaagtccctgccctcatgggcacagccagagctaggggagacagggtccctgcttcagggacctgagcttataacccagatgggagatcagtctcccaggagactgatcagtgcaatgcagcactgaggactgggtaaggatgggccactcctgctaaaagggctgtcagagttcccaaagggctcttggtcaattgccatcgctcaagcaccaagtttagatattctcctgcactgactcttgagtccagcctctccatccctccctgtggcactgcctcaggaattgtgcatccacttgcatatgaatggttgcacagtctcctaaatcatactcttgaccctaatctttcccttcctgcatgtggttcagtctcaccctcacaaaaacatgttcccaacatgtcactttgcctactttggaacctcagtgtatcctgccttgctaggataaagtcctaattccatagtctgccattcaaagcctttcagtcggccgggtctaccctcccatccaactctgtttcctgtgctctccctactccagttcagctaattgaattctttctcctctactaattgacaggcattcctgcctctaagcatttgcacgtaacagtcctctctcttgaatacccttcccactctatggatttcagtgcattgaaatcccgtgtgcatacagggcctagcccagatcctgctctcctcactggactcttccattactgtcccagctctcctccagcatataattgtctatgcctctgagagccactgagcagaacctgcctggcgtagtctgccacatatctcttttagaccttcctggggacccttgggtgtggggatccaagtctgaagtattttgtattttgtggcctaggaggtgctccctgagtttgttgataggaggctagaagaagaggtcttgaagttaaaccttggagaaaggtgggatttggagaaattgagaggctcattaggctcagatgggtcagacctgaggcatccaggagagttgggggcaggatggaaatgtgcacctagagaagggggcagtggacagagtcactgtccaaagctctaggacctagccatctcccttgccaggtcctcaggcccttacatgggctgattagcaatgcccaggtttgcttcactgcaactatcttgtccatttttgctttagaggagcagtttatcctttcccaggttgcactcctggagcaggtgaatgccttggtgcccatgctggacagtgctcacatcaaaggtatctctctggggttatagcttcactactctggttggggaggtaggtggatggatgggcaagactttcctgtgtttcaggttgtgtggattcgggttgggtctgttccttatcttttttttttttttttggacagagtcgtactctgtcacccaggctggagtgcagtggcatgatcttgactcactgcaaccgctgcctcctggttcaaacaaacttcccaccttgcctcccaagtagctaggattacaggtgtgtgccaccacacctggctatttttagtagagacggggtttcaccatgttgtccaggctggtctcaaactcctggccccatgtgatccacctgcctcggcctctcagagtgctgggattacaggcgtgagctactgtgcctggcctgttccttatctttatcctcaccctgaggtacttgccacatccaccaattaaaattaccaggatagagagcccagttttaggacctcaggcaatttgggcctgagaacactagcctaagctctagcagtccccagctctggggattccttctgccttctacctacccccaagcatctcttcttcaaggtgctgcagaacccagattttactatcagagtctctgccaggtccatgaatgtatgtgaattctttctgctgcactgctgagagcagtccctgggcctggactttgacaagcagatagtggctttaattgaatccagatatccatcttgtctgtctgtggaggtatttttcccagctccccctccctacccctgatcagctgcccgctgagtatctgacagccttaagctttgagcccagcatggtggccaagccttggcgtgttggattccagcttagggacctggcatccatcttcagactccctgttccctaagccaggcagacctgcccccgctgggctgagagcaaagggacaggtcctataatagccaaagctctctttacctggtcctgcttatagcactggggtgggggtagggagcaacactgggaaccccaaggttttgtcttctcctcgggacatgtatcttcccctcccctatgggtcctggagtaagactggagtgggcagggagccccactgccacctccagctgcagcagtcgatgaagtctggcgtttgtttagcttctccactcaatactctaatcctgccaaagacctaatagactattgagcagtcccgggggagggcacaagcatcatccagcagtgtgtgttgtgttttacagccgttcctgagcatgctgcccgcctgcagcgcttggcccagatccacattcagcagcaggtatgggaggggagatgactagaagcgaagatggaggtggcgcagcacctcatcccaactcatgccacctggggaagcagcttcaggcctttctgttgtaacctcagcagaaactttggggtttatcctttatcttgcatatgccccagggaggtaaagggacttgcctaggttcatgtacaaactttctgcttccagagcaggactttattgggacaccataaggttgaggctgggaggtacccaagaattcctggggatggtatgtcattgactgtgggtagaggggctcttttttcactattcccaggccctagtgtaaagttcaaagagagttcagaaataaggacagaagaagagacatacactagggggaatgtttacttaatgtatggccactcccttttccatccgtctttggactgctgttagggcacccatcctggagcctgaaagtgctcccatagccatttgctcctttggctttggggttaagcgtcatcttttttaggctccatggggagtgggagtccgtgatgaggcaggaagtttagtggaagatgtgggctttgcccagttcctttctgtgctacactttggccctacaggaccagtgtgtggaaatcactgaggagtccaaggctctcctggaggaatacaacaagactgtatcctttctgctcaactaggaccctaatgggtgctgtccctaagccctgtccttttgttccacctctagctctctctcatcctatcctacccacctatgtttgcctgttccccactttccatgaacttcctcactcagattcctattctcaccttgacctacaaccagacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatga

SEQ ID NO: 36568 - DNA, 4098 bp, Homo sapiens
tgcaacgccggggccagagtcttaaaaccgagggcccgcaggggtccccgcggccgccgcgatgcagaaatacgagaaactggaaaagattggggaaggtaatggaatctcgagatgttcctgcaagagctcctctgcagatccttcggcattccttgaagccctggctcccttaccgtcagcaatgcctacaggctccgatctcagcagcggctgcagccctggccccctagctcagcactccgtgcagacaccagtcttccccgtgttagcatttcccgcagggctctcactccaaccttagcgttcccagtagacccgacctcccaaccgcgacacttcctgaaatttctcaccccagcctcagcagcacttggacaacctcaccccgacccccagcctcgtttcttgctgcagacctccaacctcaatatttctgcagcccctcagtcctctcccagacccctcctcactatttccagacccttccggagcaccgccttcattttagacatccttgccctggcaaccgcactcgcccctcctgccgagcccctggagcctcggtgggcaccttctcctccctccccacctgccacatcctcactcacaaagctcaccaacctaccttcaccctgaatcccttcccttgcatactgagacgctgccttcacctctctcaggaggcatttcctggcttagggaagagtgccgcatcctcaccctgacccctgacctccttcccctaggcacctacggaactgtgttcaaggccaaaaaccgggagactcatgagatcgtggctctgaaacgggtgaggctggatgacgatgatgaggtaggactggggagtgggatacggcctggggaggggtttgagggcctgggctgggtgggatctgactgctgcccaccggccccctcacatatgcagggtgtgccgagttccgccctccgggagatctgcctactcaaggagctgaagcacaagaacatcgtcaggtgtgcgggaggcgggtgctccttgccggtgtggccgcttgggggaggcgggggctgacactggacgtctgtcaggcggacctgcctggctgagcccttcttttgccctaggcttcatgacgtcctgcacagcgacaagaagctgactttggtttttgaattctgtgaccaggtgaaaggcggggtttggaggacagtagccttgggaaggtataggggcccagattgaggttaaactctgtcccattcccccactcatatcccttttcaggacctgaagaagtattttgacagttgcaatggtgacctcgatcctgagattgtaaaggtgaggagagtggtgttgggggacccctcaggctggggtcggagtctgcattcggtgtaagcaccccttgggctctaagtttgggccctgaacagggacactctagggtgttagagaatgagaaaaccctgtttctgtcctccaggggtctccagtcttagtgagcattttcacgtggtcatctttgacccgcacagtgtcattctgatgtcagtgatattatttacactcgagagatgagaaaatgaggttcaaggagatacactcattcattcaacacatacttactgaatgcttcactgtgtgccaggtgcttttctaggcccaagaccaaatgccttggtccaggttccaggggagccagtcctgaatgatactacagcacgatatttatgttgatgttcacggcgtgcatactcagatgcggccaggaagggaagatcagcatgggctgggatctaggccggatctaggatccacctgccaaggcccattaggctgtatggtccaggaaggtggggaccagagccagcttctttactttggtccctctaatgcctagcacagtataaagcaggtcctggatggcgaatgaatggtgtcactctgaaccaggtgctgaaaggtgggtggggtggagcgaagcacagggtgaggagaggagccgacccgttgctgggcacagttgcatgttcagggcgtctgactcccttctccctctctcctcccagtcattcctcttccagctactaaaagggctgggattctgtcatagccgcaatgtgctacacagggacctgaagccccagaacctgctaataaacagggtacttcttgggaagaaggtggggaatggagaggctggggccagggcacggggagcacagagggaagaggactgggaggatggagttggtgctgtcccaaggctttttaaaggcccttctccatgtccccttcccattcccttcagaatggggagctgaaattggctgattttggcctggctcgagcctttgggattcccgtccgctgttactcagctgaggtgagctagaagatgggatatgggattgggggagggagtccctcagctccaaccccaggacccaaaacattattttcctctcctctctgagcctcctcctcaaacctcctccccagtcctctaagtgggaggtccctttcggggggggtctcctccaggtggtcacactgtggtaccgcccaccggatgtcctctttggggccaagctgtactccacgtccatcgacatgtggtcagccggctgcatctttgcaggtgatgtgctggggtgttgcagaggcaccttctttcccatttgagttgacaaatagggtctggagggtcccctctgggggaagggagggaggccctgggactggagctggaaggtcagggggtacctcagagtgaggggtccttcacatgtcacatcttagccccctgtctatcccccagagctggccaatgctgggcggcctctttttcccggcaatgatgtcgatgaccagttgaagaggatcttccgatatccttgctttcctctgccttgagccctctgggaggggagagtccatggagttttgagcacaatgggtgagggcagtgatggtgtggggtagggtgatggggtctgtagggcttctcctgagggcaaggggagagagcaggggtgctggacaccctgattgtcacagtgcaaatgcacactggagaaggtgtggcttggagacaggcagcgtgccctgaggggtgaagccgagagggtgtccctccaggtgagagatggatgccaggatgaaggagccaaagagaacaggacacattttgtgggagcagggcaaggactgtttcattaggactaggacagcagcatgtgggttaggtgattgtcatgggaaacgtggctggatatgcgagtgacctgcctggggctgcttctgtcaagctcaagccggagggtaaagggagggtgagaagtgggcggtgggtatgaggaatccctccccaggaggggaagaggccctcaccctgcccctgaagatgcagctgtggccctttcccaagtgatccttgactccgtggacacactgctggggacgcccaccgaggagcagtggccctctatgaccaagctgccagactataaggtgtgatggggaatgtgggggtcatggttcatcagggtcactcgtttcacattcctagcgcctccatccccctccccctacctctagtctgaccctccctgcctctccacagccctatccgatgtacccggccacaacatccctggtgaacgtcgtgcccaaactcaatgccacagggagggatctgctgcaggtaggtgaccaggggtagagggtgggtcaggacacttgcccagtgggactacaggaaggcagggctctgggcagtgacctgtcctgaacctgccacctcctttcccccatctccagaaccttctgaagtgtaaccctgtccagcgtatctcagcagaagaggccctgcagcacccctacttctccgacttctgtccgccctaggccccgggacccccggcctccaggctggggcctggcctatttaagccccctcttgagaggggtgagacagtgggggtgcctggtgcgctgtgctccagcagtgctgggcccagccggggtggggtgcctgagcccgaatttctcactccctttgtggactttatttaatttcataaattggctcctttcccacagtc

SEQ ID NO: 36569 - DNA, 91904 bp, Homo sapiens
cgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcgccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggtaaggaagccataaggaagccacccaccggcgggtggagcctggagctcggtcgtgggcgtgatgtcccgctccacctgtggggccttagcatcctccctcccctcgctgacctttgacctccacgccgggacccagagttggggtggactagccagggccagatgtggggtagggagggcagttccctgcgtggaggacccgcagctgtccacggagcaggtctgcgggggaggagggggcctcagaggtgggtgtgtcatgctgcagagcctgccctgggtgaggggctgccctgttgctcccaggtccctgtttcagttctgggtccccatgctgggtgcttgctgagtgctaggggtagggcagggcagggtccccaggggccggtaaggacatgccattagaggctgggggctgggccggcctgaggtctgtggctttcccaagagcttctgtaaagggctcagggacagtgactcacctctccgggctagcagctgcacgtgggagggctttgccagccaggctgggtgggcctctcctggaagcacagtcaccccaggaacaggctggcccctggggaccccaacttcccaatcccagcccctgtctagacaggcagggatgtagcctggccccagggtactgtctggctggagtccagtggtggagcagcccgaccagccccttttccttagttacccacctgcataataggggttggggccacgatgccctgtccttgaccctccaaatttctaggttggccacactgggtatcaggaaggtcttcaagacccgaggacatgaatcctgaatgctggctttttgggcagcagcggaggttctgtccagtcccaggactgtcggcgtccctcttgacagggccacctgctctctgccgattgccatctccagcatgttggacaatcttcactggactctttgaggaagaaagcccctcttttccccttccaccccatgaagctgaggagtgagaataagaatcctcctgaaattctaaaaaaagaaaaaaaaaaaaaagagaacgccttgtccgtggctgttcaggcgccagacgctggcccgaggggacagcacagccgtgggatgaagcagcctgggggcagtatttgagcgtgcaggtgtttgcatgtctgggtgagtgtggtgtgtgtgcctgcctttctgccagggcgtggcgaggtgaggggcacggcttctccccaaaggccttgctgagccctggcctcccttcaaggagtcttgtggatgcctgctctggtctttttctaaaaaagtatctattttatttattattatttgtttaaaaatagagacagggtctcactatgttgctcgggctggtctcaaagtcctgggttcaagcattcctcctgcctcagcctccgaaagttctgggattacaggcatgagccaccactcccggcctgctctagtcttttgtaacctagaggacagtatggatacagaaaactttactccccaccaaccgccggagacagagtcttgctctgccacccagactggagtgcaatggcgccatcttggctcactgcaacctccgcctcccaggttcaagcgattctcctgcctcagcctcccgagtagctgggattacgggcacgcgccaccacgcccagcatattgtatttttagtagagacggggtttcaccatgttggccaagctggtctcgaactcctgacctcgtgatccacccacctcggcctcccaaagcgctgggattacaggcgtgagccaccacgcccggctgggatacagaaagcttttatttcatcactgtttcctgcctggtgccaggcccatgctggggttcctcccaagtggaattactgacttaacatttagcttgggatcctgagacttccatcacacagttttctcattgattcgcagccaataatatctgttttaaaaacatctcaggccgagcgctgtggctcacacctgtaatcccagcactttgggaggctgaggtgggcagatcacctgaggtcgggagtttgagaccagcctgaccaacatggagaaaccctgtctcttctaaaaaaatacaaaattagccaggcgtggtggcgcatgcctgtaatcccagcactttgggaggctgaggcaggagaatcgcttgaacccaggagacggaggttccggtgagccgagatcgcgccattgcactccagcctgggcaacaagagcaaaactccgtctcaaacaaacaaacaaaaaacatctctctgctccttggggccgggtgccagctctgctattggaggcactgagcgaccttgaagcaggcatgtcactcctctgtgccccagtttactcatctgtaaagtgggagagctggggcagacagtgagctggctgagggcaggactgtgtctcctcaagcccatggcccagggctgccaggtagtagtttgtattcggtaaatgctgctggcccctaagtgtgagcgtgccctgcaaactgcagcgtatggtgggacagccctgcacggctacccctttcctgggtgaccttatttggttacggtcctatctgaagtaggaaagggacactttaggctgtctcttagctccctcaaggccccacagcctggactagagttgccagaaatacttggtccattcaggccaaagggactgtgaggttgctgggatggtgcaatcagtctttgtccatgatgaacccacagggtagaccaggggttgggccagcccagtgccctgtgtagttgagcccaggccccaggcatcccatcccgggcggtggcctcaggtggaggtggggcagccagttgccagggatgtgttccagcggtcacctctcaccagccccggctgcccatcagctgttctcaagtccaggcaatgaagccttcctgccaggaaattcccagagtttctgtgccatgaagtcagcctgtggccatcttgggacacaaggccgggtgccctggggagagtactctgggcccttggccaggtttgtctgagagtcataggcagcctgatactagtggagccagccagggagggatgaggcccagccgctgctggccataagtatataagggccatgtgctgagtgcctactatgtgccaggttttgaaatcagtacttgatttattgaaaccctctcttttaatcctcaaggtgcccctatgaggcacgtaccatttattgttattgccacttgacagatgagaaaacagaggctcagagaggcaaagtggcttgaaattcagtgattggtctgggatttgaatccacagccatgttcttaagggcatgctatgctgccacctatcctgtttatttccggcactcattgattcttcaatgtttgactcattaaatccatcagtgagcatcttctctgtgtcatgcatggttctcacctctgaagatgtagctgtgagcaaaacttctacagggaatgagttcacagcagagggatcagctagagcaaaggctcagaggtgggaccgtgcgtcctgtgttccaggaatacagtatggctgcagcagagagcagtggagagagggcctggcagtgaggtctagaggcggccgggctggctcatgctggatgtttgtgtcctcggaaggactttggctttattttaaagaggatggggagccccagagagcacagcagggaagcctggggagtctgatggacatttaaaaggatccttaatggagagagtgaaggcagagccttccagaagggtaagagaagggaggatggagacctgccctcccccaagggaggccactcagaagaggtagagtgtggccagggcagagagcaagagaggctgtggacacaggcacactggtccagtgagagccattagacacattagatttagcttcatgttgtctttagagagggagccagcctggcctcgctctatgatcttggacacatcctttcacttctgggtctcagtttccccattagtgtgatgaggatgagaatgcttttgtcctgggcacactatgagggtggtgctgggcacctgggtgcctggttaccatgggcaacaaagctctattcatgggtgtggtgaatgcattgcccacagcaactcagggcggatgaggagtttcccagcagcccctggtgccctttcggctgaagccctaacaactgtgggaaaatccaagttccagcagaccccctgagccctctgccttaggaccctccttctaggtggttctctgagcctggcctgagctggaggagggagtggccagtgctgcagcagaggctgcttcatagtaattgcagccaacagttattgactaggcactgttctgaggggtttagatgtggtaactgattgaattcgcctaacaactttatgaggtaagtcctattgttagcccattttgtagatgaggagactgagtttgaaactggggggtgtaatggaaccttctcaggacccttgaagggtagggcctttgtactcgggccacgagggtggggtttgtgtctgggtgggagctggggagggacaggactaggattaggcagatctgaggccacaggagttggttggggggtggctccagagccactccactccctcctaccacattgactgccttgaaagtcccctaatggccactcccatgaagtgtgactgctctgggctccccgcaggcgttttctgcaaggccaccgcccacccaggccccttccccagaggggctgcagtgccttgctccttccttgtgggaagagttgggattgtctggcgtcagcaggatactgcccctgggcatccctcccggtctcttcctgcgggtttctgatgaaacagccaggctccagtagtggagccagaggtcagtggtggagagaggaccaggagccagagggtatagctgctttggggctactgtggggtcagggacacttgtgaggccaagcgtcctggctgcaggagccctcacatatatgcccacccttcaccaggacattgaggggtgctgggggacaggggtagctttttgggggtgtctgccttcgacttgggctccgctacacaggccaaatttggatgtcccatgtttagagctgtgtttctttgggacctcttggggcctcagtttcctcatctgtaaaatgggatactgatagtgcttccccactggcctcctctgacgggcgccagggagaggatgggacggagcatggtgtgctgggcacgctcctgctgtacccacccacctgggagaggggagaggcaggaatgtcctgggggtgtcctttgaggcatagccctgtcaccccaacatcctacaaaggcatgagaaggcagcgaggacagaccccgaccacctgagccctcagcagccctgccacactccctgcttcacccccttcctgactgatctggcacattcttgattctcctagggagtgacccaaaatccctccctgccctgctgtgtctctggggtggaaggaggctgccagcccctcctctctcccagcctcaggcttggccaggacttaacaggcaggcagagaagcagcttctccactctcttccctgacacctgtaggcccctcctgcaggcacttacctctaagtggactctcaggaggaggctcatcagggctgcagggctcagaaagagctgggctgtggagctcttgccaaccgccaggccccttctaagtgctttagcgccaccgactgcatcctcccagcagccttgtgagatggggatttgtggttcccagtttactgatgagaaatactgatgagagatgggtgtggtcttgtctggggctccctggctcctggatagcagctcaggttccatcctgggcaggctggctctgggacacccccccgaccagctgctgtgtgggattcacggtggggcttgggcagggcgtgggatcttggggccaactgagccactctaggcttccagggaccaaggccaggctgagctgtctctgtatcctgagagagcatgaacatcacagaagatgggcccgggttcgaatcccagctctgccactactaactgggacctgggcaggtgtcccttcccgctgagccttcatttcctcaccagcaaaatggttcgtgcccctgctttgggggctgtggagggttggctcttgtctacttgttcatacctgctgttgagcagctgctctgtgccggcctctgaggatgccactgtgaacagagcctgtcgctacctccaggagcttgtgtttaggggtgccgttttgattccagcactttcacccagctctgctccggtacccgatgagagacgtcgagtgccgctttccactcgcttgggtgcgtgtgggggttggggggacagggctttgtgcacgtacccctgggtggatgttcctgggtgcacttagggtgtgtgagggtgggacctcccacagttccctgaggctccactgatgaggtccaagaaccgccttcctgccccccagcccaggctcccagcagctgggcccttggcttcttgagatagtgactggcctcacggcaaggacccccgcacaccacctaggagaactgctgcttcccctctgttccaggagtggcgacaagcacagtttttcgcttttgtttttgttttcttcactttaagttccgggaaacgtgcagaatgtgcaggtttgttacataggtatacatgtgccatggtggtttgctgcacccgtcaacccctcatctaggttttaagctccatatacattaggcatttgtcctaatgctctccctccccttgcccctcacccgcccagtaagccccggtgtgtgatgttcccttccctgtgtccatgtgttctcattgttcaactctcacttatgagtgagaagagacctggactctgatctaacctcggtcaaatggaactgtgtgaccttgaagaagtagcttaacctctctgagtcttagcttctgcctggcacccccatccttaaggagaggcccacagaggaccaggtcacatgacctcagccagttccagagaaggctgtttgcttccaggtttcggcctgagtccaggcccctgccctactcgcactccctgatagcatgagaagcacagccccagggtgcccacccagctctgagagcccagcctgcttcccagggaactgtcacagccccacctgtcccttccccagctggagccctgtcaatggctttggggttctctgacacagccctgagggggctcacacttccccttatcattgcaaggggtagatctggcttgaaggccctggggcaggcttggttctgtcctcccctgtcagtgcctcgacagggctggcctgggtgaatcaggaccaacgggaaaggaggcgaggagaccaatctggacccaagatcctcagctcaataaggtggccccagaactgacatggggtgatagagggaagggctgggagggaggagattctggggccgcagccacagcttgcacgttgcgccgggtgtgtctgtgcgtgccagctgcatctttgcgtaccatgtgtgcaaggctgtgtttggctgagtgttcatgtgggccgtgattgtgggcatgtttctgagtgtctgagtgatgcctgctggtgtgggctggtgggtgtgtctgcatgtgcgtgtgtgtctggggagtttcaaaggagaaagagggactcaccatcacgctggctcagccttaaaaaggtaggacatcctgacacgtgctgcaacatggatggaccttaaggacattgtgctgagtgaaacaagccagaggcaaaggaacaaacatgtgatttctcccagatgaggtttccggaggaggcagatctgtatggacagaaggtagcatggtggttgccggggcagggggaggagagaatggagaattagtgtttaatggggacagagtttcagttggggaaggtgaaaaggttctggagctggatgatggtgatggttggacaacactgtgcatgcacttaataccactgagctggacacctaaaaatgcttacaatggtaaatttcatgtatattttactacaatttttaaaaaattggctgggcgtggtggcttatgcctgtaatcccaacactttgggaggccaaggcgggaggattgcttgagctcaggagttcaacaccagcctgggcaatatggtgaaaccccgactctacgaaatatacaaaaattagcctggtgtggtggcttgcacctctaatcccacctactcagtaggctaaggcacaagaatctcttgaacctgggaggtggaggttgcagtaagccgagatcatgccactgcaacccagtctgggcgacagagcaagactctgtctcaaaaaataaaagataaataaaaaaattagaggccaggtgtggctcacacctgtactctcaacactttgggaggctgaggtgggaggatcgcttgaagtcaggcatttaagacatgcctaggcaacatagtgagaccttgactctacaaaaaaattcaaaagttaatgagacatggtggcatgtgcctgtagtcctagctgctggggaggctgaggtgggaggatcacttacgaccaggatttcaaggctgcagtgagctgtgattgcatcactgcactccagcctggtgacagagtgaggccctgtctcaaaaaaatttttcagtgtttttctgggctgggcgtggtggctcattcctgtaattccagcactttgggaggctgaggtgggtggattgcttgagcccaggagtttaagaccagctgggcaacatggcaaacctcatctctacaaaaaataaaaataaaaaattagctgggcatggtggtgcacacctgtactaacagctacgagagaggctaaggtgggaggatcacctgagcccgggaggttgaggctgcagtgagccatgattgcaccactgcactctagcctgggcgatacagcaagaccctatctcaaaaaaaaaaaaaaaaaaaaaaaaaaaaaacacccagtggggtcagtagaaccccaagagtcttcttccctcccagctcccctgtacaccagccccagctctgcaggtagctgggggcccagacagcttcctggggacccccagccttccctctgcccttttttctaccagttttgctgcccctccttcaagactcatgtccagagggggtgagatctgcacttatacagccccctcctctgtaatgagtgagccaagtcagcccaggttattccagaaggggcaccctaccagccccccagtccccaagctgccctgggcctataaaagcaggcaaggggacccctagtagatcatgtaggtgttacctcttagtgggtgctggaggggcctgaagtgctttcttcccccagggtggtaggagaatgtcctggcagtgacttcagggcccgctgtcacttccgttttaagactcaccagctggtaggctcattagcaagaggacaataggaggcccctgtcctcagtcagctttcttcaaaggtgtttcctttagcaactgggaggcctcccttctccagacccatggggacaacaccacccagctactggttctataagctgctgtatggctctggctagcccattcagagaaagcctctgaaagtacaaggaaaaaaatcagtccaagagctgtgaacaattagtgagccgattacaataccaagaccacaggcagacctggaaggctaagtgagcccaggtgtgaagttcaagcttactttacttctgggccacttcctggctggtctctttccctggcccttatctttctcctggtctgtcttctcttctcaccccctttctttactctttcttccttctcctgcatcgtactccacccccactccagctattacacagaatcgcgagaatgttggattattcattttatttatgatgttttcttttttgtaaaaatagagacaaggtctcactatgtggcccaggctggtcttgaactcctggcctcaagcaatcctcgtgccttggcctcttacagtgctgggattacagatgtgagccaccatgcctggcccattttatttactttaaaaaaaaaattaggctgggcgcggtggctcacacctataattccagcactttgggaggccaaggtgggcagatcaactgaggtcaggagttaaagaccagcttggccacctggggtcaggagtttgagaccagctactccggaggctgagaccggagaattgcttgaacccaggaggtagaggttgcaatgaactgagatcatgccattgcatgccagcctgggcaacagagcaagactgtctcaaaaaaaaaaaaaattatgttttgtgctcctgcttcctgctttgtaagtcaaatcagtttaactgttcaagtgtcttccttgcaaacccccaaggactcaatgtgtgtcgcccttgactgatccccccgccccgtgacccagtggtcctcagttccaggttttcccacctacccttcacccactgcttatgtttataaaaacggggtaaatcaaatgttcgtgacccagatcttattctacatgcagtggaaacttgtatgacttaagctttttggaaaagcagaaccttttttcgtggttcaagaaatcaaagtcttcccgggaggtctttctgtaaatccagagctgcagatgtttgaccgtgttcagagaggggcccttgtgctgggtgaagtggatggggcacagcaggcaatgggtgaaaagcaggacaacctggggccctgggaggaccagggagggcccatgtctttgactgttcatcagccggctgacttcctgtccgcctgtcgtctgctctgcccatccatccgtagtccttccgcctgtctctgctggttgccgctgtgctactcagctgtgtctgtctgtccgcctgactgtctgctctccttcaggatgccttccgtgccttccatcaagatctcaattttgtgcgcaagttcctacagcccctgttgattggagagctggctccggaagaacccagccaggatggacccctgaatgtgagccagagccctaggagaggctcagcccctgagggagggggatggctggagggctgggagacattgccacatggccaggagcagctccctcggcattcgcccaaggggatgcagagccagggctgagcctgccctcccctcccagggggcaggcagttgaaagtgaagctgtagggatgccctgagaagtccagggctccagatctggtttagccaggcacccgtttggatcccgaggcaagctccctccctgttgtcgcccagtgtccccatcaaaaggaggattttgatgaactgatttctctcctggctgtagcgtcttacccaccccataccttttgggagggagaggaggcttcaccaccagccagtgctccagctcacaccccgggctgggtactcttgtcacttcattcctctttgcccacaccccttgggcctggcgatgggaggagcggctggggctccaggagaatgggggtggggaggaatttcttccttggctgatcggcccctctgctatggcaggcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggtgaccccagttctgtgttgcagccaccttaactgcccaacagacgtgggcccccatgcatctgggcattgtgaacatatttgctaaatgaatgaatggacctatgaaaggatgaatggatgaataaacagatgaatgagtgaacagtctgaaggcccatcaggcatgtctgtgggtcaagctgcattccagatgagccaagaagttccttcttgaacagattccgatcaagcacagggccactgagccagaggctgctgccctgcagcttcatgacacttacgagcccctccacctccctgggactcagttctcatctgtaaaaagaggacactggcccacaagggtcttgaaatggagcattagcacgggggtaccctgcaagctgaaaggattcactggggccccaggccctggcgggctccgtccttcccaacagcttctgaccctgcctctctccccaggctcagtcctggtgtctgcagcatgacctgggccatgcctccatcttcaagaagtcctggtggaaccacgtggcccagaagttcgtgatggggcagctaaaggtgagggtggggtgggtggtcagccaggtgctgggtggcgctgggtctgcccaagtgtgtgggcacagtcgggggcacagcctgccctgagagccccctcctcctccacagggcttctccgcccactggtggaacttccgccacttccagcaccacgccaagcccaacatcttccacaaagacccagacgtgacggtggcgcccgtcttcctcctgggggagtcatccgtcgaggtgggtggggagggacgtggacaacctctggctgggcctgcagctgagggggagctaatgcactgggtccccactctgcccctgacctagcccctgatctggcctccactctggctgggccaagctctgcccccgtgtctttccttcccacctcccaacctgctggggacgaccagcccgcttgctagaatctagagttgcctttgacccttggccccagccagccccgtgaccttgcccgggagaaggaggtggcctggagagctgctgtctccagccgccgcctgtctccacagtatggcaagaagaaacgcagatacctaccctacaaccagcagcacctgtacttcttcctgagtgagtgtccatctgtccttctggggtgggggagtgcctgggcctgcactgtcctccctgctgtcctggaccactcccagccacttcctggggcggggcacgtctgtcaggtctccctggtcatggcatcctcccagcctctgcagtctgtacacactctcccagcagcatgcctttgccccagctgtctcccgtgcctgggacaccttgcagccacgggccatcacagccctgctgggagcttccccaagccccacgtagaatttcttcttgccctcactagagtggtccggagccctagagtctttgggcagttgttggggcggacagagtgaggactcaagtctggccctgacttgcggtgaagggtggtgggaggtggtggggtaagggcagcctggggaggcttggacacagaattgggggtgatatggggtcattcagctggatgtgaccagcaccaacgtcccaggggcattcctggagtaacagagcccctcactctggcgcccactcaccttggcagcccagccccactcctgaacactctcatgccccttcttgcagtcggcccgccgctgctcaccctggtgaactttgaagtggaaaatctggcgtacatgctggtgtgcatgcagtgggcggtgagtggggttgcccaggaccccgggcatacggctgccgtggcaggaggtggtgcctcgggggacagtacctgcccatgaaggcaaacagggtgcacatgtgcgtgcaacagtgtggctcacatgtatgcgtgcaacagtgtggctcacatgtgtgcgcgcagcaggagagcgagtgtgcccgtgactgtacgtgtggtgggggggggttgaggaacagggggggtgtgggtctctctcggtgagggtgtcttcccaggaggagttgctgggctgactctgccaggcatctgtgtccctggcagggtcttccccaacacaccctgcatgacaccttcgtcactaaaatcagcctcgtgagctggcagggcaaggaccctgttcctttactcagctgagaaaaccagagagggtggtggcctgtcctgggctctgaggcaaatcaggcagaagggttggatgcctgaggtcctcctcccacccaccaggcctccagacctccgggcacctggagacctctcggtatcgcctctgccctcctctgcaggatttgctctgggccgccagcttctatgcccgcttcttcttatcctacctccccttctacggcgtccctggggtgctgctcttctttgttgctgtcaggtatggcagggagtggcgaggtcacacacaggcgacaggtgacccccactgcagccccccaccagagcttcccttttcccgtctgcagaatggggccagtggtactgcctccctggcttgctggtggaatcacataaacacaagcgtggcaggagcccagggtcggtgggtttagggagcgtggcctggcttgtaagtggcccggtgggtgtcggagctgctctggactcagcctcacagtggacactgctccattcagattctttaaacactggcaagggggcgatggccacaatcctattgtacagataaggaagtcaaggccacttggggacagctgctctccagcctccactcagggtgcctaagtggtgagctggacctagggcagtgcccgagcctccccacagggtcctggaaagccactggttcgtgtggatcacacagatgaaccacatccccaaggagatcggccacgagaagcaccgggactgggtcagctctcaggtgggcagcaggggtggggcccatcctgggtggggtggggggtcccagctaggagccagatggcaaagcagggatgaggccctgacggggctgccaggtgggggatggtgccgtggggtcagggatctgcaacggcctcctcacatgtgccccgccggcttccggcagctggcagccacctgcaacgtggagccctcacttttcaccaactggttcagcgggcacctcaacttccagatcgagcaccagtgagtgtgggtgctgggggccagtgggaggtggggagggggtcctgggaggggatcctgggaggggacccgtgggtggggcctctctctggaatctcccacttcaggtgccagcatacgctccccacccccagcctcttccccaggatgccgagacacaactacagccgggtggccccgctggtcaagtcgctgtgtgccaagcacggcctcagctacgaagtgaagcccttcctcaccgcgctggtggacatcgtcaggtgaggctgcagcccggcccctctgttctggtggcttccccagggcctatgcctacccttgtccaggtcagcctcatgctgagcccccagggtccctgagcctttctgtccacgtcccatgcccttcctcccttccccagccttcacgcacacagtgagaatttctggagcacctactgcagactcacaaacagcagtgcctgcggtgagcaggtctatgcaaacctacccccaaaggctgagggaaagaagctaacagatccagtttctcagaaggaaacacttaacagggactcataaacagaagccatgtctcagggccgggtgcggtggctcacgcctgtaattccagcacttggggaggctgaggtgggcggatcacttgaggtcaggagttcgagaccagcctggccaacatggtgaaaccccgtctctactaaaaaaaaaaaaaaaaaaaaaaaaaaaaaaaaacaaaaattagctgggtgtggtggcaggtgcccataatcccagctacttgggaggctgagggaggagaatcacttgaactcgcaggggcggaggttgcagtgagctgagattgtgcctttgcagtccagcctgggcaacagagcaagactctctcaaaaacaaacaaaaaaaccatgtctcaggcagccaagagttgggacatcccctcacacgccctctagaaagaaccctctatatagcaagcttttagggtgaaccccatgcaggtggttcttatgaacctggtgaccactggaggttagataagcgtctacaagaggaggttatctatgccatgagcttggcattcagggtcaagcatcggtcatcagacagttttgcttgaagatggcattgcccttgtagcaatgcaggctctagagagcttcctgccctcttggagctgatgttccttccagcaaaggaaacagcaagcaattaaaataacaaataagtacattacagaagatgggcaaaagaacaatgaaaagcccctcagggtggggacaggggaggggaggggggcggccaggcaggggcggcagtttctaaataggtggtagggtgggcagtattgacaggctgacgtgtgagcagggacagggaggaggggagaggtctcgccacagggacatctggcaaagagcgttcaggcagagggcacttgaccctgaatgccaagctcatggcatagatagccgaggcaggcatgcaggcactcagagaagggacacgcccggcttgcatcttggaaagctgcccctactgggaatgactggcgggcaggagtcgaagtggaaaaggagagcagaggacactgcagccatccaggcgaggggtgatggggctcagcccttgtggtcaccttggaggtggagaacagaggccagattccaggtcttatacctctgcgcctttgtacacgctgttccccttacttggttgcccttccttcctgtgctggtgttcagatgcccacttctccttcatgatctctcccagcctgatgctctgagcccctgccatttggcacagccctttagagcgcctggcacagggcttcctagcagattgttgacatttctggctccactgaccaatatcaggcccaagatcgggtgggcaggttccacgtcctctctgtccttgggttgcagcgcccagcaggaggcagcaatggagaactgggtgcaggagggacaggcccacccaggctcatgcctggacttggccttggctgccctccagctcccctacccgacacccgtcaccccggtctagattccattccagagaatgagcattcagctgttctcccaacccaccctccagcccgcatcgctgcctgcccccagggaagggaacccacagggaatggggatctccgctcacacttaccatgggggatacaggggtgttaggatcttgcaactgagctcctaacacccacccccactgccacccccacctcccaggtccctgaagaagtctggtgacatctggctggacgcctacctccatcagtgaaggcaacacccaggcgggcagagaagggctcagggcaccagcaaccaagccagcccccggcgggatcgataccctcacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgtattatggagtggagtggtgaatttgcatgagttttgaagctggggtctgcccagactccccaacagcattcaggccctcggccatcaatgtgtgtgttggggccggcggcggggttgagggggagcgctaaggagctccctttagctctagatgccctgggcctgggagcccagggatgcctggactcggacctgcccgagggcctattcacttcctattcatgctgggcttcaagtcacttgacgcttctgcatggtgggatgagcgggcccagcagatgaggacccagggctgggggccatgtctgcggacgcttctggacatggactgggaaagacggttgtgcctcttgacctgcactggcctcccacagccctccatgatggggggcctgaaagggccccgcgcagcgggccacctgctgatcttagcgccacatctggcatcacaccagtggtggtggtgcagcctgtgcccggtggcccaaggaggcaacgtcgatctccctcaagcccacctgggaccaggtgcttgtctgtagttactgcagtgaataggctggacccccgaggcatggccattcctgtccctgagtccctggagtcaggtcttaggctccttgtctggcagtgggctggactgtgcctgtgggtttcggacagttctggggagggctttgagttgcctcttggggcacccagaattgggaagaagatctggctggaccaatcagtccccagcatccacacagcctgacagctccaagctgagctgagggtttcatctgaagtgtcggcagcttgaaaaagaaagctgagtgaggatttctatgaggcctttctggagtgggagctggggtcgccctaccagctgcaggggttgccccctactttttgggcttccattggcctggactgggttctctttgggaggtggaaaaggcgcaaattctgccaatttttgttcagcccctccaaggcccatcctccgtgggacggagctggaggggaagccccactgccccatcaacccgccccctactccacacacatacaaggtggcgctgagtgttgctgcccatgaacttctcttccgagacagccagaaagctcctcagtgctaaagctgatcaccgtagtctcacacctgcttcctctctgtgaggaggggccgtctgcacattcccatggactcttgcggctcttcccaggggctccccttctagaaagttctctctgacccgcagggctcctccccttccctgcccagcctgtgactagggtctctgtgacggcacctggaatactgacatcatttgctgctggaggctggtggcagcccagagcctggcccgggagaccctggggtgtgttttctgagaggatgacagacagggtgtttgggtcctgcttccctcaccctgacttctggggcaggagagcactgggggaggtcctgttcggctcacataatctcccagacccaggagcagacagcccaaagctccctatggcctcccggcccagggcagtgccagcagaggcctcctggtagggccagggaagcagagggtggcagccccttcagcttggttgtgagtgagatgcctgccctcctccgggtgccacccagccccaccggatccactcaagtcagacagacttgggggtggggtggggtgggggcaagtcctgtttctgccaggacgcaggctgtgtgaccttgggggagttccttgaccccgagcagcagtacctagggtgatggaagaaaggctcttagcaaagggcacagcagcaggctcagtttattcacaaattttgtgcacacaacccaattccccaggatgaccatttgctctgtcacctagggcaagttcttttttgccttccctgagcctcagttttcagccgagggtaagattggatgctccttgaaaggtacttcctgcctcagacacacgcttctcatggccagggcgtgccttgcattcagggtctctgcacaggctggtccctctgcagggactcccccttcctgtcaccgcctgtttaaatcctgttggctcctagtgccacgcgggcgccctgagccagcgcaggctccgaatggcattccctccgtccacaccctggtagagatcgctgtgcgctggctccgaggcgctcgccagggagatgctaacaccgaggatccacgacagctgagcctgcagcgccacccaggggcgcccggagcatctgcgccagtgtggggcgggccgtgctccctactgtccctggtaacttgctttgcggacccctgggaggccccgccttcagcagccactcctagatttctccagaccacctgggacccatcactggcaggggaatctttgctcttgtcccactgtcccccatgctagatcccctgggaacaggtcaccctcagtcctgagctgagctcccccttctccatctgtaggtctcctagtctcagaacaaaggcttagggcacaggggccaggtttgtaaaaggaaagaggctttggtggaacctctgaacctctgagaaaccgtgttccttttttattgtctgtacaagaggcgtgggcccggaggaaaaacagctcccgagggaaaccataaccgcagtgttggtttgttcctttgatcatcaacatttgctacgggtctcccagcccaggcagatgttggaaatgatgatgcccaagagccagcccctgcctggtgtgttgggagtagctggaggggagcagggcgtcaacaaactcttttgtgacgggacaggccatgggtttctcaaggttcctccccccaccacactatgtcctcaggcaatgagccaccacaactactgggagcttggcctattccaagctcttggctgctgtcactctttctcttggacacttgctcttgaatgggacgatttagaagaaagacctgaacgcctttaaaatccaaagcaaagtgtttgtgatggtggaggacgatggggacgtgatcctgaaatctcagcacgctggggggctgcttgttccgtgtatgcactggccacatgaagccagtctgctgagaaaaggaaaaccagtcccgagggcagtggcgtttcagcctggggcaagccatccccacggcgccccatttccctctcagatgttggaacagggactctttgagaggcagcttctttggccagaggggcacacctctcgggggagggtgcagcctggctcgctgaggagtcccgatgggcccaaggcactgtgtcacataagcaatggccagccactcctgatggcagcccaagcccagccccagtggctgccagctctgccctggtccagcttggtaaaggcttcctctcccctccgagtaggcacgagggcttcggagtgtccagccagacaccccgaggatccgcctgtggtgccacagcaccctcccccgccccacacacacacagcttagacttggggcgctgcagatgtccccgctacccacaaagctgatacccttttatctgcgtagctacactgcccttatctcctcctcagagactaactgccctccactgcccccactcctccagccagccgctgggcctcctgggagctgtctgacatttgacgtgatgggggcagggtctgggaaccagccctttctgtgcaggagaggtggccaggagcctgcgggttaggagcagggtcctgctgctgtgtggcctgcgcagtcctgtcctctctctgggctcagcctcttcgcccatgatggtggtgttggggtttgattgctcagggccttgaatattggggcaccatgactttggcaggggatagggattagaaactcacaattctgggtgtgttggcaagggggtcagctgagtacagggacaggagggggcggttaagcagagagcagatatgaatgtcctcagcttcttgacccagggaagtattcaagggcaaggcggggctgggtggggctggggaagtcagagaagctccaagtgcccggtgaggctaggccaagatttatctggtgccctcatagccccagcgtccatctggcctccagtatccccaattccaagccccctggttgttatgggtgatggacccatggatttccaactggtagggttgggaggcctgggctggtcgccatcctggaggcgggtcacaggcacagggcagagggtgggagccgtgcctgccagggtcttgtaaccttgaaggccactgccagcgggtccaccaggagggcaaggcctagggtaagcgggtgttgagataatggcatccttggggcccctctagcctgcccctgtggactatggcccacagggccagggagggcaaaggactccccagagccacttggtgaatctggggtgagtcggccacctcgctcagggcttctgtaatgccaggccctactcaggacaccctgtggccactggggagccatacgtaccccagccagtctgctggctgtccctacctggctggatttcggccaggcaaagcgggggtcaggggaagcaggcgggggctgaggtctactcaggagccctccccagccctgctgggagcagctacaaagccaaggggaggccccaaggtgttaactagccagtgcctcttggcccttccttggcactttcccaggatcagccctgccaggaaagccagcccagagatgatgacggagcagcatgggggtccatgggaggccgactgtacaagtgcccctggcatgttgctttagactcttcccagcctctggggtcagacagacctaggatccaatctctgtgcctatgaactggtgaccctgggctaggatgatatcagccccccccacagcctgtgggttctgaatgagccattgcatatatgggcacgggagccacaaaaagaatcatcagcctccagagccttcttcagcccccttttaatttaatttaatttatttatttatttatttatttgagacggagtctcactctgtcgctaggctggagtgagcgatcttggctcactgcaacctctgcctcccaggttcaagcgattctcccgtctcagcctcctgagtagctgggactgcaggcacgcaccaccatgcccagctaattttttttttttttttttttttgagacggagtctcgctgttgcccaggctggagtacagtggtgtgatctcagctctctgcaggctctgccccgccggggttcacgccattctcttgcctcagcctcccacgtagctgggactacaggcacccgccacctcgcccggctaattttttgtatttttagtagagacggggtttcaccgtgttagccaggatggtcttgatctcctgacctcgtgatctgcccgcctcggcctcccaaagtgctgggattacaggcgtgagccaccgcacccggcctaatttttgtatttttagtagagacggggtttcaccgtgttagccaggatggtcttgatctcctgacctcgtgatctgcccgcctcggcctcccaaagtgctgggattacaggcgtgagccaccgcacccggcctaatttttgtatttttagtagagacggggtttcaccatgttggccaggatggtctcaatctcttgactttgtgatctgcccgcctcagcctcccaaagtgctgggattacaggcatgagccaccgctcccggccttctccagccccttccaaggaggccaggaattctgtttggcctggcgctctgtggaagctggctggcccagggatgggagggcagattgcacttggggagacagctggggggggaggatgttaggaagagtctctgcaagcccctccatgccaccctccttgggtaggggtcagctgctgagaggtggctctcagccctgttttagaattgggctggggtcggctgctgagaggaggaagatgggccaatgtttttgggtcatttccaccaagttccgggccccagaatgaatttcagaggcagcagggagaggcgggtgggatggccacaggggagggaggggatacagagagatgcaagcatggggacccctcctggtgcccaggcccagctagaagggcctcatctatcacccaataccatggcctggcattggcgtgcaggaaacacaggaagtgagaataaaattccttattttatttcaaaaaatgtaggggtggggaagtaacatgataaacattacgatcagctccctatgggttcattctgcctctgcgggggtcgggggcatacagtagctggggggcatgccattgccatggcaacccagatgcttagatgcaggtccctcctggctgcttagagctggggggactaggcgccctccccgaaagcccccattctgagttgttggtgcctgcccttcccctgaatctaagaactgattagtgggttagactgcaacagcagctcaggatcctcccaggacttccctccctcccctctcacttgcccgtcccctcagctaccagcacctccagcccccacctcctcctcttctcagctccaccctggtcctcatgaggtaccccctccccagcccctcagggcagcctcctcctgagactccctcccgctctgcctccctggccctccctgacagtcagggccaccgaggcaaggccatgtggtgaaaggcagattgtcacaaggcccagccctgccgccccctcctatcagaatgcatcctggagcaacaggttaaacacagtaagggcaggttcagacaggagagtgcctgaggcagcgccgtccacacagcagccccgagatggggagggctgggacgagacctcccagctccagtgccctcctgcagcctgcagggcccacgtcccctggggccaaatggccagggattggctggcactgcccagctgataacagagcctttggagaagggtcagattgctccagaatcttggacctcaggacaccctgaggaaaagctggagggtgggctgagcctccaggccagccggcccctccctgaacgtggccactgcctctgctgagtcacaagagacgagggactccccctttggtcccaaggtcacaggctcaagttggggaggcggtggaatggggcccgtgaaagcccagggtcagagcactctagtgatggggtggaggactcttccagggcccaaggtttgggctggctgtgcccgcgggcctggggccctggacatcttaagagaggcctcgggtacttaaccgagctgcaggagggagacccgagctttgtaacaaagcaggcctctctatgaaagggtggaccaatggcagccgtcagggagagtgaagccaggccgggagggtcaggggccctgcccgactaggacctgcccctatgaaccccaagagcatctgaagaaccaaagcgggggtgatgcctagtgaccaggctgcaaggggagactcacaggccagacccatggaccgctggtctcctcccatctttaggggcagagagtggaggtaggacagagccacccccggtggccacctctctgctccttggaagaaggggctaggaggcactgggagggccatggctgatggctgacggctgagggagggcaggtcccatgagggcagggtgctatgggggagatgtgaagagaaaaaggagaggagaaagggagaaagatccaacatggggtccgtgagcagtgcatacaccagcctctcggacacccctcagaacaaaagcccatcattcctctggccatcaccccacctgcaccccttccccacggtgtcccgggggctgtggcttcatttgtgaaggtaggcgtccagccacagcttcccagacttcttcagggacctgcaaagttggggatggaccagggtcagggaccaggacgggagtggccccagggagtgcaagggctgaggaggccatcattaaggtggcatgtatgtccccttggccctaaccagggcttaccactgccactgggcctgtggggctgtcagctcagagcccaccaggaaccccacacagaaagggatggtcttctcgcagcccagggagaaaagcccaacagctcctaacacaggctcgggagtaaggcaggtgccctggtgggtgactgtgccaggagggcccagcccctcttgtgatcccactgtctgcaccacgggtgatcccagggcccagcgcctgtggacctccacccctcacctgatgatgtccagcagggccctcagtagcggcttctcctggtattcaatgccatgcttggcacatagagacttcaccagcggggcgatcttgtgtaagttgtgccggggcatggtggggaagaggctgaggagtgtgtagggtgggcagagcgtgaggactcagagggccatgctgctcccgcttcctcccaccacctgggcagaggctggctggggccctcagagaccctgtccacagccaggaccagtctcaaagtgtggctcctcgtgtgtgcccagtggggtgccacgtgtgtggaggggagggtgcagccctccgtgagcaggagggcgtttgtgctctatggagctgggaagatattgggtggccagagacaaagtgtcatgtttttcaaaaaagaaatgaaatagctggggaatgctaggaaaagaggcagtgaggtgaggcacggtggctcacgcctgtaatcccagcattttgggaggccgaggcaggcagatcacttgaggccagaagtttgagatcagcctgggcgacacggcaagacctcttctctacaaaaaataaaaataaaaaattaggccaggtgcagtggctcacacctgtaatcccagcactttgggaggccaacgcaggtggatcacttgaggctaggagtttgagaccagcctggccaacatggtgaaaccccgtctccactaaaaaatacaaaaattagctgggcgtggtggcacacgcctgtaatcccagctacgtgggaggctgaggcctgagaattgcttgaacctggtaggtggaggatgcagtgagccgagattgcgccactgccctccagtctgggcaacagagtgagattctgtctcaaaataaataaataaataaaagtaaaaaaaaaaagaaaaaattagttgggcatggtggcacgcacctgcagtcccagctactcaggaggctgaggtgggaggatgactttagctcaggcgttcgaggctgcagtgagccaagaaagcaccactgcactccagcccaggaaacagggtgagactctgtctctacattttttattttttaataaaaaaaaaaaaaaacagtgacaagaggtgaagcaaggacaaggggcagcagggcagtccctcggccgatgttccaggcaagctacgtagccctgccctgctagcctcacagggtcatgaggtgcgtgtgcaggctccataactacaaagtcccaggcccacatggagggaggtggtaaccactatgaccaagtggcacagcatgaggggcacaggatgaccctcagggagatggaataggggagcccctctcctgacctcagcggggctggctgggagccttgctctatattgggcagagaccttgtcagagagacaaagaggtggcccccacattctgcattctgcccagtgggatagcggccacttccctcccgctgtgggtctccccgcctccccgcagccccgcgctcactggtgctcaatctggaagttaaggtgtccactgaaccagtcgttgaagaaggactgctccacgttgcaggtggctgtcagctgtcagtggaggggatgagtgtcagggaacaaaggaaggcccaagggcccggcctcattcccagggggcccagccttacccagggtctccaggccacccgtccacatcataccgtcctgcctgatggcctcagcccacccagatgccccacctgtccctctgggggattcctgctgccctttcttgctcagccctgaagctcccagcaaaaggacacaggcagccccgggaggcccagcacagccctgtgttagcaggtgcagatcatctggggccaggacatggacattgggaccaggctctggtgaccggccctgacttccctacctggctactgaaccagtcacggtaggcctcctggtcaatctccatgacgatgtgattcatctgtgtgacccacacaaaccagtggctctccaggaacctgcaagagaacacagctcagcgcaggggcctccgggggcccagccacagtgggaacagatccactctcccaaccagcccaggacagcccctgccaaggggccaggatgggaggtccccaggcaaagtggagccgtccgagcctcttctcatgccaaagccatcatcagtgccagtggagggcccagggatgaatcagcaaagcccaggcacctgatgaagttgaggaaaaggagggctcccaggatgccgtagaaagggatgtaggtgatgaagaaccggatgtagtagctgacggcccaggccaggtcctgcggggaaagatgaagttaggtgcaacctgccctctcctctgccctggcaccaagtgcgtgccccagatgtgcacacacctcacactcaggcctctagaagctggaccgcagcccactgaaatgcaatgggcaactacacgccacctgcttgctcggggtttgcatggctgcctttgtttctagggaaatgctgagtgttttagcatcaggaagtgactgtgccctgtttttcgggagagaaacggaccctcctgctgaggggcagccatggggtaggggtgggggtcagcagccctctcgtggggcaagggcgattctgaaggtgcgcccccaacccggggccaggtccccaaccgtcccccagtcctgtccctcctcctcagcacctgggtctcctcctggcatctccttccagcaggacagagggcttggaggggtagggaaggtcagaggtaccatcgtccctatctcagagctctcacagcagaggctggcctccccacgccccactgtcatcctgtgtccctccactctgctctcctccctgcctctggctggactggtgtcagggactgggcttggacgtcttctctcatgtactgggagggtgacttcacggctccaccctgtccactgtctctctgccacccaagtcttgtctcaactggaccacagcatcagcttcccacagtctcctgcttgtcctcgtggccatggcaaccagagtggccttcgctccaagcaggtcccaactctcccctgctaaagcccccatcccacccagtcacccacggagcctcatggggttaagaacctgtctttactcagccccctgacctagcttactccctccccggggcctctgcatggcctgttcccactgccagggcgctcatcctgccatgagtttaggtatggtgacatgccacaggctcagcacaggtgtccgaggtggaaggtgaggccaagggactgccctgtctcacttcaaacgactgaagaacaaggtcacatttgtgtcttaaaatagatccccacccactggagagggggagactaggaagttattccagcggctcagacatgaaatgacagaggcctaaaccagaacccacggcactgacaaggaggtgacagattccagaactgtcagaggcaacggtggctgcatttgtgcctgcttggctgtggggaatctaggctggtcctaggtgatcaggggtcgggtgccagcagctgaacaggaaaggaggaagggagcgctcaggagaggctggagatggccttggggccaacattggccgagggcaggacctcacgttccaataaggtggccttcaaggtgaggagggaggcagatgtagccagttctgctcccactttccatcacattccttctattctgtgtgtgtggtgcaatagtgtgcagtgtatctacacatatatggaaacaaaatgaggatggggttacggattatttttttttggagatgggatcttgctttattgcccaggctggagtgcaatggtgtgatcatgactctgtcccaggctcaagccatacttctacctcagcctcccgagtagctaatttctgttttttttttttttttttgagagggagtctcgctctgtcgcccaggctagagtgcagtggtgtgatcttggctcactgcaagctccacctcctgggttcataccattctcctgcctcagcctcccaagtagctgggtctacaggtgcccgccaccacgcccggataattttttgtatttttagtggagatggggtttcaccgtgttcgccaggatggtctcgatctcctgaccttgtgatccgcctgcctcaggctcccaaagtgctggtattacaggcatgagccactgtgtctggccttacctggataattttttttaagtttttatagagatgggggggtctcacttacttgcccaggctggtctcgaatgcctgtgctcaagtgatcctccagccttggcctcccaaagtactaggattacaggtgtgaaccattgccctggcccaacttttatttttaagagacagggtctcactctgttgcccaggcttgagtgcagtggtgtgatcacagctcactgcagcctcaaactcctgggctcaagccatcctcctacctcagcctccaaagtaggtagattacaggcgcgcatcaccacgcccagctttttgtagagacagggtttcgcccatgttgctcaggctggtctcaaaactcctggcttcaggtgatccctcccacctcagcctcccaaagtgctgagatcacaggcgtgagccaccatgcctggcctggacttcttttgagtgtagagagcaacacatacacagagatcgctggtttcaggggcagagagcccaagagatcagaagcagccaaagaggcggagcgagggggttgggaagaagccagcagaggtggggacctggaagccaacaggaagaactgcaagagggagtggccagtggtgtcagatacagcaaaattccaggagggtgaagcgtgggagcatctcaggatccaggacgtggccccgggaacagggaaccttgccagagcatgtaaatctccccgggaagcctccttcaaagatcttagggtttgtcacctctttcctctaagccagggtcccccaacctccacactattggcacctgggacaggctgcttgttgtcatgggcggttctccagggcatggcagggtgctaagcaccatcctggctagacgcccaccagatgccagtagcaccctcctctcctgaagttgtgacaattaaaagtgtctccggatactgccaaagggcagaacagctcccctgagaaccagtgccccaggtcataggtgcgctcctggctctgaaagccccatgggctcatcacattgtccccactctgccatccccttttaggaacatagggtgatttcttttcctgtttaatactttgttccttagggaacaagcacagtcaaaaacaaacaaaaaaaagaagttgctcactgcaagctccgcctcccgggttcaagcaattctcctgcctcagcctcctgagtagctgggactacaggtgcacaccaccatgccaggctaattttttgtatttttagtagagacggggtttcaccatgctggccaggctggtctcgaactcctgacctcatgatctgcccgcctcggcctctcaaagtgctgggataacaagcatgagtgactgcgcccggcaataggccacttatgagttagaacgggattggatgctagaggcaaggagagggtgtaacatgtataaggagggaaaaaacataatggtgctagtctctaacttgagccactgggtggatgatggagccattcattaacatggagaccatcaggattaggttgtgggagaagaggagaggacttacattgaatatgttggatttgcaatggctgggacacctccaaatggagttagattggatatatgggtccaagacttggagataaaatttgacttggctgctcttaaattcacagtcagggtgaaaaggacaacttcagttagcaagcgataaaacagtaatcaacaggccgggcgcggtggctcacgcctgtaatcccagcactttgggaggctgaggtgggcagatcacctcaggttgggagtttgagaccagcctgaccaacatggtgaaaccctgtctctgctaaaaatacaaaattagctgggcatggtggcgcatgcctgtaatcccagctacttcggaggctgaggcaggagaattactcgaacccaggaggcagaggtttcggtgagccgagatcacgccattgtactccagcctgggcaacaagagcgaaactccacctcaaaaacaaacaaacaaacaaaaaacagtaatcaataaacaagtccacatttggttaagagaggaaaaacttccccatggctattggttggagcatgagggacaaatagactgctgagaaagactggattttaagcaagcatttcagaaagtgacaatttagtctttgataattttcagataaacaatttatctgccgggtgcagtggctcacgcctgtaatcccagcactttgggaggccaaggcgggtggatcacgagtcaagagttcgagaccagcctggccaacatggtgaaaccccatcactactaaaaatacaaaaattagccaggcatggtggccggcgcctgtactcccagctactcaggaggttgaggcaggagaatcgcttgaacccaggaggcggaggttgcagtgagccgagatcgcaccactgcactccagcctgggcgacagagcgaaacaccatctcaaaaaaaaaagatgacgtaattacaatgggccctaatgcaatatgaccaatgtccctattttaaaaaaaaggaaaaattttcaagaatccacttttggtgaagaaaaaaagaaaattaaaaaataggccaggcgtggtggctcatgcctgtaatctcagcactttgtgaggctgaggcgggcagatcacttgaggccaggagttcgagaccagcctcgccaacatggaaaaaccccatctctactaaaaatacaaaaattagctgggcatggtggccggtgcctgtaatcccaggtacttgggaggctgagtcacaagaattgcttgcacccaggaggtagaggttgcagttgagtcgagatcacaccactgcactccagcctatgtgactctgtctcaataaataaacaaataaacaaaataatttttttaaagagggatatttggacacagatacagatacaaatatgcagagagatgatgtaccgagagggaggacgaaagccatcaaccagccgatgagaggcccagaacagagccttccagagccctaaggaatccaccctgctaacacctcagttttggacttccggtctccagaaccgggagaaaacacatcgctgctgcttatgccactcagttcgtggtgctttgtcatacggtcttcgcaaacgaccacacctgtcatctcagccaacgcccagctgctccaacttcaaaccagggtgtggggcaacccagttcatgggactcagggcccacagggagcggggaagggagatggccacacttgcctctcatcctgctgcctttgagaactttctcgggggctctgcaaaagcaggggctgccccagtggactccctatgtctgagggagagtagagatctttaggactaggtcctggtggccccagagggagtcctttcctgagaggcagctaccccagggaggagatgcctggggccccacaggctccactggggcacacgaggaggcagcgtaggacccccgggtccccctgtcccagtcaccctcctccccatgccaagccagctgtgtccccaactcaccacccagttcttatggacgatcatggtcatgatgatctggtactggaaatacatggggatgagcagcggcggcccaactgcaggagagagacaggcgcttagaggcatccattccaccctgcctgtgccggaaggtcaggggaacccaggcccagcactgagtgcaggggccagccctgcagacgtgggcagaagcagccagggaccccggggcctgcagagaaggctgggagcccttgaggacgtgtgtcacccctgggactctctgagcctctgtgtccccatcaggcctgtaacacaggctgaggggtctgcacagcaaggctgctgtggcccccgcttctaacaagtttagtgtcactttctggatctgaaaaagatgtcaggtaggagggagagacacgccactctggggggaggggagggtcccagagtgatttcggggcgccgagcactcactcaggaagaagtattcgtgctggtgattgtagggcaggtatttcagcttcttcttgccgtactgaggagagaggagagatcatgagcacccagtagcctcagctcccagcctcccatgttccccaacccatcctgcagccaccatcccttctatctgctcagggcacaccactgtccctttcctgtcaatctgcaccctgggcccaccaagcctggggcccctccagccctctgggctccccatgctacagccagcagcggccaacgcttcctcagccctagccgagcactggcccgatggcatcgatcctctacaaggccggcacttctgaggctgaggctcagcgttaagccatggcccaaggccacaggaagtggccctgactgggatcagaacccaaaaagctgactctgagcccatgtgacaggcactaaacaaatgtttgttgaatgaatgtgcaacagagcaactctcggcggagcataagcacccaggggagttcctaggtcaccatggagagctcccggagcccgcagtggcagggagaacctaggtaagggccccagaattgctgccagtcatcaggctgggagcatctgcctccctggagcctccctgtaatttacaagagtgaatcactcctccccagctggagcctaaccttgaggacagaggaggccacagcacagactcctcaggccacatctggctacctgaggtccccatgacggcaccggtttcttccccatcagagcctgcaccttgggcagcctgatgcccagaggctctaatggaggagggctgggctgggtcctgggcatcgtcattgtccaatgccaggcataggaaccacggccccaggggatccctggagcccttaattccatggtccagcccctagggaccagcccaccctgcacttccaggactgagaccaaaagatgccgctcactgagtgacacctgctcctctcccttgcagtgtggggaggctgggcttgcagccagcagatgcgcttgagccgactctgcctctcaccagtgctgagactatgtgagtcgcttagccttgctgagccttgtctggcatttgaatcagtggttggtaagaggagccaatgagaacatgggcataatgccaagtgctgaccccaggacactgcccgtcaccctccctatacccctggatccgaaggccagagatgcctcctcctatagtgtccagtcatacttattgcagtcaggaggtcaaagtgagttacagagggaagggaccttggatgatgcctaggccagtgcccctctcatccaggtgagtaaaatgattgtccaaatcacagggagagcatggattcctgagggaagaggctgtgggtgggaaccaggtccaccctgtccccaaggcttgcatcttggcgccaatggccatggtcacggcacaaccagctgaagaacccccagaaacagtccctttgttctgtgtggcctcctgagccttggcaaggatctcactcattcccagaaaggacggccacttgcaggaagactattattaaggccagggctgaggccggccatggagaggtccgagccagggaggcctcacaggagcctttcatgagtctccagtggacggagttgctggaggagccagcactgcagacgttgctctcgaggtggccagtctcggggcctgcagtggcccacagaacaggcccctgagtcctgctctaagcttctcccagaggccagggagcaggctcatagccccagccttggcatgcagtgtctccagctctgctcaagagctcctccccaccgcatctctgtcccacagagcatcccatccctctcgggctgggccggctgtactcggaagtgagcacagagggcaacccaggcaggtcagcaggggccagggcatcctatggagggactgagggctggccacgctgttgtgggggcctgggaggcacctggggagtctgtttggagctgcatgtgcacagtaggcaccctgttctcatgggtgatggtggcctgtgggtggacaacacaggttacaggggctgcctctgctggtaagcactgctggctttagtgtgcgtcccttcaatgccccagaatgaccctcgggagccagggggtcctgcttgccaggcagcagcaggcctcagagtgggcctctgtgggacggtgagcaaaatgctcatcacagtcacgcacgtgtatgtacatgcgtatggtgacataccactacacatctgtgcccatctcgatggcctcagctgcagcggctctgctgggggatggccaatactcccctcccaaaccagaaagtacaactgtgggtttgggatacgaagccctgccctgtggctaactctctgctctcatctttcccacgctcagttctttgccagagctttgccgtttaagtcatgggaccagggaagggagggagaggtattttagaatgtagcaagctaggggggtgagtgcctggctgtttaattgatcagaaagctggggctacccaacaaacatatttcacaagggcccccaggactccgaagctgtggtttgcagccagatggtttgggttcggacagtggtgttgccttttccttgctgttaccttgaacaagtcacttcatgtctcttggccttagctgttccatccatgaaatgggtcgatgacagctcccgcctcacgggttaagcaaggattaagtgacgttgtgcacgcacactgcccatcacagtgcccggtccacagactcactcaacaagagtcaggcttcttcccaactgggggctcagagccccaagtgtggggagtggaggaccccacacatctcctcctccagaggagtccccgtcacacacacagagaaagcccaagaggcaaggaagacacatgactttcacctggctgggctgcggccaagggtgtgggtggcacacatggacctccccctgatcagcaacagtgccttcccaggctgcggttgacaggcagagacgcaggccaggggcaagggagggagtgcagccagccctggcggcggggctgactctcctgtcctcggcctctccatgcacctcaaggccaggcttggatgagggcctgggggatgccgggccatgtggaggggacctttcagctttggaacaaaatgtctgaggaatgacaagggccctccttgtccatcgagggttgggggaggggagctgtcgcaaagcccagtctctgcctctgggaacctgcaaactcacacacagagagaaacaggcggcacgacctccccagcaggagcagaatggcaaggtcccagtccaaggtccccgagagggcggcatgtgtgtcccaaggcgggatgggtggcttaagcctgttcatgaaggtctgcctcaagcaggaagcccaggaggttagcttcagacagtcagagcagcagaggtggtttcccggatgggaggaggaggaggatctcaggcaccgcacggcttctgaggcccctttacactgctaccgggataatggtctcaccagccccctcagaaaacggggatatggcaaaagaagaacaaaacaaggctgctgccaatatcaccgctattaaactcagctctgaaatttcccgtcaatgcaataaaacccaaagcagaaaacagagtggagctattagaaagaaagagactacttcaacatccagattagaaagaaagaaggaaaggaaggaaggaaggaaggaaggaaggaaggaaggaaggaagggagggagggagggaagggagggagggagagaaagaaagagagagagaaagaaagaaagagaagaaagaaagagtgactacactttttttctgtttgttttgttttgttttgttgttgttgttgttgttgttgttttgagacggagtctcactctgtcgcccaggctggagtgcagtggtgctatctcagctcactgcaacctccgcctcccaggttcaagcgattctcttgcctcagcctccagagtagccgagactacaggcgtgtgccaccatgcccagctaattttttgtatttttagtagagacggtggtttcattgtgttagccaagatggtctcgatctcctgacctcgtgatccgccagcctcggcctcccaaagtgctgggattacagatgtgagccaccacgctgggccgagagactacgttttcattattttctaggatatgatcatctacccaggaaactcaaaagaatcaaccgaaacacaactagaattacgaagagacgtaagtggacactagcgggacaaaagataactatcccattcattggaaggccatgcaaacaaaaatttagaaaaaaaagaaaattaagataactaccccaatatccactgctttcccgagtactggagaacctccaatcataatgacaaaatataaaacatataaggattgcgttttaaaagaaacatccatgagacatataaagaagtacagaccttggccgggcacagtggctcatgcctgtaatcccagcactttgggaagctgaggtaggcggatcacttgaggtcaggagttcgagaccagcctggccaacatggtgaaaccccatctctactaaaaatacaagaattagccgggcatggtggcgggtgcctgtagtcccagctactcgggaggctgaggcagaacgatggcttgagcccaggaggttgaggctgcagtgaaccgagattgcgccactacgctctagccaaggtgacagagcatgaccttgtctcaaaaacaaaaacaaaaacaaaaagagagagaaagagaaggggaaaggcaccccactacgagcttccaatgagttaagtgccaaggatgaatgagtgtgagtgtggcccccaagtcatccagacggtggcctgggagaggacagacagcccagcccaggccaagcccgggctcaggagcactcactgcctcatatgaagaagcaatgccacctcatgggggtgccgggaaaactggccgactctggagaaaagtgaaggccgaacatcatcctacccatatcccatttggcagaagttaaagattgaaacacaaaaccttaaagaactgaaaataatatgtatgaagaactttctaagcacacaagaaatgaatctctgggtaaagtgaatatactttgctacatatgacaaaaagaatcctcctggacagcatcaataagaccaaaatgcagaaaacgaggaaaagggctttactgcggagcccgcgctattcacagttccacgtgctgggagccgcttggcagggctgctttgcttatctgtccccagagatagaagccctggccggcatccttgctctggagactgggatggtggcttgaggccctgggacctggccgccccacctggccctgctgtggtgtgtgggactggcatgtgacaagtcccatcagacccactgtcacttcagtcaagagaccagggttccttccagggcggccgggtcctgcgagagccagagcacaggtcaaaacaccaggaacccaggaagcaccaatcctttccccatgagtgtgagagcggggatttccacagaacaccgcggcactggctggggacttccaaacgccgctggtaactgaacaaccagatcctcacagcctcccacccctatctcctgccccaaagccagcgttccagaagtgtcgggggtgagaagatgtcgggaaaggagaggcttctctggccaccacgcacaagaaagacgccttcttgccagtgcagctggtgggactagactttctttgttggagacacagagaacatctgtcaggacagccaacggctctacattacaaagcctcgccgagaaaatgaagcctttgtccccacttatcagagggcctcaagttcatcagttctgttttctagacacctctaattaaagctggcaaactgtttcctagaagaataacaatagcctgtactttggcagaaaatggaatccctggcagcttagagaggcttccaaagtacagaactgtggctgatttcctgcgaattggccatgttacagaaaaatccacgttcctgctcagatagtctcacgggtggaaatgaaataagaagagggtgtacaaaccagaactggggagccaggctgtctcctcgccttgttccaagccttaggcgccaaggctgtcgggaatactacttcactcacggtgccactccttagtgagggaaaattggcctcacttggcagatgctgattgaaccctactctatgcatggctttgtggctcctaagatctgcataaaagcaacaaggatcttctaaactttcattttaatcattaatgtatttccaaaaagcagcgcatatatttatttttttcttctaaattaggtcccgacatagaggctctacataaaaaaaaagaatgtattaaataagaacatttttttgtggaacgcattggtggggcttttattcaaaagaaattatgggccaggcgcggtggcttacacccgtaatcccagcactttgggagggcgaggtgggcggatcacgaagtcaggagttcaagaccagcctggccaacatggtgaaaccccgtctctactaaaaatgagaaaattagccaggcgtggtggtgtgcacctgtaatcccatctactcgggaggctgaggcaggagaatcacttgaacctgggaggtggaggttgcagtgagccaagatcgtgccactgcactctagactgggcaagagagtaagactctgtctcaaaaaaaaaagaaaagaaaagaaaagaaagaaattatgaactactgacactcaatttgtctaccatataaaataatgtaggtcctgttatggttcagaagtacaacagaataccatatggctagagggagacgagacctgtctacatgaactgggggggaagggcatccacattcgcagaggtggcaagttgcaggatacaaggtagaatttttttgttttttatttttttatttttgagacagagtctccctcttctgtccccgctggagtgcagtggtgcaatcatagctcattgcagccttgaggctcccaggctcaagtgattcccccacctcagcctcccctgcacctgggaccacagacgcacaccactacacctggctaatcttttgtatttttcgcagagatggggtctcactatgtagcccaggctggtcttgaactcctgggctcaagcacttctcccacttcagcctcccaaagcgctgggattacaggtgtgagccaccacagctggcctaaaatttttgtttgtaaagaaacagatatatgcatgtttatacacatataaaaatatctagaagactgtatagcatcttgttaacagtggttaccctcaagggcataaaatttggggcaaaggggaggtttgagagactcactttttttttcttttttgagacatagctttgctctgttacccaggctggagtgcagtggtgtgatcatagctcactgtagcctcaacctcctgggctcagctcaagggatccacccacctcagcctccccaataactgagactaggcacgtgctaccatgcctggctaactaaaaaaatatgtatttttttagagacagggtcttgctatattgcccaggctgagactcgtgttttaattctggatatttctgtactgtttagaagtttataccaagtgtgttctatatttgtagtaataaaatgaactaatatgaaaataaaatggtatagtaaatggaaggcaatggcctagcagtccaaaggtctggggcctcaccctagactggccactaaattacgtgactctctcggctgggcacgttggctcatgcctgtaataccagcactttgggaagccgaggcaggcagatcatgaggtcaggagtttgagaccagcctggccatggtgaaaccctgtctctactaaaaatacaaaaattagttggcatggtggcacatgcctgtaatcccagctacgtgggaggcggaggcaggagaattgcttgaacccaggaggcggaggttgcagtgagccaagattgtgccactgcactccagctctgggcaacagagcaagactccgtctcagaaaaaaaactaaataaattatgtgaccctgaacgtgttccatcctctcgctgaccttcaatttcttatccactggtgaagcagattggaccaagccacgttgaggctcctcccagtgtacaggatgatgattctccaaataaggttttctcaacatgagctagtcggttggcgaccaagcttgagcccctgaaatcttgccttcctgctgaactggaacaagatttccctctaccctgggaaaaaacaagccagaaaatgcccttcctggcctaagggtaggagggagacatctaccattctaatgaggagctgtgtctgtatttacaggtgaggccattccacatacattccagccagaacaattcagggtacctaggagaggtatctgtgtagcaggagatgtggacctgcctggctgaatgtcagctctctaggcttccttccctgctccctgctcaggccaaacacttcctaggtcaacaccaaccccttagtcgtacctcgatggctgccattcgcccaggccaaacacttcctaggtcaacaccatctccttagttgtacctcgatggtctgccattcgcccaggacaaacacttcctaggtcaacaccatcctcttagtcgtacctcgatgggctgccattcgcccagaacaaacacgtgcagcatgttcacatcgggatccttgtggaagatgttaggcttggcgtggtgctggaagtggcgatgattccaccagttggcagaggcaccctgtggggagagaggggtggggatgagccatgcaagccaccagggaaccgagctcgcttgtaacaggcccttcttaggagcagttcccggaaccttcaaccctcggggatagcacttcaggcccccacaaggccagaatccagccctgccatgactgagctcagagcatgcgccagccccagatggagtgaagtcactttatctctctaggcttcagtttccctgatcataagacgatggtggcagatgaggcgtgctgctgagggaccacacggtgagcgctccagcaggtgtggcagccagtctctgcctctccgtcaccaggtgtggaaccagagctgtgcaaggtaaagccgaggtttcagggacagtgagaagtggtccctactatgtggcccagaaatctccctcctgagcgtatatccaagagaaatgaaaacatgtccacacaccaactcatagagcagtgttcacagcagcattcttcaaaagaaccagaagagcaaaagcaacacaaatgttcatcaacagatgagtgggtgaatgaaatgcagattatccacacagtggaatatcatttggctgtgccgtaaaacagaacgaatcactgacccttgctacaacacggatgagcctggagaacatgctaagggaaggaaggagccacaaaagaccacatatcacatgattccaccgacatgaaacgcccagaatagggaaatctatagagacagaaagctgagcagttgtgtagggctaggattggggtaggggagggagtgagggggttgggatgtgatggctaagaaacgtggggtttcttttgagcatcatgaagatgctctaaaatcgactatgatgatggttgcataaatctgtgaatataccaaaagtcattgatttgtctactttaaatgggaaaactggctgggcgtggtggctcacacctgtaattccagcactttgggagacagaagcgggtggatcacttgaggtcaggagtttgagaccagcctgggcaacatggtgaaaccccgcctctactaaaaatacaaaaattagccgggcgtggttgtgggcgcctgtaatcccagctactcgggaggctgaggcaggaaaatcacttgaacccgggaggcagagatcacaccactgcactccagcctgggagacagagcaagactctgtttaaaaaaaaaaaaaagtgagaactgtatctcaataaacgatttggagagcgcagttgtgctgctatgctgagggtgggtcctgagattcgtgtcacaccaggaaggctggagggagggctcaacaaacaactgctaacatgaacaagaagaactttcctgtttctaacactcaaataggatcccatgagacaagacacataacatggatatttcttttgaggccacaggtgtccgtctcctcagctcagagttatggccctcgacagttgcccagcgacagatgaaagaaaacacactttcctgaccctttggcatcacgactatcctggtgaactgttgccggatcaatgctttggctaagggtttgcaaaaaatgcctatttgctaaacaaacattttacttgggagatgcttttggcacacacagtctatggacactaatagccatgggtgggaacagcaacggacagctgtggcctttgcagtaacctcagggccctggaaactggcaggcctcaaaacccatgagagagagagagagagagaaaaaaaaaaaaaaagtcagagagtgaaagctcagaggcttcactttgggaggctgaagcgtgtggatcacttgaggtcaggcgttcaaggccagcctggccaacacggagaaaccccgtctctactaaaactacaaaaattatctgggcgtggtggcgggcacctgtaatcccaactactcaggagtctgaggcaggagaatcctgtgaacccaggaggccaagatcataccaacttcactttagcctgagcaacagagcaagagtctgtctcaaaaaaaaaaaaaaaaaagaaaagaaagaaagaaagcttagaggctcgaggaatcaaatgacacatttgcgtttgttgtcaaaaggaacaaaattcctgggaagaatcaaatggaaaaatctctggcacaaagaaactgaggagcaaggcatgaaacaagtaagcgtgatgtttggaggataccaacccagagatgtttattgaacaaacagatggaggaaagcaagacgggctgacaacaaggaggcagtgaggtgggcagtcccggttctccctggactcgggatgagatgtaatgaaagcattttttgttcatgctacttcctctgctgtgattctcttccattttttttttttttttttttgagacagagttttgctcttgtcgcccaggctggagtgcagtggtgcaatctcagctcactgcaacctccgcctcccaggttctcctacctcagccttccgagtagctgagattataggcgcccgccaccatgcccggctaatttttatattttcagtagagatggggtttcaccatgttggccaggctggtctcaaactcctgaacccaggtgatccgcccacctccgcctcccaaagtgctgggattacaggcataacccaccgcaccgggcctctcttccattcttctttgccaggtgaagccctgcttgtccttcaagagcccctccttccgggcaccgggaagcccgccttgcccaggaacaatggccagctccgtgttcccagaatgtggtgcagatgttgcctaccctaagccagctgccgtgctctgcctgggaggtgaaccaagagacaaagcccttgtcctcacggagctgcgagggagggtctggcctcatcacaccaaacccaaactgagctggggccaggaaagctaagtgtccacgcagctggagaagttggccaggcagagtgaggggtgctttcctgacagaggcaagagcctacgggaggccctgggagaggaagggggagtgtagagtgctccagaagccagaggaaagctcctcggtataactgtgaccagcagtgctgggtggcgccatatcagagcctgaggcaaaaaaaaaaaaaaaaaaaaaaaaaaaaaaagtgcacttctggctttaatggaaacaaactcatcgataacattttcaaagcctactttttgcctcatttcattttctttcttttttcttttttcttttttttttttgagacggagtcttcctctgtcgcccaggctggagggcagtgatgcagtctcggctcactgcaacctctacctcccgggttcaagtgattctcctgtctcagcctcccgagcagctgggactgcaggcgtgtgccaccacgcccggctaattttttgtatttttagtggagatggggtttcaccgtgttagccaggatggtctcgatcttctgaccttgtgatctgccctcctcaacctcccaaagtgctgggattacaggcgtgagccaccgcgcctggcctcatttcattttcaatggaaagaattgctgagtttgatggtttctgtcaaccaagcgattagcttaaataatttttatgtttattttttatttttgagatggagcctcactctgtcacccaggctggagggctgtggcacgatctcggctcactgcaacctccacctccctggttcaagtgattctcctgtcttagcctcccgagcaccctcgcctggctaatttttgtttttttagtagagacagggtttcaccatgttggccaggctggtcttgaactcctgaccttaagtgatctacctgcgtcaccctcccaaagtgctgggattacaggcatgagccaccacacccggccaagccacctcgcccggtcttaactaatttctaattacattcaactgaagcaaaagtataataagttctgttttggtataaataaagcatttacacttagaatgttatgacttttaatacatcaacttcttcattgttaaatatttttttaactactttaatcctctggaaaaaaaatcaaccattaaaaaatgacacacgaacatgtttagagggttgcatgtttttccatttccctcagttcatcctgatctttatttaaaattttgatattttgttcattgtggatttttttgcattaattttgatttttttaaaaacatattgcaggccgggcgtggtggctcatgcctgtaatctcagcactttgggaggccaaggcaggtggatcaccttaggtcaggagttcaagaccagcctggacaacatggagaaaccccatctctactaaaaatacaaaaaaattagctgggcatagtggcgcacacctgtaatcccagctactcgggaggctgaggcaggagaatcgcttgaacccgggagacggaggtttcagtgagttgagatcacgccattgcactccagcctgggcgacaagagtgaaactccatctcaaaaaacaaaacaaaaccacattgcattaaaacatcatttatcttgataactgaatttgtctggtgtccccttagaatttgtctggtgtccccttagattttataccctaagcgagtgccttacttgtttcaccctaatcccagccctggtggcctgagatgaggctgcagaaagtctggtgatgtccatttccagatgcagcgcccagatggcactgggcctttcagcttgcatttatttatttagagacagtgtctcactctgtcacccatgctggaatgtagtggcaccatcacagctcaccgcagccttcaaatcccaggctcaagccatcctccggcctcagcctccccagtagctgggactacaagcatgcaccaccatccccggctaattcttttatttttagtagagacagggtcttgctatgtggcccaggctggtctcaaactcttggcttcaagcaatcctcctgccttgacctcccaaagcgctgaggttataggcgtgagccactgtgcctggctgaagtttgcatttcatcctaagtacagtgctgaactacgaaagagttttaacctcagaatcgtctttgtaaaagatcacactttggaagaaatgtccactgggcatgacacgggctgaaggcaaacaggtcaggatgtgaagaactcccattaaatcccattagcagtgcagccaacaggaagaagggggtcccagcctctcacagcacctggtaacctactcacaggtctttccagcctgtgctaagacatctgagttggcgaggcccttgaggacctccctgtagccagtcccctttttcccagtgatgggaagagacacagacctacaagatttgtccccatggctgtgcacctgccgagtgctagagccaatttcaggcaagcttgacctccgtgctctggggcacccctgagtgagccacatgtccatgtccttggcctgtctctgtgacacagcaccaaggacacagccagtgggggctggtgggccatgagtggagcccacatccccaagcccaaggaccctgtttgctgtcatccacgttctacatggagaccagtcctctgtcctggccccgtctcccgcctgacgcaacagccgtgctctggggcccctcaaagactgagggcaattggacaggaacaatcccccctgcccggcccctgcccagaatctggaagcaggacacagcccatctttgttaagtgtgtgggggctaacatgggtcaggagttaaatgttactttgccatactgaggagggtttgatccaacagagaagagtataaaatgaaacaaagcactccactatgtgcaccctctccctttgcccctgagattctggacagagaccaggttctcaggccgcttcaggctcagggccaggcaagctgctcgctgcgaaactggtgaccagctcaggggtggttggccaccagtgagatctgcagccggcaagccaagggccccgttgcggtctgggtggaagaggggataagctacaccccacatgtagctcgtcccttgccagggtgtggagggatggattctttaggacccagcttttctcaggaagcaggtactgttgggtcaggctgggatggggatagtctatttcagagagcaagttggcaaagactcattttcaaaactgaggagataacgcctgtcagatcagaacaaggcagttggcaattccagcttgtctttctacaaacatgctgagactctgtggtctgcttccttatctagggggaggtgagagtggaacttccttaactcctgcacttctaatgacttttgtcctttgggccagctgatcattccgtagtttggtgtcccctatctgaggccttataggatgacttttactttttgtaccccgcttatttccaaagagtatttgaagtggcttgagataaaagactcatatataacggaaggctaaaataaagataaaagcataaatgccagatgaggaaggagagaatgggggcaccaaaaacacagactaaagatagttgctgtttcaaatgctgctttgtacctcttggcttctgaggggaagagaggagcacaatgtgtttctttttcttttttttttttgagagatgggggggggtctcactatgttgcccaggctggtctcgaactcctgggctcaagcaattctcctgcctcagcctcccaggtggctgggattacaggtgcatgccaccacacccagcacaacgtattaaagagctcacatccccagtgaaaggaagcataccaactcatcaaaaaagatgctacaggccggatgcggtggctcacacctgtaatcccagcactttgggaggccaaggcaggtagatcacaaggtcagaagtttgataccggcctgaccaacatagcaaaaccccatctctactaaaaatacaaaaattagtcaggcatggtggcgagtgcctgtaatcccagctactcgggaggctgaggcaggagaattgcttgaacccggaggtggaggttgcagtgacccaagatcacaccattgcttccagcttgggtgacaagagcaggactctgtctcaaaaaaaaaaaaaaatactgctactttactgtccccaaacaaaaacagatttgttagatgagtccttagctaaggaacatcaaaaaatacaatccgctgagccaaaagacaagaaaggtgtgtgcctgtcttcataatgagtagtacaccatggctttgtggttcggacctgatccagagacagggctcaggaagtcagcagaatggagagtcaccatggccctcagcataggcacacctgccttgtcaccctgtagcctcagagcactgagcagagaggaatcctggtccctctgtctcaactgctgtccaacaggacagatgcccagggctgctgacacttacctttaagtggccaatgacgaatttgtggacaaggtggttccacttgggttttctgtagacagacaggtggccataatcatgttgcagccatccagcttgggcctggggagagagggtcacacgtgctgtcacagcctcagcaaacaggcaccaggcctctgtcagctaggggaagtgagggtgtcacgcctcacctgagaggtagcaaggacaaaggccgtgatgagggtaggaatccagccattgccaaagtaaaagacagtgaaccatgcaatgctctccagggcgatgatgtgggccaggaggaggaggaagaacacgtggttggtcttgaacaggttcatgtcctcagccgtcttcctcagggcccggaagtcctcagtgatctttgactgttgaccaagagcacagggaaaggagtcagccaccagccactctggagggaacatatgtctcgagctgccatttcaacagccaatgcacaacccagagaagctgtggcaagagggggccaagccacaagcctcgaccctccaggagtccctacaatagctgctgttaccacatgccccacacagccctggggcctgtatatttgtcacagctaggtaagagtgacagagaaaggctttgactcaaaagcttgcattttatacaccctgtgttcatagctctattcacatcaggaaaaaggtagaaacaacacaaagatctcgtgatggatgaatggatcagcaacacgtggtctatccatgcaatggaatattactcagccttgaaaagggaggaaattctgacacatgctacaatgtgagtgaactttgaagacatcatgctaagggaaacaggccagtcaccaaaggacaaatattgtatgattccatatacaggaggtccttggagaggccaaattcagagacagaaagtagaatggtgcctgccaggggctgagaggtgggagaatgaggagtgagtgcttaatggatgtggaatttcaatttggggaagatgagaactggatggtggtgatggttacataacaatgtaaatgtgcttatttgatgccactgaactgtacacgtcaaatgaccaaaatggttgaccacacttttttaaaaaagaaaactttaatcccagcactttgggtggccgaggcaggcagatcacctgaggtcaggagttcgagaccagcctggccaacatagtgaaactccatctctactaaaaatacaaaaattagccaggcatgatgatgggcacctgtaatcccagctacatgggaggctgaggcaggagaactgcttgaacctggaggcggaggttgcagtgagccgagatggtgtcactgcactccagcctgggtaacaagagcaaaactccatctcaaaaaaaaaaagaaagaaagaaaagaaaagaaaaataaaacttgcattttccaccaccaaacagagcaccacttgctctgcgcacactgttgggtcttgaggggttgagttgggggcgacacaaactagcgcaggagggcgagctgaggcaggcaggagggggctgtgagtcccgggcacatggagccagggaggcaaagcggagtcaaggagggccctgggaacacaatggcattgcgaggaagaaggaacttgggacaagaggcaggggcagggccggacggggaggagagtggatacaaggagaggagcggtacccacagggcatgaccaaggtgctatgaagggtggttctggtggtgcctggtgggagcttggatgctaaatggtgcaggatctgcagcagaaagggagagcagtggagagagccaaggagcaaggccatggacaagggagctacagggcaggacgagcagagctggggaagccgcaggccaggaggtgctggaggtgagagtgggagatggacccacttgcgaaggaggcaggaggggacaagcatgggctggcatgggtacagggcaggtgatctcatgtgccatggagggcaaggtgagaggaggggcattggcctttgaaggacctgcagggtggcccgcagctcatcaggaaagccagaggcaatgggggtggtgggggactggccaagagtccaggccgggagagaccctggtcctgccctggctctgctaaacagaggggtctggcccaggctggcaacaagaggaggaagagcttgctgaggccagggtgggacttccatgaccaccctggtcacagcctgtgggtaccactcctctccttgtaacaactctcctccccgtcctgccctgcccctgcctcctgtcccaactttcttctataaacggctccgccatttacatggagacttcattgttgaacaaaacaacagcccatgagacctcaggggttgctattttcacacatggctgtcctggaagcccagcacccaggggggcgtctgacctgcagacaatgaacagatgaccagggaatggtcattctttctcaaagaggtgccccggaccacacaccccaaagccactcttgtcatcaaatgacatttttcggtgtttctgtcctgtctttcccctagattgtcatctggcaccttcctggaaagggatggaggagaaggaaaatgaaactggccaggagagaggagacgccactagttgttgtcaaaccccggctcccagggaggctctgaggccctccctgaacacaggtgaaccacagtggctcctccaggacaaaagcacccctgcctcagccccagttactggtcatggggcaaggggagcctctctcagactcccagccacccccagcctcgtctccacccccacccaggttgcaagccagacttacgttcttgccgtggtcctggctgggctcctccggggccagttcaccaatcagcaggggtttcaagaacttgcccacgaattccaggtcagggtggaaggcgcggaaggcatcctggagagcagagggcagtgatgaggctaagacctgaactctgtctgctcttgggccccaaggaggacagtgctcaccagcaacagctccatgtgtgcacccagacaccaaacggggtctcctgtgatctggccccaaatgccgtctccagcatttttccaggacagagccctcagtgcccaacgccaatggcaacagccacctgggcttctgtgctggtgcaggcatgctacactccccaggggtttgtgaatagatgcataggctgcctttgggcaggtcgggaaatggtgaccctccaggaaggcgcaccaggcagacacggggctcagggaggacttgagcctcgactgctcgtgagctgagtgccttgcatggtgcacaaaccacaccacccaccatctcttactagttcctcacctacatgtccagggtggtcaatgaaaaggacaagaccgaatactaccttggcactggaaatgtgctgtgatgaagtaaataaaaaaataaacacagaattatgtaaaaagcgttcctgaaaaaaagcctaggaggatctaggctattattgcacatgttaaggtagctggattatgccttgctttattttcattactttccaaactctaacactgctataatgatacacattttaatctttttttcccaattataaagtaaaaacgtgctgagttttggccaagttagaaaaggcacagcagaataaagaggaaaataaatatcacccagaaagtggtcattattgctaatattttagcatttttccttccagcttttttctatacatattatgcatattacatgaattatctcataaaaaatctagtatttctattagagatgagccagcaccaggctcccctgaggggatgcaatagaatgtcccagtggtgaacactgtgtaatctgcatcaaatcaagcttccagacattggtaggattggcaaaccagtcaaactccaccatgagaaacaatcagaaaaatcaatatagctggggaaaaacatacaagtttgtggaaaaaacaaaagtacggaagcatggtctagattaaaagagactaaaatgatataaaaactgcaactcttgactggtcgcaggggctcatgcctgtaatcccagcactttgggaggcagaggcaggaggatcacttgaggccaggagttcaagaccagcctgagtaacatagcaagacccctgtctctactaagaataaacaaaattagccaggcatggtggcctgcaccaataactccagttactcgggaggctgaggcaggaagatacaataagcaatgatggtgccactgcactccagcctgggcaagagagtgagaccctgtctcaaaaaacaaacaggccgggcacagtggctcatgcctgtaatcccagcactttgggaagccgaggcagggcgatcacctgaagttaggagtttgagatcggcctgggcaacatggtgaaatcccacctctactgaaaatacaaaaattagccaggtgtagcggcgcacgcctgtaatcccagctgctcaggaggctgaggcatgagaatcctttgaaaccaggaggtggaggttgcagtgagccaagattgcaccactgcactccagcctgggcgacagagtgagactttgactcaaaaaacaaacaaacaaacaaacaaaacaacatcctgcaattctttaatgtgacaggctctcacttgaaggaaaaaagaagttataccaggtttttcgggagttgaatgagaaaaaatgaatatggaccagatatttgatcatatcaaggaattactattaattttcttaaatgtgacaaaggtactgtgatgatgttagagcatctcttccttttttctccggaaatgttgaagaccttagggatgtgatcacacaatgacgcagcttattttcaaaaggcaactgcacacatataaagaggaaaaacgcaaatgtggcaaaatgttaagactagtgaatcttggttgaggatacacaggtgtttgcttgttccttcaacatttaaggatgttgggaaaatttcaaaattaaaaagaagagggggccgggtgcggtaatcccagcactttgggaggccgaggcggcggattgcctgaggccagaagtttgagatcagactggccaacatggtgaaaccccgtctctactaaaaatacaaaaaaaaaaaaaaaaattagccaggtgtggtggcacacgcccgtaatcccagctacttgggaggttgaggcagggaattgctttagccagggaggtggaaggttgcagtgagctgagatcgtgccactgcattccagcctggcgacagagcgagactccatctcaaaaaaaaaaaaaaagggtcgggggaaggtggagaaagtgctaaccactcctggaaatcttttcagccccacacgtaaggatctcccaagggtaactgccagtctcccatcatctccttactgcattgctggcatcaagtcctttgcttggtctttgttctatttgtgtctagaacagactgacaaagcaacacttcgtgcaggagaaaactgggcccacggtttcttaaaaaatgcctgtgacccactagccgagccgaaaagggatggtagcagaggatcaggtcaagagtattttcagggaaaagagacgtgctattccagggccctggggaggcagggagaagtccctggggaggcagggagaagtccctggggaggcagggaggaggccctgggggcaggcagggaggagggctggggtgggggggcaggcagggaggaggcccagggtgcgggcagggaggagcccagggttgcagtggtgaccagctttgctggctctgggtggggtgatcagtccccaccagagcctcagccgcctatgcaaaatgagcaaggccctgggagaggcccggaggagctgccaaagtcagggcccagggctgggcctgaaaaagccccttcattggtcctcctcacatcacaccacggcctttgagaaatgaacaggaagtccctggtaaggcagtttcctgagaagcagctgcagtggctgataactaatggattcctcttgtctcattgaaaggcaagactcaatggcttgcaaatagactcatctccactcctgctgcctccccaacacccgaaccctgcagtcgaggttccaactccaagggagcagacagatgacgagccctgccttgaccttggttgctgctcagccatttccagagggctctcgggcagcctcacctccctgagcccaggggtaatgggcatgcgccaggcagggagccaggagtgttgctcatgttactcccttaggcctcaagccccaacttctgaggtgaagatgcaggagctcaggaagcaaagtcctgggctccaggtggcagagccaggatcaaatccaggtccatctgcctctaaggactcttttctcacgtgccacacgcttcctgccgttttagaaaaccgagcagtctgttggatcagctccttgcccatggtcagtgtggcagctttccgagcaggcctggtgcggaccgcccttgaacataccacgctcctttccacaccagggctgcctccattcgggactcagcctcaacatcacctccaagaggcttttcccaacatcacatccaaaagagctctcccagccctgggccttccctgggtcattgccctgttagatcttcatagcagtcatcaaggttcgtcatcagactgcgtgacgtacccacttgtttatggcctgcgtcccccgctggagcataaaccccagttgggaaggcctgcacctgtcttgttcgctgcaataaacacagtgcctgtaacggggcctaataagatggctcacgagggaataaatggacccaggaccccacagctgcacacactctgatctcatactttcccactgtgcagtcatgaccagacacttgtcctcttccgcgtttcacacaacttggcttctgcctctggaacaccaaaagccttctccggcatccccacgctggtggttgctacagctgccacctgctgaggtgacgcaggcgagccacggggccatgggagtggcttgcatacatcagccaggcatctttaccaaacttcgtgaggcaggtccttttttagagataagaaatcaggcgtaggttggcagagccacctgcccactatcacactcgggaatgagctgagtagagtttgagtcacatgtggctaccttgagcattgcccgctgttcatacaaaggcttccctcaacatgagtgtcctcctccctgagagttgattatattttgtgtctctcccttcacattgccataaatgtgtctcaaacgctggcagaaggtttccagcacctgccgggttacagaaatatctggcaggtataaggcagaccaggattcaaggcaagggagggccaacccaaactttgtctttggaccaagaattggaaccaggctctatcctagtgtaacgggagagaagccagagactttccaggaagaggacccgggacatggggaagagaaaggattggtaaacaggtggagaaagcagagatgcacccgcctcggcagggcaggtgtgtgaggtggggaggtcagaacaccctgattctgaagcgcttgtcacacttcgctctttgccagttcctgcttctgccatcacccaggtctgatgccagtcaacttctccacagggacattttccctgcccctgccccactctgggtacaactcacagttgctcgccatccactgagcacctggtgccaggatttgtttatggccgtgcccatgtcctctggggagcaaggctaatctctgatcgaatgctgcacaactgggcactttgcctaggatttgggaagtgcagcacgggcaagcacagggcacacagtgcagtaggtggcagccctgcggaccagaactttatggaacaagtgatctaagagtgtggagatgcacaggagggatcctcgcattctccagtggaaatgaagagcaagacagggatgctgacttcctttctgcagcagagagaggcaggcagggcaggaagcccctatgccatgtcccctccaaggaaagaagcaatggaggctggtggggcagtgctctgtggccaaagagccccgcagtgagagcctcccccataacacagggtccatgcactaccctgagggcagaaaggcagggctgcacaggagacaggcccctacaaaggcaacctgggcatgaagaaattgatgccattctccactttcatctcagaactgcttcctggggatgctgaggctacagccacagaaattggacagctcccacccagatctcagctggggagatggagctgccctccaggcctgggaattcataaagctggggctggaacccaggtctcctgcctctaaatactacaaccctcctgccccgtgcaaaggaggccagagttccactttcgatctgttgcgttttcacaagaataacataggagcaggttgaaaggtggaacaaacctctggtctcttctcaccttcccttgattctaagaggtcaccaatgcagaccgggcaggaacagttgctgagacaagggctaggggtagggggctgatgtctagaggcagagggtccagatccaagccccagcttgagagagagcagggggagcacatcccacagcttcaggtctctgtctgtgaataattcatctctgtgtctgggcccagctcagagccatggagacactcaattaatgtttgatgaattgtcgctgaagatgaacagttctgcagtggtgggactgctgtgaaaagagcagacacgctcttagggcgcgggtgagggttccttttgcccacagcaaggaaaaggcgagagaagcaccgcagtaccaaagggaagagatcagaggtagcaacaggaagggaaggaagctgggaggggaggacttgaggtcagattctgagtttaagtctgagcactgccacttaagccaggtttgatacctcagagcagtgagagatgcctacggggctgatccgagtatgaaatgaagtgatacatatgaatgtgttttgtaagttgcaaaaatcaagcaacttgcattattataggcaaggtcagggtttagcttctgtggaaggaccacgtaacagttgccccatccttctagggagatggatcttgactacctggatcttttgctcttcaaaaaaaagaaaatgccctattgaggcccctgattgtcccgagaatggcttccctgacttcgaggattgtcccaagaatggctaccttgacttccgacctgtttccagccttgtgttaggaatgactgcactgtgatgggctcagaacattgcctgggaatgttgcagggaatccaaactgtcttctgatcagtccctccccagactgtgcctggtccataaattgtcactccccatgctctgggggacaaaccatcaccccaaggggcaaagccacttgctcaacagcctaggcaagggtctctggatttcagtagcctgttcctgcttctctctttaggtcccctttccacatgccccacccaccccacgctgctcaaggcctttttccaacctggtcctggacagtttaaaaaaacaaaacaaaacaaagagaacccagctgctcactccatcatcaccatcattcaaatctgtatccccagttcgtgtatttcatgccccaaaagtcttattttagaagacaggaagctctggggacagggattgcttttacgtgttgctacaccaaataaagctagcatagatttaaattttttcttcaaattcctctttgcatactttccattctagctgtttcataatacttgttcttattcccgtttgcctgataacaccccattgcattcatctagtggttacagttgctgggtgctttgccacaaatcagtctcattgaaacaggtacaggtgtaccttatagatgaggagatggggctcagtcaagtgacaacacttagtggatgagcccagtaatgacatctttcttcaattctagatctgtttgcagccccggttggctcccaccctagcttatgaaagtaacaaagcaaccaacatccaagataccagatttatagtccatgaaagttatacagaaagcgctggagcaggaccagaaatgacgagactattacatttttatgagacagagaaaaggtcagggaagagtaggtcattctagtcctctgttaggagagatgtgagcactgatttttggagggaactcagtgttaaggtcaggtaagcactgagaacatccagaacaaggaagaaataaatcaatctgatatggtaattaaaccagaaaggtcaaggcaattgccagactaagcgttcacataagaaaatatgtttaacaatgtggaataatcagaccaaattcatcgtatttgacttttccttctggaaactttttggtgagggcctggacaggacaggaaccttctacaatttacctatgaaatcagaaacagaccagcccaagtccagcaacatatagtggaaagatcccagccaggatccagaaggtcctttacttaggagttacattaacccaacctcctcactgggccgcgtaaaggtccaggtgagatagcactgaaggtatgtgaaacatacccacctaagttctaaatagcatcacaaacccactgggcttaagcaatgtccacaagcaagtaaaacaggatgggactgaaagctgtagggaatttcagtatcgctgaccttcccaatcttagataagccctggccctgctggcccacaccacctgtccattgtccagcttgggttatggtggcctggtctggccttcccctaggcctgtctccatgagatgcaagaggtggggaagttaagggtcgggcctacacagcttagagagcaaaagcccaccaacagttgggcatcctagacctccaggtggaatgatctacgtcaagttcatccctcctttctgcctctctcctattcactttccccaatttctgtatcccatcagaccttttttctctgcatccaattcactaccaccaccaaaagccgccctttcttccctccttgcctctgttcttttccttctggcccattcgaatccatgggataccagctgcatccttaaataaatgccaggatttcagactggggtccccggtgcgggtagctggtgcggggtaatcactgagccacgcatttggtgggggtaaggtgggcagcaatggctccagagaggcccacaacctttaggagtgcaagatgagggaagggtgttcttggcaggatttaaaaagagagagccattgagttgaacgcccgagagtaacctcgagtgcagacggacctgttgccaagccagtctagtgctgctaaatccaccggctcaaggcctcactcgacctgggctttgcaaaccccaggccgttctccttccaccaatcccggacgccggtccccaagaaggccggctcgagcttggggtgagtctagataatccctggagcgtgggaacccgagctgctgggcggtttttcccaggtggccattgaggaacttcttagacaagagtcccagcaggagcgatctccggccggggacgagctttccttctcgccacccagtctggatggagagtgcgggacaagcgcggagtcccacacctggctgcctgcgctcccgctcctttcagcggcgcgcaggggcggccatcttccccgctgggggcgccaaagccgtctggcccgagcgcccctcttggggagtccctgcctccagacaaaccccgaggaaggggaggacgcgtgggtcccggcgcgcgcggtagatgcttgccctgttctccaccgctgggactttcaccgcagcgccgcctccccgggtcccagatccggtctccaccccagtcggcccagaggaggaggaggattggggagggggtacgagtgcaatagatgcactttccttccctacaggacgtcccaagctccattcagcgccggaggtctgtttggcccacggggagccagggatcctgactccgcctgcagcagagaagggtggctggggcgcccccagacccttaccgttgcatcttctccagcgtagtgcccgatgacccgctggccccccgggtgctggatggaccatttggtgatgttgtaaaccttgcggtcaatgaccagccacctgtcggtgcgcaggttatgcttctgaatctcctcccagctgaaggtgggcaccgacacctcgcgctcggcggccccctcgccctggttccctcccttccccatgctgcctgccgactgtgacgccccgtgcactgcggcctccccgcgccggctgctcgctgcacagacggctgcctcccagccggtgtgtgcagcccgggccctcttcgctttcggcttttgtcttctcctactcctcccaccgcgccccctcccccagccttctcgcctgcgctcgggagtgtccctgccttcctggcggaggatccctggcttcccagtgcccccaagcggtccccttcctccgcccctccctcagccctcccgctatggacttttgcctccagtaaaaactccccgggagctcagggcctcgacacctcctctgcccgcccctccggctccccccgcctcgggttccacatcctcccgcgttccccgccgcccgagtttccacagcgatcagcagagcgcctgcaccaatccggtcgcgtcgccccgcctgccattggcccaggaggatctttcgaaggccagcgggctggagcggcgggtccccggctcccccgccctcccgcgtggagtcgagccctgctgcgaggcaggctacgtgtccgacctcctccctcccccactctccggccccgggcgccggaggagatcctagaggagatcccggtgggggcaacgaatgggctccgcgcgctccggggcgcgtgcgcgcacgcccggcgctctgggggtttgcacctgatgccgacacaaagccggcgcggccaccagggtgccagcaagcggccgggcgggtggaccggcgggctgcggggcactcaactccagggccggcttggctaggtgacgcccttccttggcgcgcggcagtcgagactccagtatcccacattgtccgcgccatccacattctggcgcctttctgcaacctccctagagacacaagccggccttggattagagggctttgaaccctctagtcagacaatcttagaaaagaattgcggaacctctgctctgctttcttggtctgggcgccatggctgcggtgagggggaagggaggggaaggcagaggaagggggcgatgaggaactggcgcggtccttgccctggtctcagtaagctcagtctctttgggaatcgtggaagcagacacatcattgggcagtgatgttgtgcagactccagcaaataaagactgccgtatcgaagggataggaggagggttaggtcttttaggcgtggggcaagagacaggcccctcagaccccagctggatggggcggcttagtgccgggcgtcctgggggaaatgggcctgactgcatccggagggctaacgggacacgtgggaagtaaggatgaacagagagggtggggtgcacgaggcttgggaatcactagaggagttatagggccctcagatttcaatgggatttacaggtgcctgtgtgctagcacaccctaatcattagattctcatcacaggctgagaggtaaacaggacgcatattattacatctcacttgaaaatggagagcctgagattgagagagatggtcaaacgggccctgcccaatctaaatttcacagcaatgcaggggtggtggggggatcactctgcccaactggtggggttgtacttgggggggcagatgggctccctttcctcacattcacacagtccccaacctctcccatcacatttcatgctggtgtcagccctgagcatccttcattcactccacagactgcagacataaagacagtaaggcctctctgtctttgagtgtgagcagacatcccaaacaaaagccttctgtacaaaataagaggatgaagcaagacctccagagagtatggtggccttgaggactgtcaaacgttgacggaaatggaaccaagaaaattattttctcagaaatggattaacataccatatagataactttaatgaacatttgtaaagggtgtggagctcggagcagggagtgatagctgaaaggcagaaccagggagtatctcacagaggctttgaaggttcaggccctaaaagggagcacgtatgggtggcctgtgtagggtggctgagaagcgtggaccggccagggcctggggtccccagcggctcccagcacagtaccagccagggtaggtcctgaaaaaacataaaaacatgtgttgaagacacaaatgaatgaatgaagttcaaagaatggctccaatgaggccggcggtagatggggctcaaattgagaaaagccccagcagcctcagtaaggggtaggaagggaggactttaccatggaggaggcttggacatccgtaaagcaggtgtactgtgatcagatccatggtgtagaaagataactccagaggctggggctggactgggatgtacgggagaaactggggaacagtgatgagttcaaagatgagggcagtgctcgaggagaggggaggggaggcctgaattaagagagaactttagggggctgaccccacactggacactgccatgtgcctccctgccctctaatttttttttgagatgcagtctcactctgttgcccaggctagagtgcagtggtgcgatctctactcactgcaagctccacctcccaggttcacgccattctcctgcctcagcctcccgagtagctgggactacaggcgcctgccaccacacccggctaatttttttgtatttttagtagagacggggtttcaccgtgttagccaggatggtctcgatctcctgacctcgtgatccacctgcctcggcctcccaaagggctttttctttcttttttttttttttttgagacagggtctcactctgtcgcccaggctggagtgcagtggtgcgatctcagctcactgcaacctccacctcatgggttcaaatggttctactgcctcagcctcctgagtagctgggattacaagcacccgccaccatgcccggctaatttttatatttttagtagagacagggtttcaccatgttggccaggctggtctcaaactcctgacctcaggtgatctgcccacctcagcctcccagagtgctgggattacaggcgtgagccaccctgcccagcctagaatatcctttggaggtagaatcaagaccgcattagttggaggtacaggggcaggggtgatggtagagatgaaggaataagagaaataagtctgattctagcatttgagttgagcaaatgaatagataatgggaccatttaccaagatgagggaacagagttagtacaggggtgaaaaattaaaaattctattttaacgttatgtttgaaacacctaggctgggagcagtggcttatgcctataatcccagcactttaggaggccgtggtgggtggcaccatgcccagataatttttgtatttttagtagagatggggtttcaccatgttggccatgatggtctcgatcttctgacctcgtgatctgcccacctcagcctcccaaagtgctgggattacaggcgtgagccactgcacccggccaacacctgattctctcttactgcagaagggtctcctccatgtgacaaaaaaatatggctgtatttgctaagctacgctagcagaaataattctcccccattccctgctcccaaggattaattccagtttaatgggctctgcatcagatgctaaccattgggccactgttatcagacggctgagttactctattaggtgtaggtcataagccaagcagcagacctgggctttggggaacagggtctgttcctttttgtgggaagtcacaaaccaaaagcaattacagaccgctacagtattcctttcccatacctaccatgtgatgttagacctctgtctctgaccttcagtttcctcatgataaaaaggagacagtgatttttctttctttctttctttctttctttcctttctttctttctctctctctctctctctctctctctctctccctccctccctccctccctccctccctctctctctctctctctctctctctctctctctctctctttttttttcccccaagatggagtctcactctatcccccaggctggagtgcagtggtgcaatcttggctcactgcaacctctgcctcccgggttcaagcgattctcctgcctcagcctcccgagtagctgggattacatggcatgtgccaccacacccagctaattttgtatttttagtagagacagggtttctccatgttggtgaggttggtctcgaactcccgacctcaggtgatctgcccacctcggcctcccaaagtgctgggattacaggcataagccaccgcacccagcggagatagtgatttctaacctatctcatctattttaataacgaggctcaaaggacacaaggtatgtgaaagtgccatacatgtattttcttaactagcaatattggtgaggtcaaactttaaccaagctcactagataatgatttattaatatgtggtgaaagtcataactatttttaaaaaatgaataattttcaacaacaaaaatggcatcaacttagtaagtgcatcaaatttagatgccttaaatgacaggctggggaccctatctaagaaactgggttaggccaggcgtggtggctcacacctgtaatcccaacactttgggaggccaaggtgggaggatcacttgagcccaggagtttgagaccagcctgggcaacacagtgagaccctgtctgtacaaaaatataaaaaattagttggatgtggtggtgcatgcctatagtcccagctactcgggaggctgaggtgggaggaatgcttgaaccgcagaggtggagacttcagtgatccatgatcgtgccactgcactccagctggagtgcaagacagagcaagaccctgtctcaaaactcaaataaaataagctgggttattatctctaggtggacattgataaaaggtatggtatgttaggtaaaactttaaagcacagattgctagtgctggaaagcatctggacaatctcttcactttacagataagggatccgaaacccatagaggtggacataatgtccaagattacacagcagtaggtggactagcaggtccaggttgcaggtgtctcaactacaatccttattctttccattctaccacattgcctcccttccttggtacattctactgaaacttgatggatccttctccaactctgaagtgcacagagaatagaatttgagatcttcacatcccagagtctagtgcttcgttgctgcatctttagtgctcatagtattggtggagaggtacttggtcaaggagctgtaggacaccattcctttcctgttctggtgataagaagtgcagtaaaactaaggaatgcatactaagtgctcgaggaatacctgtgaaataattcagcagtaaattggtaatttggcaacaaatgacaagagactaaaaatgttattacctgatccactaattacacatgtagaatttatcctaagaaaatgttcagaaatagaaaccaatatctatatacaaaaatatccatcgcaacatttatacaagcgaaacttctacacaaatgtccaacaatagggaaaaagttaagtatattgggagtatatatatgtgtgtttatagatatatgatgacttactatagtgaagtaaatattctcattataaaattttaagcttagcttttttgttttattttaaagagagatcatttgtactggaaagttacattaaaggcccagcaaaatgcttacaacaacgcctagaggactccagacccattccccgggcaatctgaagatctgggacctacctacccaggcctcccttctcccacttaatagaggcaggtctgagggcctgggaggaagaaggcaccgcagagaagcaaggacaacagccttctcctctttgaaccagggtggccttataccaaaacatttattgaactcactgctaaggaactcatgtagagaggaactaaaagttataaataagttctggggtaaattctagccccaaatatactaaatttcatgtgtggcttcagctctttggatctgtcaccttgtctataaaacagtgggtttaatatatctgtccctaaggcatctatattctatacaatgataagaagactgggccgggcgcggtggctcacgcctgtaatcccagcactttgggagtctgaggcgggtggatcaccaagtcaggagatggagaccatcctggctaacatggtgaaactttgtctctactgaaaatacaaaaaattagccaggcgtggtggcagacgcctgtagtcccagctactcaggaggctgaggcaggagaatggcgtgagccctggaggcggaggttgcagtgagccaagacagcaccactgcactccagcctgggtgacagagcgagactctgtctcaaaaaaaaaaaaaagactgcattaaggaaatcccgtgaattcctccatgagcctgcctctgccccatcccaatctcccacactcttagaatgcagcaaaatgagagtcctgtttctagctctcgctctgcctctaatagaggtatgattgggattctccctttagtttaagcactatatgtcataaattatttttaatattacttaacattaatctgcagaattattacagatgacttttcttaaaacaaagactgattctgtcaactttattagtgcctactgtgttgtagtcactgcacccccataagttatccaatttcacagaaatccagatttttcaaaaatggttttggtctttaatggcctgaagggctgctactgaggggaggctgcagcagaggctgagcacaaccggtattgcttctcctatatgtgttgactttgtaaaggatccaggctattggccaactattatgtttaggatcttttgttaaaatggatcaaaatttgaactcacaattcaggttattccaacagccactggcagttaggttattcaattatggcttcattacaatcggcattaaggtctttttttttcttttctttagagagaaaatggtgggacagttaggaaggggtctcactatgttgtctaggctggtctccaactcctgagctcaagtaatcctcccacctcagcctcccaaagcactgggattataggcacgagtcactgtgcctggcctggcattagggtcttaagctcatttcgttctgttccttgaggattaatttggccagaacagttagtattcacaagtggcaacctaaaattaagtatgtgattcatatccaggatgaggcaagttcccttaggatcaacagggcctgcaaggcaaaggtttcctttagttgacctggatatgggtttattgcagtctgtgtgaccacctgtgtaggtgggtaaggagatgagagggcaacacgacatttgcctagtggcctataggcttactcacctgtattttttcaggttgaaatcatcagttgattcagcaaattttttatttatttatttatttagagacagagtctggctctgtcacccaggctggagtgcagtggtgcaatctcggctcactgcaacctttgcctcctgggttcaagcgattctcctgcctcacccccacaaagtagctgggattacaggcaccccccaccacacccggctaatttttgtattttagtagagacagggtttcaccgtgttggccaagtgggtctggagctcctgacctcaggtgatccgccctcctcaccctcccaaagtgcagggattacaggcatgagctgccacgcccggccaattcagcaaatttatgtgggattccacctagaactccaaaccaaggtgctctgaatatgtattggtagtataaacagaatccacagccctatcctggattataagctcgttagggaggtagcaaaatacatgacactgacctaagaacacatgaaaagcaaagaaacatgaatgcaaagtcatgtcatataagctgtttaaatcctgagtaagatgaatttaatttgcatctatcctactgacctataatccgtgactcacttgtctctctcctccagtagacatgactaggcatgacccatatagtactgaactttgtattcccagcaccttaccaaagtaggtgctgggaatacaaagaggagacaccccacaaatgttaaataaaacacttaatgaatggttctaggtaggtggggttgatcaaggaattatcttacaagtggtatgggttttttggttttttctgaggtgcagtctcaccatgttgcccaggtgattctcctgactcagcctcccaagtagctgggattacaggcactaatttttgtattttagtagagacagagtttcaccatgttggccaggtgggtctcgagctcctggcctcaggtggtccacctgcctctgcctcccaaagtgctgggattacaggtgtgagccaccgcgcccaacctagtctttttatagaacagttatctctgtagccaaacttacatcatattatttaattttccttgattcgggggaggggggagggatagcattaggagatatacctaatgctaaatgacgagttaatgggtgcagcacaccaacatggcacatgtatacatatgtaacaaacctccatgttgtgcatatgtaccttaaaacttaaagtataataaaataaaagatttacataaaacatttttccttgattctgtattaaaggaaagatgacattattttcaatgtctgcaaaatatttcactgatgggcatttagagtgtttccatttcccgctatcatagatactgctttaatgaatattttttgtttataaatagttttctttttttgtgtgtggatatagaatcttgctttgttgcccaggctggagtgcagtggcacaatctcggctcactgcaacctctgcctcccggattcaagcaattctcctgcctcagcctcccgagtagctgggactacaggcgcacgccgccacgcccagccgatttcttttgttcaggctggtcttgaactcctgagctcaggcaatccgcctgcctcgacctcccaaagtgctaggattataggcgtgaggcaccccgcctgacctataaatatttttctaagaacatttccttaggctatattcctaaacatggaattattgggaacatttttatttttctattttttttcatctcttcagtattcaaaacattcctaaattctggccgggtgcggtggctcacgcctgtaatcccagcactttgggaggccgaggcgggcagatcacgaggtcaggagatcaaagccatcctggctaacatggtgaaaccccaactctactaaaaatacaaaaacaaaattagctgggcgtggtggcgggcacctgtagtcccagctacttgggaggctaaggcaggagaatgccatgaacctgggaggtggagcttgcagcaagctgagatcaggccactgcactccagcctgggcgacagagcgagactccatctcaaaaaaaaaaaaaatcttaaatttctatataagttgtcaaactattttttccagtttaatcaacttacacttctaccagcagtatgagagcttttatcccactgcacagtcacataggaaaaatggtttatgtaaaggacctctcttctgttatttaatacccatgaatttcttatatagttgtaatcagcgaacccatactactttgggttctgcttatttcacggggaaggattctatatctatcaatatagttcacattctagccatttaaaatcattctttaattcttcattgtgttaacagatcccaataagcttggcgattttcttattgtcaggactcgggtttatttccagtttttgctattaaattggctatttctgcatctttgcacagtctcccctactttaccaagagtgaaactgcttgatcaaagaatagaaaatgttttgtagctcgcattagacactgccaagttgttgggcaaggtttttaaaaaaggaatattggctgtacagaggtgcagctgtgtggaccatcattcctgagcagggtccaatagcctggcatcttacctggaagtcaggacatctaaacttccctatgggaacttggtaagccccttccccatttcgaacctcaattttcttatctataaaatgaagaatttggatggaatgaattaatccttttctaccagaaatctagccatatttcacctagtctattctgtatcaccctctcctgactcctacgtgctcagaatctagctcagtgcttgggacagttatgtttcctttccctttgaagtgcccaaataccagtgtaatgagaaatatggcagagcctgagagttcagagcacaggccagggtcaaatctcagccctccacttacaagctgtgtgacaaaataacctcccccgggctcagtttcttcactgtaaattaggttaattgttccaacctcatagggttgttaggagaattaaatgagttaaggtttgcaaaacgctaagaacagtgcctggcacacagtaagtgctttataaagtgtttgttgaataaataaaattttggacctaaactctgggtctcttcaggactgcaacagctttgtaactggcaaccccacttttaggtgcgttcccactcctctaaaacccagagatctaaatgccaaatctctctgcttaaaaagtctcccagggctcctaggcgcctccaggctagaacagaaatgcctcagcttgaagacccaggcttttcaggtgaaacacctaagggtcaggagacgctaggatcatcactcaaggatcccagtgaatttttccaaaatacaataaaaataaaaacaaaaagaggcaaacagggttataaaaattgtggggcattttaaatgtttcattgaacaaattaaagcattaacagccctcccccaaccaccaccaagcccaagagaccgtaaatatgctgttcacaagataactgcaactttcaagggctctcaggctgctacttcgggcagcacaattggcggcacgacgtggcaagcaggcagtagtttccaaccctggagggtcagcgtctggagaccccggccaaggcatccacagcctaaagatgatgtccgcgaccgcccgggcagcctcgtgcacggaaaaacctcaaccccggccccgcccacccttcctgcggccaccccgcagccctggcccctcagtccattcactcctgcagcgcggccccgcacccagggcctgcactagaaccgctgttcctaccgcggcgccccctgggagccaacgccgcgatgcccgcctgacgtcaggaagtcgaatccggcggcgacgcctttagggagcccgcgagggggcgcgtgttggcagcccagctgtgagttgcccaagacccaccgggggacgggatctcgctccccgcgccacgaggctcggccaatgggaacgcgcgctgcgaggcccgccggtctgccctgcggtgctgaaaacccggcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggtgagcgcagccaggcgggggcacaggagagggcgggaccggaggctgagtgcaggggagacagagttacgcactccgagccaaacaccgactaattcggaggaaagcccggaggcgcctgatcatacctgttgcccggtgattgggtgtcctgcggatgcgggatgaaaaggcgggagagaggcctggagaagtggagtctggggagtggggatggaggccaacaacacgcacacacaaacaaagggtcccgcctccctgccgtgcattccatctgcagccccgagcctcaggtctctgggcggggacagaaccccgagctgggtaggctaggagggaggagagcaaggatgcaggccgcctggggagggagggggtcagtggccaggggagggagtcacatcctgtctcgatggctaggagaggcagcgcagccgcgtctggacctaggtgccggtctccactcgccagcaggagcggagagggagcaggaaaggagcccattctcgaggatggggctgaaacgggaagcttggggagaccgctgccttggggacccctgcgtcgtgtgaagactggaggacgcggaagggacagcgctggccggggagggcaagcggccgctggcgtacataagggattgggaatggcatacacttagcgaggacccccagagctgttctcgaatcgccggggaggccactgagccgcaggccagcgaggtcttcagctattccgcggagcggaccgctgtttacgctctggggcggtaggcccttcgcggggtcctgtcccttcttcccttggtctcactgcggggtcggcgcgcgccccagccccaggcctgctgcttccctttctagaccacagccctcagagctaaggccccggcgcctctctgctgggttggagtcctggggactcagtcctagggactcgaaagtcggggcgttcccttcaccgcgtttcccccttggcggccagaatggcgtcccctccccttgcatccccctctgatcccgtgccctgcagcgtgatgccctccactgtccctatccactaccctggcgtcccagagtgtgccgcgggtcaccaggttcccataacgtcgcagcagagcttagacgctgcggggcgaagacccgccccaccctctgacgcgaccagcctagtgggcgaggccagagcttgcgcgggtcaaccagagtgaccactcgggagccctgactgcggccaagggcgcaggcgtgtcccggcgcatgcgcagacgaaacaggcaccaacgctggagcttcccgcagtgtgatttggggccgggaatgccgcggcggggacggcgattggtccgtatgtgtggtgccaccggccgccggctccgccccggcccccgccccacacgccgcatcacttacagggcccggggctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagaggtgaagccagctggagttgatgggtcgaatggggacctagagaacttttctgtatctagaggtttgtaaaatgcaccaatcagtgctctgtaaaaacgcaccaattggcgctctgtagctagctagaggtttgtaaaatgagccaatcagcaggacgtgggcagggacaactaagacaataaaagctggccaccccagccagctgctgcaacccgctccagttcccttacaggctgtggaagcattgttcttttgctcgtcacactaaaccttgctgctgctcattctttgggtctgcaaagagtgttattcctttaagagctataacagcgggaaggtccacggctccattcttgaagtcagtgagaccatacccgccggaaggaaccaacgcccgacacagccccacccatctctcctgtttctcacctatactgaaattcttgggcaaaagctgtctgtggacacacccaggggaaaggccagcccaggcaggtgtttcttagtggttcccctcagccaatgcttcccattccttgatgcatccttctaactagagcagatactcggtgatcttaaactgtggacacctgggagcaccctcaaaaggcagctgggcctagggagatggcctgtgcttctgtgtcaggagttggttccttcaggtgggctcgtggtctcgctgacgtcaagaatgaagccatgaaccttcgcggtgagtgttacagctcttacaggtggcgtggacccaaagagtgagcagcagcaagatttattgtgaagagcaaagaacaaagcttccacagcgtggaagggtacccgagcaggttgccgctgctggacgttggggggtgtgagggggagcagcctttttttttttttttttttttgagacggagtctccctgtcgcccaggctggagtgcagtggcgcgatctcggctcactgcaggctccgccctcccccggggttcacgccattctcctgcctcagcctcccgagtagctgggactacaggcgcccgctacctcgcccggctaattttttgtatttttagtagagacggggtttcactgtgttagccaggatggtctcgatctcctgacctcgtgatccacccgccttggcctcccaaagtgctgggattacaggcgtgagccaccgcgcccggccgggagcagcttttattcccttatttgtccctgcccatgtcctgctgatttgtccattttatagagcactgattggtccattttacagggtgctgattggtccattttacctctagctagctaaagagcacggattggtgcattttacaaacctctagctacagaaaagttctccaagtctgcactcgacccaggaagtccatctggcttcacctctcacttcaacttgggtacagccttctggcgggcaggaggatggcctttggtgcgaacactgccggagtccagggggctggctccctcacctttcatcttctcccggcacttgcaggatccctttgtggccttccacatcaacaagggccttgtgaagaagtatatgaactctctcctgattggagaactgtctccagagcagcccagctttgagcccaccaagaatgtaagaccctgtgtttgctatgtcgcaactattggttgttgagggggacagagagggggtggaaggagagtctagatgggatcacagtcatagtaatcacagtcagtagtagctctggggagtcttgaggtccctgcttctcttgcatagtcatgaggtcacaggcccaagggagcatggctttgcaacctatggctcccccaaggctgccactaccatggctgccatcattgttatcatcattgttatcatatgagcacttactatgcaccaagcataaactcataactcttacacatttacagatgagataacaggctcagggaggttaagcaacacagccaaggatcacacagttagtaaatggcagagcaaggacttagtcccctgaactcttaggcactatcccatggcacctcctcctgtcatcctcattgtcgtggtatctttgcctaggactgtggacttcccacagctacctcagtgggaggtccttgagcctgagagggcccttgtctccagtagcattggggtgcagatgagaagaataacagctcctcttcctcttctgcagaaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggtgagagcctttggcttgtcaagtgcacagcaatgctcagcatccctggggaaagctccttgggtgtttgaggaaggccaagagtgcctgccctccaagcagggcagatctgaaggtatgcaggagtgagtgcaggaacatgcattctgctgtcttgacctgtctgctctttagccacatggacatcttcatttctctcactgcctttttagctgcttctccaagggttctcttcttcctatgcggtttgttctctgccacagcccacctgtgccaggagccaagtttctggtttcttagcaaagcttggctccctccccaccactgacattgcccaatatgttaataatgattgagcgctaattcttgactgtcaggacccatttggcaagccttctgctcatgtttcagtcctttctgtattctagatgtcagtccatcataagtcatgagcttcaggccaggtgtggtgactcatgtctgtaatcctagcactttgggaggccaaggtggccggatcacttgatctcagttcaagaccagcctggccaacgtggtgaaacctctactaaaaatacaaaaaggccaggcacagtggctcacgcctgtaataccagtaccttgggaggccaagatgggcagatcatttgaggtgaggagttcaagaccacctggccaacatggtgaaaccccgtctctattaaaatacaacagttagctgggagtggtggtgggtgcctgtaatcccagctacatgggaggctgaggcaggagaattgcttgaacctgggaagcgaaggttgcagtgagccgagttggcaccattgcactccagcctgggcaacagagcgacactctcaaaacaggccaggtatggtggctcacgcctgttatcccagcagtttgggaggccaaggtgggcagatcacctgaggtcaggagttcgagaccagcctggctaacatggtgaaacctcgactcttactaaaaatacaaaaaaatcagccaggcttggtggcgggcacctgtaatcccagctacttgggaggctgaggcaggagaattacttgaacccaggaggcggaggttgcagtgatctgaaaccgcaccattgcactccagcctgggcaacaagaacaaaactgtctcaaaaaaaaaaagtcatgagcttcggagctggcgaaacagaagaacagagaagggatggtgatttgccccaactcacgtgtgagtcagtggcagaggcagaactaggacccatgtttcctgactcctgaggtgcatcacaggccttggcagatgaaggaagtgggagaggctgaaggaggcatcgaggtcagtgaaggcgacactggggctggtgggctgctctcagtgttgactcttctcacctaggcccaggctggctggctgcagcatgactttgggcacctgtcggtcttcagcacctcaaagtggaaccatctgctacatcattttgtgattggccacctgaaggtcagtgggatggggaggagctctctaaaactccaggcaatgaagggctgccttgggggaagcttttcatactcgtgtccctgcttttctgtagggggcccccgccagttggtggaaccacatgcacttccagcaccatgccaagcccaactgcttccgcaaagacccagacatcaacatgcatcccttcttctttgccttggggaagatcctctctgtggaggtgcgtggaggtatcagtggaaaggtcttggggaataggaggcagccaacataggggagttggggaagatgcccacgatgttgtcagtgtgggcaagacactggggctgggctggctggggcttttgccattttggaagttctggaaggcaacaggcaatagatgggggctgcccaggagggagtcaccatcctccctagagagttcagtcagcaaaccgttactgcataaaaggcacctcattttgcaaaggatccagcggatgaccagaaggatccaaatgatgagatagcctatccttgaaggtgctgatggcacctcctggaggtgcttttttgacactcttgccccaggcaagtattccccttgcactttgtatttctctcccacacttaggtatccttcttgtcacagtcttctctgtccagggctggactgtcttactcttctttcatgtccaatatctggaacattcattcactgagtacttcttcccaccctgctgatccccagcctgatttcctgggtggtcagcgttgggtttgagatgtcgtctgaagttgtaagcagaaataatgtagctgctgaaggaataatgcctgggggtggagatctggtgagcttttagtgagcattaggcaatggaaggttctaaaaggccagcagaattctttgaaaagttcatttaaagccctttgtcccaaggctgtaggctgcagagttcttccaggtccacctcctccactttgtgacatttcagcttgcgaggaattaaattgtcgttaaaacacatttcagttctaggcatgagttcaaggtagcctggcgttcctctcgcccctggccatgagaactttgaaagggctttggcagcactggttggcctggcatgaggagctcatagcttgaggctcatgccccacctgtccataatgttcttattttcccatcatgagcatggacttgggtttgttacatgtccgataccattatggtcagtactatgcagatgacgaagcagccctgtcccccgtctgactcccatggctgcttcaagggcagtgtggttatttgctgggcagtggcatggggcttgtgcatttctactgtcactacagagggtttaaaaaaaagacatgggcaggttaagtggaagggaacagtctcacaccactacctttattgcttcttggtacttgggttttcaggaaattcctatcagcagacatcaaaaacagagaatgaagggacgcagttggcatgtgcctgtggtcccagctacttgggaggctgaggtgggagcatcgcttgagcccaggaggtgaaggctgcagtgagtatgatcacgccactgcactccagcctgggtaacagcgcaaccctgtgtgtaaaaataataattttttaaaaagattaaaaccaaaaaaaaattgtaaacagagttcaacgtaacttacagattaaaaacagtaaaatatgacagaaactgagaggtagtcatgatcagatatggcctccttcgggtgccgacatctgaactgagacctgaatgatgaaaagggccaacactgcaaaaattcagggaaggaacatttggaacagagagaacagtcaagtacagaggctcccggatgttcagggacagtaagcaatgagagaatgagaagaccagaaaactagggaggggccagatcatgtagggccttagaaagccatggtaagggtgtggtaagaagtttgggttttattccaatagcaatggggagtcacaggagggtttctggtgggtacagcaatctgctttgcactttaaaaggcttgctctggctggaggtggagaggatgaattatagagggtaggtataatcacagatataacctcagtgaggcggctggagcgagtccagaccagaccacggaggagcaggtgaagccaatggatttgggatatgttttggaggcagtgtaagcaacgcttgctgaggacctggatgtggtggtgagaatcaccccatctcgagcaacattaactgaggaaaaaattgaaaaaggggcgcccttgcttgggggcttcctattgtggaactgttatggaaaggagccccatccattgcttcctccttgaatggcaaatgcctttatgatccctataacttgtcccattatgtttagacccttggtggtcagaagggttctatttagggcagtgtcccctgcccctccttgtcctccaaaaattttgggaggcactgacgtggatgtcatggggtcagcacaggcatcaacatccccagagggatggaaccaagcagcctattgcccaggcattcactaacaggcagcccatcctcagcctcatagctggccggggagaagaaaggctattttgggtcccagatctttttttttttttttgagacagagtctcgctctgtcacccaggctgaagtgcaatggtgcggtctcagctcactacaacctccgcctcccgagttcaagagattctcctgcctcagcctcctgagtagctgggactacaggtgcgtaccaccaagcctggctaatttttgtgcttttagtagggacgtggtttcaccatgttgcccaggttggtctcaaactcctgggctcatgcagtccgcctacctcagcctcccaaagtgctgggattacaggcatgagccactgcacccggtctctgtttacaaatttatcaccagcttcatcccctaaggttataagctccatgagggtgggaagtctgtattgttcacctctgtatcctaagcatctagaacatagcccggcacacagtaggtgctgaagaacttgaatctgttaatgtagaaaggatgtttcatctagctgaagtgtcttgtacagaataaactctcaataaatgaactgtggacacatggaagggtgagctagagctctgctcaggggttgagtgctcctcttgtgcccttgtggttgtctggttacctgaactaattggagtgcgatgcagacatagtcatggagtgagacagcagaactttgctgtcttgtttgtgagcccacatcaggggttctagactggctggttgacatggtggccccagcctgtctcttcagcagctcggcttataaaaaataaccaccacctactggggaaaactgctggaaccttcagattgccaaattgttcttggtgtcttttccagaaatatttgccaaactcgaattagccttcaggagatttgataaagctcatgtttaagtcaagagaccaaaagattttgatggggagaattaggggctggatatagagggaatacttaacctgtataggggcagatatggttgtccatggagattctggtgtgaaaaagtacgatggcggccgggcgcactgcctcacacctgtaatcccagcactctgggaggctgaggtgggtggatcacctgaggttgggagttcaagaccagcctgaacaacatggagaaaccccatctctactaaaaatacaaaattagctgggcgtggaggcacatgcctgtaatcctagctacttgggaggctgaggcaggagaatcgcttgaacccagggaggcagaagttgtggtaagccaagatcgtgccattgcactccagcctgggcaacaagagcgagactccgtctaaaaaataaacaaaaaagtacgatgggagaaaggggagagggcagtggggcctggaaacctcatgacaaagagaatgaacacaagagggcctgtggtcctgtagactctgtgctgtgcacatccctcatgtgagcatgggccatccagctgcaggccatggtgtgacacactctgcagattacagtctagggcttcatgttccatgtgctggaggtaaggctgggcctcttggagctttccaatagcaccaacaagctgtcagccctggaggaggcctaaacctccaagcaaggaaaggtcaagtcacagagggaggaatcactggtctccgaatgctcatgtgtttgcttttcttcacagcttgggaaacagaagaaaaaatatatgccgtacaaccaccagcacaaatacttcttcctaagtgagtgtccccatccaacacaggggagctgcctcaggagggaatgctgagggaatgaggaggatgtggctgtccaagggattatggtattttaaggaaaggggctagaggaagtaccccactcccacccccagttactccctgcatgacagcagtttgccatctcagctgagcgaagtgaagttaggctgatgattggttgaaggcaaactagttcttcccatccaaccccagtttccactgggaagctgggtgtttggggtgtagaggggcctcttgctttatcctcaaccttatctttttttttttttttttgagacggagtcttgctctgtcgcccaggccggactgcggactgcagtggcgcaatctcggctcactgcaagctctccgcttcccgggttcacgccattctcctgcctcagcctcccgagtagctgggattacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccctcaaccttatcttaaactttgtcaagatgggccaaggtaacctggtagagcccagtccaacccccagaggaacaaaggtacagatagttctggaaggatgggtcctgaggagagaatggaagagctgttagaacgaagaagatctttctgatgactgccacatattcccagctttaaaagtctgtcccagctactaaggaaactgaggtgggaccatcctttgagcccaggaatttggggctgcagtaagctccgattgtgccactgcactccagcctgggcaacagagtgagatcttgtttcttaaaacaacaacaactctgctccataatgcctaaaatgagctttaaacgcctttaaattttcaaattttttaaagaaggaagggaaggagtccactgatcttattttagtttgaaggaattcatcctaactgcctatcaccaactatcacgaatagagaaaggcgatggggcagaagggtagagcagagacctctggaagaaatagttttagaatccatggcacatcaagatggaggagccatgggtgagcattgtcatgctaggagttatgggtagcatcaggtgccacagagaagggctacagaaaaggaaatgaggaagcatgtagaatgcaacacttcttcaactcccagttttctttcaagagaggcccctctgttccgtcccacagctgacctccagggcttcagattggggtggcacaagcccatctccctagtttaaggaagtgagcttcacagcctgtgaaggatccacagggtccctcccaacacacacacactttcctgctcctgccccttcacctgcatggtggagctgccaggaacaaagggcagatgactgtagggacagggctgtggccaaggtaagtaagagagtattagcacccttttaaaagtgtgggatccttggagtgtgtatgtagaaaagagaagaaaaatgaaaaataataaaggtgtgggagcagagcaagtcccatgcgtggggcctgagttcccaagcacctgtcactgaagagtgccactcgcacccctcaccttccctggcatcctcttgggagtttttgccttccccagacttggatttatgcccaccttcagtgcctgctggttccagtggattgcagagcactcaagcacctggaggggagacagaagggatggttggaagaggcagccccctgctagaggccatctctcccaacatcaactggccctttcatgaccttcctgtgctcatgcctcctctttgtctcggtttcctccccagttgggcccccagccttgctgcctctctacttccagtggtatattttctattttgttatccagcgaaagaagtgggtggtgagtatccatggcccaagaagcccacatccttgtctccagcacccagagtgggggataggggttccccaggggaaacttgagactgactctaggcctaatttagaacaaaataatagaaccagacacagatcctccttatctctaagtgggacgaaatgatttgagcttagcaggcagcctgattcccaatgtgtaatttcatgcggtcagtgtctccagaggttcttgtactgggcataatgccagggggctgagttgggaatggggaagatgaatgagagacaatacctactttcaaggaaacttctgatgaagcagaatgtggttattaatcagaaaagaggtacaggcaataggttctggggactccaaaaggggcctgactgcacctggctttgtgaagtcacttttctagctggccttgaggctgggcagggtttctgacaggcagaggtggagcaggggggatgaactctgagcagagaagctggaaatgaggggtaagtttgaccaccagacatattgtggaggactagtgtcaggggaagagtatggtgcttggttcagtgatgagagatttgatcagggcactggcatggactgagccatggtcctggcagattcatttggcggcatgctgaaggatttagattggctaggaagagctagaggcaaagagaccttgtaggccttggtacttttgaaggggacatgcaagaagggctggggggtgccaatgggaatggaagaaaggagcagtggcactagatactgcaggattggacccctgagaagctgaagatgagtgagtctggataaccaggagaatggctgcaccatgcaaacaaagagctgctgagaggaagaggaagagttgttcgtgactgttatgctcgctgcttttctcactataggacttggcctggatgattaccttctacgtccgcttcttcctcacttatgtgccactattggggctgaaagccttcctgggccttttcttcatagtcaggtagtattcggtgggggcggatagggactggtgaaggaaatgttggggagtgaccagtctggtctaggggccgtgctggggctttgggtaacagtgggtgtttcaggagttggcttgggaaagtagacaggctggagcagttatctgaggggggaatcagaattctgggctctgtgtgtactgtttttgtctgtgtaatacatctaacaggttcctggaaagcaactggtttgtgtgggtgacacagatgaaccatattcccatgcacattgatcatgaccggaacatggactgggtttccacccaggtaagggacagtcactcagaagactggagcataacacaactattgaaaaggatgcgtaggtgaaaacagcaaaaacaaaaagtcccccaaacagcattttctcattagcctgaggctcttgttctgcaaccatgtgaagggagtgaccaagacagtctcatgtcccttcctcagccagctttacctggagaatgctgggctggcctttccatctgatattcaacatgctctcccctgaccttttccgccagctccaggccacatgcaatgtccacaagtctgccttcaatgactggttcagtggacacctcaacttccagattgagcaccagtgagtagggagcctggggaagcagggtcctggggagggtgtaagtgttgggtacaggtgggagcagagaagcaggaaccactgactcccccgttctccctaaagtctttttcccacgatgcctcgacacaattaccacaaagtggctcccctggtgcagtccttgtgtgccaagcatggcatagagtaccagtccaagcccctgctgtcagccttcgccgacatcatccagtgagtatctgagaccaggaagatggctagtagggagggaagagggcagggcaatggaaatgatgacatgtagggtggggagtgaacagaaggtgttcccagtcgtgtgggatggagttcaccatggcaaaggcaggattctttattggacctgtggccaggtcaggcctttgccctcattggggttcccctcagtaccatggcccaagctagctttctctaaagtagaggggaggaaaacctccagatggaagaaggccttaacctcactgctccatctccggtgggttcaactctgcttgtctccctcactgtctgcccccattttgtccctgcagctcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgacc

SEQ ID NO: 36570 - DNA, 80049 bp, Homo sapiens
acattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggtaagactagtctttggaacttgcccactccatttgagtagaagcgtggcttgctcacccacggtgtgcctttattggcactttggttttggttttggttttgacttggtttgaattgcttgacaggactggtcttgggaacttgcctactccatttgagtggaagcatggcctgatcaccgatggtgtgcctgtaccggcactttggtttctgtttttgatttgacttggattgcttgatactttggttttgtctttgacttggcttgaatttctggatactctgattttggttttgatttttgtttggtgtaaactgtaaaagtgtgtgtgtgccctttttaccggttctttgttttgtggtgtgcatgtggtgtgagcgtggtgttttgcctcaaagaagcatgggtcaggcacaaataagcccaccctactaggaactatgttgaaaaatttcaaaaagggatttaagggagactatgacaccaggaaaacttagaactttatgtaaaatagactggccagcattagaggtaggttggccatcagaaggaagcctggaaaggtcccttgtttcaaaggtatggcacaaggtaacctgtaaagccagggcacccagaccagttcccgtacatagatgcttggttactgctggttttagatcccttcacagtggttgagagaattgcagcataagtggctggcagaggcagagagagagagagagagaggcagagaggagagagagagacagagaagagaaagacagagatatacaagtagttaagaaaaaaagtgtaccctattcctttaaaagccaaggtaaatttgaaacctataattgataattgaaggtattctccataatcctgtaacactccaatactactttgttgtcagtgtaaacaagggcgtatcccaaaagcactgaggccttcctatcaaaaatccttaacccagtagcccgtggatggcccaaatgcattcaatctgtagcagcaactactttgctaacagaaaaaaagtaaaataataataataacttttagaggaaacctcattgtgagcacacctcactagttcagttcagaaatatcctaaatcaaaaaagcaaaaaagtagcttactaactcaaaaatattaaagcaaggggctattctgttaggaaaaaaaaagccatctataccaattctaagttaatttggacaaaacaaggtcttattaatagcaaaagataattaaaatcccaaacttgcaaggttttcaacaaaagtaaagtttgctaaaagttaacagtgtaacatgttttatactaacttctattcttgcggccttagacagtctagtccacagacacaaaagaagtttgctttggaaaaaaatggttatcatcttcaaaaaaaaaaaaaggaaaaaagggggggcagaatttatgtaaaaagagtattatatggtaaattcttgtcctgaaataaattagctggttgtttaaagaaagaaatatttgtaataagtcagaaagttgaagcatgttgaagaactgcctgcgaaagtcatgaaaaaaaaggttataaaaggaaattcatgcaagaaatgttgtctagtttaaaagtaattaggcctcctaaatgtaaaactattaaagaaacagtttatgtgcaaggtatataaaaaaagtaaaatatacttttaatagaagaattataaggaggcataagaatgtaaagttttacctacattaaaaggttaaaaatatgtgcgttttgttttaaaggtttaatcaagttttaaaatgttaattgaaaaaaaaaatctgtgtgtaaacatcggctaaagttaaagaggtatcatccagtttttctgtaaactggacattaaaataaaagcataacaggtttttcttgaagtaccaacctgctctttagcaaaaattataaaatgttaaaaagagtctataaaatcttaccttatagtcaaatattaaaaattagataaatatgtctgcaaggttttattaaaattaggtttaacattaataacacattaatataaaggtaaaatttaacttatctggtataaaaatcatacaggaagcattgttaaatgtaatggtatttggctttctttgatttaaaaactaataaaaataggtgctaaaggaaatttctcagtaacaaggcactaaggactataaagtccactgccaaggtccccacatttaaaacaaatggtcaatttcttaaaaattatatacttggcttatcttccacttaaaagtcttttagtatgcataccacccctagaatttccagtaaaccagcaccagcctgaagatcacgttctcatcaaaaggtggaaagaagaaaaactcgagccagcctgggaaggaccctactttgtgctgctaaccaccaaggctgctgttcatacagcaaaaaaggatggactcatcacacctgagtcaagaaagcgccaccccctccagagtcgtgggccatagtcccaggggaaaaccctaccaagctaaagctaagaaaaatttaactcttttcatctattctattactctttcttctttcctcattctattgcggaccatctagttattaacataaccaagtcaatttcacctcaaactgttgcatttaatgcttgccttgttataccctgtggagacttgccaagtcaaagacagctttctacttcagaaaagtacttctatccctcttgactctctttagactgggcattggtaaactaggaccgtttaatcgggggagatttcgataaagaccccagtgccaaccaggagtcttgccccccaacatagagcttttatgccatagttggtccaacattctgtggaccactaaagagcaaggatgaactgccccgactggtttttataatttcctaaaatcatacattcattttactagaggatcatagaagttaaagacttaaaacaaactttagcaattaagacaggataccaagatgcaaatgcctggttaaaatggatcaaatattccgcctgcacgttaaacaaaagcaattgttatgcttgtgcacatggcaggccagaggcccagattttcccctttctattaaggtggtcctccagttgaccaggcgtaggctgcatggtagctcttttccagtattctacagcctgaagtaataagtcatgccaagctctctctgctatatcccaaagtctggcaccctgtgggtcagcccccaagggccatccagcttccgcttcccaacattaagttcacttcatgtctctcacgacagggaggcaacttagcatcccttggagacctgaagggatgcgatgagcttaagaattttcaagagcttatcaatcagtcagcccttgttcatccccaagcagatgtgtggtggtattgtggtggatctttactgggcactctgccgaataactagagtgacacttgggctttagtccatttggctatccctttcactggggcatttcatcaacaagaaggagaaaaaataagacatcgtaaagtgagagaagtccctatggatctttcaactctcacatctatttagatgcaattggagtcctgcaaggaataccagatcaatttaaagcttgaaatcaaatagctataggatttaagtcaatattttagtgggtgacagttaataaaaatgtagattagataaactacacctattacaatcaacagcagcaagctttccatgagttaaaaaaaaaaaaaaaaaactcatgttggccccagccctggagctacctgacctgacaaaaccctttacaccctatgtgtcagaaagaaaaaaaaaatggcagttggagttttaatccagtctgtggggccttggccaaggccagtggcctatctctcaaaacaactagatggagtttccaaaggctggcccccatgtctaagggccctggcagcaatggccctgttagcacaagaagcagataaagtaactcttgggcaaaacctaaacataaagtcctcccatgctgtggtgactttaataaataccgaaggacatcattagttaacaaatgctagactaactagataaccaaagcttgctctgtgaaaatcccaacatcaccattgaagtttacaacaccctaaaccccgccaccttgcttctggtatcagagagtccagttaaacataactgtgtagaggtattggactcagtttattctagtgggcccaacctctgagaccaaccttaaacatcagtagactgagagttatacgtggatgggagcagctttgtcagcccctgcaaagtgactctgaagaagacaacaagccctgctccagtcacacttggaagctgactggtccacacacagccaaagcatgaagaaactcatcacaagactcattttccttaaaatttggacttgtgcagtaaggacttcaactgaccttcctcagactgagggctgttcccagtgtatacatcaagtcactgaggtaggacaaaaagttgctaaggccttattattttatagttattataagtgtactggaaccctaaaaaaaacttgtttgtataattttattctatataaggtatgtagcccaggaaatgaccaatctgatgtgtgttatgacccatctgagcctcccatgaccacggtttttaaaataaaattaagaactgaagactggtgagggctcataaacaacacaagtaaagtgttagccaaaataataataataataaaaaagataataaatagccccctgagagaattatacaatattataggcctgctacttatgcacaagacggctcataaggataccagacccccattcacatgctcaaccaaatcacacagttacaaactatcctaaaaagggacaggaattgctcactcagagagcttggctcttgagacaggagtcttgccgattctcccagccgaataaacctcttccttctttaactcggtgtctgaggagttttgtctgtggctcgtcctgctacacgttctatagcttccctttgactcagaaaataccaccaggggtctggaatattctagaatctttgtttcttacatttgacatttcttatgttatactgggtctagaatttaagctctctaagttgaaaatacccaagctgaataagtatgggtataaatacaattttgttcagtattgattttagaaaagttttaaatgaagcaattgttctttccaaagcttcttcatcaagtagaaaatgcagacactggttcctaaaaaatcttggaattttacattaatctgcagcttgaaaggcaagtgggaatgttaaagaaacattccaaccaattttgcacaggtcaaggaaaaccaagttttttcaaacatcatgtctcttgtttatttacaaaatcagatacatgcaggcttctggtgttggtggaatgcagctgacctcgtagaaacatttctggctgctcatttacactttgaagttgttaaaattttccagagcaaatatcctaatttctagtaacacaaggtatgtcatgtacagcacaactactagtttaaaggagagtcaagctagaatacagaatggctgttcccagtcataagcacattatccctactgaataaaatgaaaatggtgcaggcgggtaatgttttgaaagtaggataagggttcctcatgactttccttgtgaacaggggcctcggatcagcctgtagtggacatcagagagattcacgttaccccagtgtgataaataatgaagcacaatgcataattgtcactaagttcttagaactttctcagacccaaactaccatgcagaatgcattacctcaggctctgcagggtcacgagggagataacccagtgtcaggacaagtaaatagacataattgtaccacactcctgtcgttataacagccctttagaaaaactggaattccattttgctcagctgctttccttactctattggaaaaaacaaatggtctttgcaaacagcaatcctgagtgtgtaaattaatttctaactttacagttcaaccatagacctggttacagaattaacttttaaaatgaacaatttattttgtattctcacctgaaaatattactgtttatgaaaaatgcttaataaaatttaatgtttaaaaaatagaggcaatgacacaaaatatccaattatgttattgctatataactaataggaactctggtgccacaaggcttaaacgaaactcagtgctttttaagaagccatttttcagtgcttcttagaaaactgttttaaaactctcctactttaagaccaatggatgtcattttacaataccaaacgctgaagtaactctaagtatctcctaaattgtggaagggtgacgaaagttagtctctcattactcctgaatatttgtccaacttcaagaacaatctgagacctgaaaaaaattgatgttatttctcaaacggcctaacttatttttaaggagcagtacacaattttgcctgtgtatcagaataaagtagttgacacagaaccagctcaggaggcagaagacgtgagtatgatttgaaatcaccaatgatcagctgactctgtgactaaagtcctcagctaattgccttatttaagaacatgttgttacctacccctcatccgtagcacatgctctctttgtttccttcatagcacttaataaaacttataattatttttattttcatgtttatttactcactcatcaactcaaatatatatgaaggcagaaaacgtgtctgtcttgttcaacttagtatttcttccaattcatagttgaaaaaaaatgagctcaaagattcatgcattcatttatccattcaacagacatttgctaaatttttattttatgtaagcactagggcctagaaaagagaatctacttcacaatatttttaaatattgaatgagatcatatgcttactttatgaagtaaacatataattaaagtgaactgttgttattatttacttaatataaaaggattctaattccagagaaaatagcatctcttcctctacaaccaaggagcaaatattctcaatgttgcttaagataacagagttgtcaaacattggtttctaacctatgaactaatcttcacattaaaaaaaaatgcattatagtatgtaaatatatgggagaaaattctatttatatttcatgattttcattgataaaaaattgatttcatatggtgtaatattactgataaggaaatcttttgtcagagttcagtcataattcatgaacttagggaataaacttaaactgttcatggcacacagtcttttcagttcacatttatatgaacaatgcatttggatgcctttgttgttggagaatctcaaggagaagacccaagcaaggctgagaagaagcatcagaggcaaggcagagatgcaggatgccttaaggcatagtagctcacttaaaggaagacgtggttcagactgcagtatcaaatgaacatctacatagctcttaggaggagtaaatatcaaggcataatggaaacctgagtgaggacagcaaaacaaagtgtgtcaactgataatactaaaaaactagccttttagaagataatttaaaatacacattttaaaaacagaacattatccattatattgtaaccataattctctaccaatgtaggttgcactattgaaatagatgcatcagttaagagtgagttaccctttaagaaacagagaacacaatttgcagtggctttgcaataaggaaatactattgagacaagaagtctagtggtaattgactgtagacaataatgtagttgctcaaaataaacaggctgctatctgtgtgattctcttggccttttattcactattataagacaaatacttcttcgggaaattcagggtttaaagaaagaaggatgatggtgctagagaaagttcgctgtagggtttggctcacatctcattggccaacattgagtcatgtggcactcctggctgcaaaagatgtttatttagcctctatagaagagattaaagaagacaaaaaaaggttggggatgtagggttgaacaaatcaacctacagtatcttccacatttctttttcctcttagtgtatgtatttttgcttgtgtgtcaaactccaaaattatattaacagatcctgaaaaagaaatattattattcagtcttctcttaattaatagggactttagcaaatgtcatgatgattgatttccacttaggttactttgtattttatatgttaaaactttcagtacttctttggaaacaattaaactaggatttttaagccatggtttttagtgaatgggttatttagaggatttcctaagggttttgactaataagacatgtcagccgaaaaaaatatttgctgtccctttagggattcaaactatttagtgttacataacactactccaatacatttgtagctgactgctaataaactgcacaaatgtcatcatttcacatagtcagtctcagaagaaatcataaatataagagataaaaaaatttttacttctgcaaaaaccccatccagatctctgcttatctatgttgaaagagtaactgcgcaaaagaagttccaaattttatttttaggagactgtgaaaaagcatccaaaaggacatccgtgggatatttctcccacgtttttatttaaaattggtatttcatagcttaagagtttaattattttgtgcattctgaacatcattttgagaaatgcctgtaagaattaagcatgttttgtcattaaagtcaaattctgatcaattcaaatttattcaacagacacatttatttaggatttattgtgtgttaaaaactattgtagacagacagtaggagggaatacaaagaagtagtgggggaggaagacatgtatttgttgttaggacagtatagtttgtgtgccacatataagaagaaatagaatgcttttgtgggggcacaggtgaggagtaccacttcaacaccacccaaatgagtaagccaaggaattcctgtggaaaagtgtatgacccttgcttcctgaagggtggattattactgagtcttagaaagataattctaactggggctgggtgctgtggctcacccctgtaatcccagcactttgggaggccaaggtatgaggagcacttgagcccatgaattcaagaccaacctggggaacatagcaagactctatctcttcaaaaaataaaaaaatcaaaatcaaaattaactgggcatggtgacacacacctgcagtcttagctacctgaggggctgaggtggaaggattgcttgagaccaaaaggttgaggctgcagtgagctgtgatcacaacactgcactccagcctgggtgacagagccagactctgtctctaaacaacaaaatatataaataagtaaataaaataaaaattataattaagaaacccattactttctctactataggctgccttacttacattttaagaaccccttttcaatatctagagcttcctatttccccttctagcattttctttacttgtgtactgatttcaggcccagtattttcaacacatggaatcaataatctgaccactccttattgctcttgcattttacaaaaggatctgaagaaacataagatgtttgggaaggaaaactttaattcctctttgctcttctgattgttacttaagtttctggaacctccaagaccaattaaaattatcagagaatctcagagttttgaacaataacagaattacatttactaatccttcatcccattcttcaataattcccatatctttctgctctccacactttactgttttctcttcttgttctaagatttgatcactctgcctataccaaaatggcagaattcttgggcatttcttaaacttctcaagtaataattgattcaaatgaagcatgaaaatagttttttaatctaatgttcacacttatccctaatacttagctctcacaaaatgtaacatcaaaattttcttgactcttgatatgttgcacagctacagctaatagtggagtaagaatgagaagtaggcaatgatttgggtttgtgtaatactgagttgtctattgataattcaatgaggactttaaaaatatatatatgcaaacctttctgtaaatgtgaacacgtgcatttctaggacaggttcatagcttttaccagattatcagaagagggctaagacaggaggaaagaaatgataagaatatttgaccagtataaatgatgcttacataactaatggtacttacttatgtatatggtaatgatttggatccatctctcatcaagtgctccttttcctctcaatgcttatttttcctcacaaatgttagtcctttctcttctactattcatgagagcaaatgcaggagccaaaaatttaggaaatccccaggcagagaggattagcaaatctgctgactttttttttttatatagttttctactttattcttctcttttattatactttaagttctagggtacatgtgcacaacgtgcaagtttgttacatatgtatacatgtgccgtgttggtgtgctacacccattaactcttcatttacattaggtatatctcctaatgctatccctccttcttctccgcaccccatgacaggccccggtgtgtgatgttccccttcctgtgtccgagtgttctcattattcaattcccacctatgagtgagaacatgcggtgtttggttttttgtccttgtgatagtttgctgagtatgatggtttccagcttcatccatgtctcaacaaaggacatgaacttatcgttttttatggctgcataatattccatggtgtatatgtgccacattttctcaatccagtctatcattgatggacatttgggttggttccaagtgtttgatattctgaatagtaccacaataaacatatgtgtctttatagcatgtgtctttatagcagcatgatttataatcctttgggtatatacccagtaatgggatggctggatcaaatggtatttctagttctagatccttgaggagtggccacactgtcttccacaatggttgaactagtttacagccccaccaacaatgtaaaagtgttcctatttctccacatcctctccagcacctgttgtttcctgactttttaatgattgccattgtaactggtgtgagatggtatctcattgtggttttgatttgcatttctctgatggccagtgatgaggcacattttttcatgtgtctgttggctgcataaatgtcttcttctgagaagtgtctgttcatatccttcacccagtttttgatggggttgtttgtttttttcttgtaaatttgtttgagttcattgtggattctggatattagccctttgtcagatgagtaggttgcaaaaattttctcccattctgtaggttgcctgtttactctgatggtagtttcttttgctgtgcagaagctctttagtttaattagatcccatttgtcaactttggcttttgttgccattgcttttggtgttttagacatgaaatccttgcccatgcctccgtcctgaatggtattgcctaggatttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttatcaaagatcagattgttgtagatatatggtattatttctgagggctctgttctgttccactggtctatatctctgttttggtaccagtaccatgctgttttggttactgtagccttgtagtatactttgaagtcaggtagcataatgcctccagctttgttcttttggcttaggactgacttggcaatgtgagctcttttttggttccatatgaactttaaagtagttttttccaattctgtgaagaaagtcattggtaggttgatggggatggcattgactctataaattacttgggcagtatggacattttcacgatattgattattcttatccatgagcatggaatgttcttccatttgtttgtgtcctcttttatttcgttgagcagtggtttgtagttctccttgaagaggtccttcacatcccttgtaagttggattcctaggtattttattctccttgaagcaattgtgaatgggagttcactcatgatttggctctgtttgtctgttattggtgtataagaatgcttgtgatttttgcacattgattttgtatcctgagactttgctgaagttgtttatcagcttaaggagattttgggttgagacaatggggttttctaaatatacaatcatgtcatctgcaaacagggacaatttgacttcctcttttcttaattgaataccctttatttctttctcctgcctgattgccctggccagaacttccaacactatgttgaataggagtggtgagagagggcatccctttcttgtgccagttttcaaacggaatgcttccagttttttgcccattcagtatgatactggctgtgagtttgtcataaatagctcttatgattttgagatatgtcccatcaatacctaatttgttgagagtttttagcatgaagggctgttgaattttgtcaaaggccttttctgcatctattgtgataatcatgtggtttttgtctttggttctgtttatatgctggattacatttattgatttgtgtgtgttgaaccagcaggatgaagcccacttgatcatggtcaataaggtttttcatgtgctgctggattcgctttgccagtattttattgaggatttttgcatcaaagttcatcagggatattggtctacaatactcttttttttgttgtgtctctgccaggctttggtatcaggatgatgctggccttataaaatgagttaggggggattccgtctttttctattgattggaatattttcagaaggaatggtaccagctcctccttgtacctctggtagaattcggctgtgaatccatttggtcctggacgttttttggttggtaggctattaattattgcctcaatttcagagcctgttattggtctattcagggatttaacttcttcctggtttagtcttaggagggtgtacgtgtccaggaatttatccatttcttctagattttctagtttatttgcgtagaggtgtttatagtattctctgatggtagtttgtatttctgtgggattggtggtgatatcccctttatcattttttattgcatctatttgattcttctctcttgtcttctttattagtcttgatagcagtctttcaattttgttgaccttttcaaaaaaccagctcctggattcattgattttttgaagggtttttcatgtctctatctccttcagttctgcactgatcttgttatttcttgccttctgctagcttttgaatgtgtttgctcttgtttctctagttcttttaattgtgatgttagggtgtcaattttagatctttcctgctttctcctgtgggcatttagtgctataaatttccctctacacactgctttaaatatgtcccagagattctggtatgttgtgtctttgttctcattggtttcaaagagcatctttatttctgccttcatttcgttatgtacccagtagtcattcaggagtgggttgttcagtttccatgtagttgagtggttttgagtgagtttcttaatcctgagttctagtttgattgcactgtagtctgagagactgttggttcttatttctgttcttttacatttgccgaggagtgctttacttccaactatgtgcgacgtggtgctgagaagaaagtatattctgttgatttggggtggagagttctgtagatgtctattaggtctgcttggtgcagacctaataagtttggaataagtgcgacgtggtgctgagaagagagtatattctcttgatttggggtggagagttctgtagatgtctattaggtctgcttggtgcagagctgagttcaattcctgggtatccttgttaactttctgtcttgttgatctgtctaatgttgacagtggggtgttaaagtctcccattattattgtgtgggagtctaagtctctttctagtctctaaggacttgctttatgtatctgggtgctcctgtactgggtgcatatatatttaggacagttaactcttcttgttgaattgatccctttaccattatgtaatggccttctttgtctcttttgatctttgttggtttaaagtctgttttatcagagactaggattgcaactcctgcttttttttttttttttttccatttgcttggtagattttcctccatccctttattttgagcctatgtgtgtctctgcacgtgagatgggtctcctgaatacagcacactgatggttcttgactctttattgaatttgccagtctgtgtcttttaactggagaatttagcccatttacatttaaggttaatattgttatgtgcgaatttgatcctgccaattatgatgataactggttattttgctcattagttgatgcagtttcttcctagcatcgatggtctttacaatttggcatgtttttgcagtggctggtgctggctgttcctttccatgttcagtgcttccttcaggaactcttgtagggcaggcctggtgtgacaaaatctctccgaatttgcttgtctgtaaaggattttatttctccttcacttatgaagcttagtttggctggatatgaaattctggggttgaaaattcttttctttaataatgttgaatattggcccccactctcttctggcttatagagtttctgccgagacatctgctgttagtctgatgggctttcctttgtgggtaacccgacctttctctctggctgcccttaacattttttccttcatttcaactttggtgaatctgataattatgtgtcttggagttgctcttctcgaggagtatctttgtggcattctcgtatttcctgaatttgaatgttggcctgccttgctaggttggggaagttctcctggataatattctgcagagtgttttccaacttggttcctttctccccatcactttcaggtacaccaatcagatgtaaatttggtcttttcacacagtcccatatttcttggaggctttgttcatttctttttactcttttttctctaaacttatcttctcacttcatttcattcatttgatcttcaatcactgataccctttcttccagttgatggaatcagctactgaagcttgtgcattcatcacgtagttcttgtgccatggttttttgtgccatcatgtcatttaaggacttctctacactggttattctagttagccatttgtctaatcttttttcaaggtttttagcttctgtatgatgggttcgaacttcctcctttagctcggagaagtttgatcatctgaagccttctctcaattcgtcaaagttattctccatccagctttgttccattgctggcgaagagctgagttcctttagagggtgagaggcattctaatttttagaattttcagcttttctgttctgtttctccctcatctttgtggttttatctacctttggtctttgatgatggtgacgtacagatggggttttggtgtggatgtcctttctgtttgttagtcttccttctaacagtcaggaccctcagctgcaggtctgttggagtttgctggaagtccactcccgaccctgtttgcctgggtatcagcagtggtggctgcagaacagcgaatattgctgaacagcaaatgttgctgcctgatcgttcctctggaagcttcgtctcagaggggaacctggccatgtgaggtgtcattctgcccctactgaggggtgcctccccattaggttactcgggggtcagggacccgcttgaggaggcagtctgtccattctcagacctcaaactccgtgctgggagaaccactactctcttcaaagctgtcagacagggacatttaagtctgcagaggttcaagtaatgatgaaggattgcataaaagatatttgagtataggagaaaatgtaatattaatgttctattttaatcgcctataatctctcaataattcaagtacacttatgagagatcattcacccctccttgtcatctccacaatcccttctctcccaacaacaccaccatgccattgtggatattgtccttccattgcaggcaacagacaaccatcttgtaaatacatattccataccacattccactcaaggtgctcagatcagatagaatgaagtaagaagatggtgatatcttagtaaatacacttgaacataagccttcacatttacattaatttcttccttaacatcagccacctgaggctgagtcattcctcaaaatgttagcagaacttctttagatcttgtttagtctcattaatataaagcaaaggttctcaatgctggctgcacattaaaataacctgggggctgggggcagtggctcacgcctgtaatcccagcactttgggaggctgaggcaggcgggttccaaggtcaggagatcgagaccatcctggctaacatggtgaaaccccatctctactgaaaaaatacaaaaaattggccaggtgtggtggtgggtgcccatagtcccagctactctggaggctgaggcaggagaatggcatgaacccgggaggcggagcttgcagtgagctgatattgcaccactgcgctccagcctgggagacagcgagactccgtctcaaaataaataaataaataaataaataaataaataaataaataaataaaataacctgggaaaatttgaaattactgatgccaatattacaacctgaagattctgctttaaatatactaaagccatggttcttattccaggctatccatcagaatcacctgtgggtgtttttaatgatctacatgcctgttctctatttccagatagctgaatatgaatctctgacatgtgaactccctatacaattgtagtttccaatactttgcaagtgattctaatatagagtaatgggttgagtctcattactccacattcacacttcctcattggtccaaaataggaagcccagctctagtcaatggaataacttccacatggtgtttagttttttgcaaaaattaatcactcaacattttaaaaagaatttgtcacagactctaacatatagcaaaaacaaaaacgtggccttggagtaaatcaatttataatccttttatgtgatttcttttgagtggccaacattttactgtctgcaaatagatattcctaatcactatgccctggtctgaagttttcaaaattacccaaagtcgtgaatgctgtgaaatatatatggtttccttcacaaaatatatcataggatatgagtggacaagaacaaaaccacatgaaagtgtacgtgcaggcagttcatccaggattactcactagcaaacaaaaataaaagctgacatttattcaacaattattatctgtttaaaattttctgacaaccttgtaagcattataaaatttaattcttatgactgccttctaggataggtattattgttattcccaaatgacagactgggaaaataaaaattaggaagcttaagtgatgcttttgcttatcagcttcatagaactgtgatgcctaagtaaaattacaaattactatatcgtagtgattttcacaataacataaaagtagtcaaaattatgacctttatgcctgtaaataccaagatttgcctgcttgcattctaatgaatatattaaatgaaagtctgttaacgctatcacataaatgcattgccttccaagcctaaaaccccatggtgtgaactttcccttccaaaatacattaacttttttggttctgttagtgcagctggtggataatacttaaaatggagttctaagaaaacagacagtgactcaatttctacagaacagtagactcatgtttaaacaaatacacacaaatttattctgcagtgacataatttattgttcaatgatttatcaatattatattattacaactgaatccatatggaccagaaaaagattattcacacaaatcacaaagatactgtggtaggtagaataatgggctcctccaaaatgcccatgtcctagtcctcagtccctatgaatatgttttcttacatggctaaagggactttataaggaccttttgaaggcagattatactgaattatctggataggccccatctaattacttaagtccttaagagtagaagaagataggcagaagacaatgtcatagtgatgtggcttggaaaggcttcaacccacttctgtagattttgaagacagagaaagaggccatgagccaaggaatgtgggtggcctctagaagctgctaaaggcaagcaactaatattctcttatagcctccagaaaggaacacagccttgattttagcccagtaagacctgtgtcagagttctgacctactgcacaataataaatttgtgctatttttagccacaaaattaatggcaatttgttacagcagtaataaaaagctaatacaaggcaaggatgcccacttttgccacttatgttccgtaaagttttggaactccaaattaggcaagaaaaagcatccaaattggaaaggaagaagtataattatctgtgtttggggatgacatgatcttgtatgtacaaagctccaaagtatctacaaaaaaagcgatgggatgcaaaaataatttcagtacatttgcaagatactacattaacataaaaagtcagttcagtttttgtacactaaaaatgacacatctgaaaatgaaactcagaaaacaatcccatttacagtaacatcaaaaaaaaagttaggaataaatctaaccaagagggtgaacatattcactgaaaagtgtaagacactgataaaagaagttaaagcacacacaaataaatggaaagacatctcaggtttatggatgagaagaattaatattgttaaaacgtccatactatgcaaagcaatcttcagattcgatccaatctctgtcaaaatcccaatggtattctttacagaaatagaaaaaatcttgaaattcatttggagccacaaaagaccccaaatacacaaaacaatctgaacaagaagaacaaagctggagatatcacactctcgattttaaaatatattaaaaactactgtgattaaaacagtatggtactggcataaaaatagatagatagatagatagatagatagatagatagatagatagatagatacacacacacatacacacaccccaatggaacagaatagagagcccaaaagtaattccacacacctaaatttaactaatatttaacaaggatgtcaagaatgtacaatagggaaagggtagtctctttaataaacagtattggaaaaactggttatttacaagcaaaagaatgaaattgaaccattatcttacatggtacacaaaatttaaatcaggtttaagacttaaatgtaaaacatgaagccataaaactcttagaagaaaacatagggaaaaatattcttgatgatggacaattgacttggcaatgatttcttgaatatgacaccaaaagcataagcaacaaaagccaaaatagacaagtgggattacatcaaactaaatacttttgcatggcaaaggaaacaattaaaaaataaaatgggaaccaacagaatggaagaacatatttgcaaatcatatatctgataagggattactatccaaagtatataagaaactcctaagactcaatagcaagaaaatgaacaatttaatttttaaaaaggcaaggaactgaatagacatttctccaaagacatacaaatgtcaacaggtatatgaaaagattctcaacctcactaatcattagggaaatgcaaatcaaaaccacaatgagatatcatcatatatctgttaaaatgactattatcaaacaacaaataaataaaagataatgagtattagaaaggaggtggagaaattggaacctctgtacattgtaggtgggaatgtaaaatggtgcagttgctgtagaaaacagtatggaggtgtctcaaaaaattaaaaatagaactgccatatgattcagcaatttcacttctgagtatgtatctaaaagaattggaatcaagattttaggcagatagctacatttttatgttcattgcagtgttgtttacaatagccaagatatggaaacaacaaatatgtccattacaaatgaaggatacagaaatttgctatatacctaaaacagaaccttaaaaaaagaaaatcctggctgggcatgttggctcacacctgtaatcccagcactttgggaggccgaggcaggtggactacctgaggtcaggagttcgaggccagcctggccaacatggtgaaaacccatctctactaaaaatacaaaaattagccatgtgtcgtggcacatgcatgtagtcccagctacaggttgaggcaggagaatcgcttgaacccaggaggtgaagatggcagtgagccgagatcgtgccactacactccagcctgggtgacagagtgagactctgtctcaaaaataaataaataaataaataaataaataaataaataaataaataaatactttcttaaaaaagaaaatcctgccttttgtgacaacttggatgaatctggaagacattatcccaagtgagataggtcaatcacagaaggacaaacactgcatgatttttcttacacataagatacttctaaaatagccaatggtatagaagtagacaatagaatggtgttaccagagaatgggagaaggggcatataaggagtttttataaatcttgtataaatttacagatataggaaataaatgagtttcagagatcttctgtaaaacatagtacctatgactaacaaaaggtcttatgtacttaaaattttttttaacagagtagagctcatgttaaatgtcaacacaagaaacaaaagaaaaaagggatgcaatgttggaattgcaaattataaatcaaaagaagggggaagtagataaggatatagatagggcagcattgcctgcaggttggagttgagtgattggggttcatcataatattgtatctgtttttatgtacatataaaattctccaaaaagtgaagttttaaaaaatactacaggttagaaagattggccatatattttttacttgatgccaaatttaaaggacagttggaaacaactaatttttccctatgaattgatacttctatctgtcctgtccattttattttccctgtcacagccatccgagttcagatattcattatatggtccctgggttcctgcaatcaactcctacctaatgccctttacttcattcaacatctccccaaatccatctctctaccacagtcactctagcctttattattccattcaaacacacatatgctattcaagggtattctgtatgcaaattgatttgctctacttttaaggttttccatcgtttagtccagactatttatttcactaccctctaacccaacagatagtagaaagcccaatctctttactcgtctaaaaaatgccatgttcattctggttgtaggtggctaatccttctctcttcatgcattccaattctaccagccttttaagactgattcatttccctgaatgattgttttatttttcgatttcaaataaatggaaaataaaagatatatatatatatttatattttaatctttaaaaatacaaatacagtatacatatgtaatatatatcttccaccttagtaactctatggtatttatttaattggaccaacttaataatgtcagttactcaggaactggtcatttgaatattcataatgaaaggacagctctttgtcatctcaaaactagtttttggcattaaatctaaaccaagtttggtaaatgctacctttctgaggtgttgtttggggtagtggtttgatttttggttgtttcaaagcatttctaaggatgtacaactaaaagataaagacattggaaaatataagatggttgttctttctttctctcacagtttggaatccagtgtcttgagatgcatttggttactgtagactaaagctgcctagaaactggtgagctggctggctccctcagcatttactctgcagtcattgtcccttgtacaacgctttccataaagccctgcttgtgttaacctcaaaggaatgcagtttgcctggggtcaaggcctccacagcacatccatgaaaatcagcaatgtgatggggtatacaatatcaatctacagagcaatacaagggccccttgataggataaacaacatcttaggtccagggcatcatgagattcagggtaaaattgatttctacttaaaaacatattcacattatctaatagagggtctctgttcccattaaattttttcttcagccacagtattttttactttaaaaaccctaaatattgtagtactttaatttttcttgggttaaattagctttctatatatatgtcagaggcattcaaaccagagcaactccattttgaatgagggctaggaaaatgaggctgggacttgctgagctgcattcttagaaagttaggcattcctggcctccagatgtttgcagttaagggaacaaactaataatgtttattaaacagactcagacttaggagtgtccacatatcccaatatctggagaacagaagcattcctaattttgctttaaagataataacactgatttttttgcaaaatatagtaatgaagaaacttaatcctttatcacaaacccttgtagcagagcacatctcccccacatatataagcactgtagccagggtggatgcattccttctcctactttcgggaacgtcctcctcttgtctatggagtagctgttctttcaccactttactttcttaataaacttgcttttactttgcgctccctaaattctttcttgcatgagatccaagagccctctcttgggatctggatcgggacctcttccctgcaacatttctggtgaccatgaagggattgcagtggggaaacccccgacccaaaggctaattttgggtaagtagggttgtccggtaacatatttctggcaaaccaccaaatggatgatactgaagagaccccgaacccaaaggaaatagactgcagcactgattggacgactttgggtaagtggggtgcatacttgagtaaagaatgggattgggttagaggcccaatttaggggagttacagtctctcctaaagactaagagggttaaagcctcctctcaataaaaggcacggacacttgacagaccttgggttagaggcccaacttgagaggttagaatcacttctaaaatttaggggattagaagcccctctcagtaaagtcccttttggctaagaacgggtttgacaccacgggctatgctgttcgtattcatcagccttgttctctttgctgcaccaatcaatttcttggttgctgtctctgtttcactgtcattttcaggagactttacttaactgtatttgaacttattcttctcctgtgcccctcccaatttctgtccattagtttgtgaaacattgggaacaaaaagcattgaaggctccatctctaaaattgctgattgagatttgatatttaacagctacagccaataagattagatagatgtggttatgttttgttgtcactatgctgactaggtgtgattgagaagcactaagatggtaatcgggggacttttctccttgctgttttgtttcattttgcaaactgaaaaaacaaaacaaaacgacaacaaaaaaaacacttctttccttcttagattcaggcagactggctttgcttatccaatccaccctactgctattgcccaaaacctgcttgctctggtcattcccatctaaatccttctcatttcccttgccttattaagcatttttgtcaaagtccatgttgtggtttatctaagattcatggctcagctcacctatattatttgggtaatgtgaataagagaattcaattttcgacagggatcccctcattaatgtagctggccttaaaaacctctcttatcctttttagtggaacttggccagtggcaatacaatctcgcaggtttggaacttttctttcaaaaatcacctgcctccttcatgggaaccgtggcatcaattccaaagaactcaccagtaggatgtattcttgaacactgggaccagattaaactgaatgggcttaagatgagaaaactggtgtttctatgtaatactatttggccttgttattatttgtaaaaacaagagaaagagcctcctactggaactacagtctttaatactgcacttcaacttgatttgttttgtaagctggagggaaactgggatgaaataccatatgttcgagcatttttgctgctcagtcaggataaaaccctgcagcaggtgtgtgcatgcttgatgagaggtaaagaagaaaaagagctagacatactaggtgattctttaatgcaaccccctactgccccagtttaggggcacttttgggtggagcagagcctccttctgtcagctctgaaggttcagatgtgttggtcctttctcccttcagcccacctgaatgttctattggaaacccattgtcccctattccttacccatctagtcccacactatacccaccactccctgaggaactcagcccagcaagtactacttgtagtggagcctcctatcaacctccaaagggaaacctttgtccacttagagaggtgacaaatggggaagaagtcactgtgagagtacatgttcccttttctatgtctgatttggctgtatataaagaggagtttggtcatttctctgaagacccgggaaaattcatagataagtttgagaaattaactctgacgtatagtttaacttggcaggatctgcatgttttattgtctctgtgttgtacagtggaagagaaacaacacattttgggggcagctaggacccatgcacacgaggtattggcttgcaacccaaaccatgatatatatcaggcaggaggtatagcagttccagatcaagatccagagtagaactatcaaagggacagtgaggacttggggaggagaggttatatggtcactctttggttggaagggatgagaaatgtatgaaaaatcctgttaactatgggaaggttaaggaagtttctcagggcaaagaggaaaatctagttttgtttcaagggcatttagttgaggcaatcctgtgctttgtgggattactcacagatcctgtgctctgtatctgcccctttaacatgctggtccaattgtctggaacactgtctcctgcctacctgccaggtaggttcatatttggccttcaagacttcaagcattatttcagtagctttttttctttcatccccaagcggacttagataccttggtttccgtgttcccacagaactcagtgtgtcaattaaggtctaaggctgagttgaagtggaagagatttactggggtaaaagtttttggaagacaaagggcaaaaggtgcaggagaaagcaagtagaggctacagactgtgatgcatgtctaaaacctataagaagatagagtaaaggtggacaagtctcaaactgcagtgcgaagtcttggccagacaacagggaaccctcatctcagactgccgtagaagaacttagcattgggcagtaccaagctctatccattctgctatgttcagtcattaacaagggctgtccagaaagagtgtagcatcagcacaaatgaatgctacaagagatcctgaatttgctgcaactggaatctgtcacctaaattccctccttgttgtagattttctcttgaagagaaatctaagtgacatacctgtgtggctgcatattctgtaatatcatagactgtatattgtcactcattgtttacttatctttcttaatcctgaagtgccttaaaaataaactaaattttaaaaatcagtgatcaatttaaaagtatttgttaatttttgagatgtgtagacattatcttacaaatcttcatatttgcagataaatgttaagtaagcgttttccaaataaatgtgtgaataaattaacacaagaaaaagcagtgcagcaatcttttatgttttacttcccaaggtattttctttagctttgtgagaacatcataaaccattaagaaagtatattttctactatgacttccctttgtattaatttcatctcaccaactaatagctgtggaattttttgcagtaaatggtagagaagggacgctacaagtcttgagttggaataaaagaaacagaatatcaatattcttataataaggatatcaaactcatgtgcatgtgagtacaatagctattctaaaccttcatctcattcttcactccattcgacagccttgataagctcccatttcactgagaaactaaagccatctatcaggtgtgaatttcaggtctcctcaatgtccatcatccatttgcaaagcctcttaaagaccactagtatatgaaaacatggagaattgtagacgtatcagatattaagcaccttaccatgtgccagtatggtatcaaatgtagtaccaagcactgcactgtgcaattctccccaagctcaaataaagacatggatctcagggaggttatgtgttaatccaaagccagattctatttttagagcaaagatttgaagctgactttattttactatcaaactcatgcacgttaacccataacatcattaactctagctttaaaattcctctttgaaaaaaaaattcctatttgatccccaaggaaatctagttcaatcaaaagtaaatctatcttcaaccttcctagaagacttttgtctagcacatcagagacttttgggagaattggactgaatatacttcagaggtcactctgaaggcaaaattgtttgaatatgacttgtaaggcaccattaagtaatctaattaaggcttagatattttaagaataaaagcaggtaactattttctcacaataattacccactcccttctaattgctattgagagagttaaaagttcaccatatatatttgattgagatctatttagaaagtttcatagagcacagggcacggtggttggcacctgtagtcccagctacttgggaggctgaggcaggaggattgcttgaggccaggaggttgagaccagcctgagcaacatattgagaccctgtctctacaaaaaaaaaaaaaaaaattaattagctgggtgtggtggtacgcacatatagtcccagttgctcagaaggctgaggcaggaggattgcttgagcccaggagctctgcgctgtaacatactatggtcatcgggtgtctacactaagtttggcatcaatatggtgagcccccaggagattgcctaaggagaggtgaaccagcccaggttggaaacggagcaggtcaaaactcccgtcttgatcggtagtgggattgtgcctgtaaatagctattgcactcatctctaaaaaaaataaaaataaaaataaaaagacaaagtttcagagagctaaaatgaatttgatttatcttttaagatgttgaggccaggcacggtggctcatgcctgtaatcccagcactttgggaggccgaggaaggtggatcacctggggttgggagttcaagaccagcctgcccaacatggcaaaaccatgtctctactaaaaatagaaaaaaaaaaaaaacagatgttgaggtggtcatccaataggaaatctaataaaaaccaacctctttatgtttagatgattgcaaaaacagtgccaataaaatgataattagtattttagtgataatgattagtgatcattattactttatatgtggtcattataataaagggctcaaataagtccccagtttaaatatacattcttcaatctgttacacttagtgttatgagcaatgtcaacattaacagtaacttgctgtttagaaaagcttatttaattaggctaaggcttttgaaaaacagtcatagatttcattcttaatcctgtacccccataggacttgtttgaaatttttctcaagtaaatacttgctttaaagaaccatttctcacccttgccccttggaagtgtggaaataaatcatttgtataaacttgaaactgtctagggtgatttttatggaaataacaatggcagttcaacaatggaagtgagggtgggagtacaaactgttataaatacatcactaataacgtcagtgtatttcccttgtcttccacaactatctctggggaaataaaaacactgttacatgctcacttgaattcctgtcattgtgctttgtggatcagtctctctagtctcaaacttgcagcctgtggctgaggttatcatctagcctgtcacatggagccaccaacatagagttgaaatcactggaaatgggtttttttttctcttataatagaaaaggcaaatgattcatgagctcagccacaaatcagagtgaacgaaaaacaactgggtagtaaggcaaatcttagctgcaaaactagagatttccaaaggaaactatattaaatataaaccttctgtataattgtatttgtttcaagcttctaaaccattgaaagtaatgacatagctagctttacaccatgccaaatgcatccattccttccgtatctcctctgtacccttttccccccttccctctcatcctctaacattcaagagaaaagctgaagacagcaaaccccagaatgggattctatactatagaatataggtgtagcttatcctaggagatttttggctttttctttagataactgttctatagagaaacaggtgtgcaatttatctacacttctgaatttactttctgtggtttttctacacgtatatcacagttcggatacttgtgacttttaagggaatcttattttgtaattattcatgcctcagacatgagacaggattcacggcatggtaaatttttcaaggaatactgaacaatgccaaacggtggcaaagcctgactatctttgtgtgataatacccacatctgtgtcacatctgagtctgattcagatacctgctttgtctcttcggattgtgtgttttttttgtttttttttttttttttggttttttgcatggcttagagtattttcttgaaagctggatataatgtatcagataataggaactaagggaaataggcctttagtgtgaggttttatattaatctgtttaggaatttagctgggcttaatatttgctatagctgtaggtgccagaggcttccaatttttctagtgtccttatttttatgtcttttgttgatttaagccttccgtaagtacaattcctcagagagactctcagtcctgcagccctctcagctacaagtcattgtgaaactggaatacagtttatgtggcttctgctccaggtaagcagatattggccaggaccctggatttgcctttcgctccagattttgttgtgaccatttttccctgtgatctcagttctctgataggtccaagaaaagttgttaattttcagtttgtctcacattttcttgttgtaagaatgggaatgacgacttccaggccatttacaaaatattggtgcacacaccagaagtccacatcactgtcttgggaatcagtgaacaggttcacttatttgttcaatcaaaaagaatctaagtgattgcccaaaatcttcctagagttttagtttagtaattgtcttggattttttttagcaatagcaagaaagttctgtatattttcacaactaaaaataaaatcagcagtaccaaaacataaaatgtacacatgtacacctcagtgaagccatgcaaccctgagactgaaattgtcaacataggacactagtaccgctgccacctgtcataatccaacatctttgtaacataaagggcattgagttcacagtaactctaaggtatttacacagtcattcaacagctacaccccctccaagatttcacacttggaaatttccctaaaaaaacacaattacctaccaactcttccatttctttaccccaggcatccataacaaaagtgttttactactaactttaaaacttttctcccatgtctatttgttaggtgaaattcatcttagcttctgggattggctcctactcaacatgcaagcactaatcctctaacatgcaggtaaactggacaacttgctgttcactgaaatatgccttggaagctttattcatgcagcttccactgcctggaaacactactccctccattctgcctttagaaatcctgttcattttttttaaattaatgataagaacttcacaaattatacctaactctatgtgagagtttctatctttgaactatacagctctttatgtacgcctctattatgcatttactatattctgacttccgttggaatttatgtgcacctatttatctcctctagtaaatgatttctaatttcttttaggctgtagcttatacatgatgcctatacatggttaaaaaaaaaacttgtaaatataatgcatgaagggaggagatcaagtttgttttgggagcagtgagttactaaagttcattcaattatataaactcagagtttataggaatcacacacattcaagacaacatattagatagatgcattcagggtataaatgttacttataaccaggcccttatgttagattggttcaatattcaagaccaagaatcttctaatgcactttgagcaatattccccatagagcattattgcttacactgagcctcattggccatctttatgtctggtcatacaacctggtaaagcttccatgaaatctgtattttatcatccagaaaaaaacatggagtttgagattttaatgattttactttgcaatttgtcctccagaatgtttaaaggtgaaacaagacttagcacccccatgaacttctctatgtagattctgttaagtggtcatttcgcttgactataactacctcaagtattgaggctttactttcctgggttttctgaaatttcctttatctctcccaaatttatttcaatatgaaagaaaaggactatattatagaaagttagcaaagtgctggtatctgaatttgtaggttaaaattttctagaaaaatctatttacttatttaaaaaaaagaatatggcacctgaactcagaagtgtgggtatatttctgattgctgaagtcagtaaacaaaaaatgaaggtgaaaaagccaatagaagagaaactaagataatgaagaggaagttgaagtttccatgaggaaaggccaaaaacaattagatttcataagtcaagaatgctaaaggctgaaatgaggatgacataaaaacatataaaaccattaagttattgagtacagcatacctagctgaatgattagattttaaaacaataaaactagggaatatctttcgaagtttagttgaaatcagaagcagtagtacttacgggatgcttaaacaggcagttacttcagtttgtaaggctacatgacatttaataggctaaagcagagtttcagtaaagcaatagctaagttctaaggattataaagagagagatgaaatgcatgagtatatgagaaacctccatcattaatagagattatccataacatttagacttctttaatgtcatgggtttcaacaagagttgagactctacgtgagcatttaacaggatgagatacataaattctaatagattcaagtctgtctgtgtaccagagataatttaggtaagtcaattactatatccacacagcacatattgctctacaggaaagggttttatacattttcaggcaatttaaatcaaagaatagcttttatggaaggagacaatagactctgactggaatgtaatgactacaatatggagaataacttaagtcaggaattgatttctattttagactgatattgccttaaatggcaggctaaacgtttctgtcaaaaagagaaattttattctagtaaaaacaatttatgatgtattaggcagatctttgcaaatacataatattccctgaactaatattatccattactataagtagagggaagtactttaagaataattgaatctgttaagaaaaagcctatataatttagaaaacaaataataatcgcttaagaacaatgttcttgaaaatgcttcttttctctatttcatttttttcattgatttgaatcagcagcttatgagtcatatagatatttttaattaatagaaaaattataaattatgtagttttatctagatgttagatatgggtaaatacagttatttctaaggttgaataaattattgtttgcatattgccaattggcctttatttggtgtaaatattgctataaatgattcaaatcgtctcgcttattaattgggtgcaatgtgatgcaatctaagaaaagacgaaatattatgaaaagtctgtttggcatatctgagaagtatgtataatctagtggctaatgtgtgggctctggatttaggtttcttggcttcatctctgcacagcttcatttctgtgcaggcttaggcaacatatttaacctctttccctctaaaatgtttcatctggaactaaccatctttcagcgttgttgtgaagattaaatgaggtaatacagaacaccagaaacaaggcttgtttgtaaacactttataaatgtaagatattatttttcaagttttttcctcttcataatataataccaaacagtaaggaagcactttatgaaataatgtttaaatttttttttcccagacaaggcttttatttcagggattgtgctcaagtgcaagggagacagcagagggaaggcacaaagattcaatagctggttccctgaaaaaggtggtagggattttatttttgtttagacaaagcacaagaattgacatcagaggtaagcacatgacaggcagaacatttgcaggtcagcatagctggttgcagtggttaataatgtttaaattttatcagactgcttcataatactgacaaagccttctattcttccatctctctgcactgatgtttatgaatagtaacaaaatactaaacatctcctataactccttactcaaaatggtactgtatataactcagtattctcgacaaggcttttgctttatttaagcattagttcaacaaatgttgagtgaatatttattatgtgccaaacagattccaaaatataaaacaactgtccctgtcctactgtccaacttagaaaacttccatcaccaccactcctcatccttttgaaaaagtgttaaaccatcgttctgttccacctttccaatggcctgtgccccctcatttaacctgttaagagaaactgcctcatctgtaaaatagatatgaagctgctgtgaggaaaatgagctagctaatagagaagaaccttgtgaacttatgaaagtgttagttatttgataaatcactagaagaatctggtcattatgtaagttaaagagtagatgatagtgcaatacaagtaactgtggctccttgtgaactctggtcatttacatttatttcctcagaacagagaatagacaaaccaaccataccatcccttcccttctagtaagacttttagaaataattatgagtgcctattggtagttaaaaaaaattatccaatgactttcttaattcttatcacactgaacctctggactacttcttgaatctcttccctcccttggcttctctgattcttctcttttttatttgattcttccttctcagtcttttaacgggatagtttctttactcactccctgtacaaattaattgtggataattcccaaatatgcatctgtgtctaagaactatattatgagcttcaggctcacatttccaggtttcaaccagatatcacacctaggtatctcccaggcatcataaattaaactagaccaaaactgaaatcattgtagctttccaaaaatttctaggattcctgtcttaatcaatagtataaaacatggatccatgccagaatggcatctaggatcctgttcccatccctttcaactcgcacacagagaccacatcttgtgaattctgaatcataaattatacgcttaacctccttccatctccccttcaaatattccaagccaaagtctctttatcttgctcatagactgtggcaattttaacccaactgctctttgtgcatcatgacctacacacacacacacacacacacacacacacacacacacacccaattcatcttttccttggctttgaatgagattttctgacaaactaatctgttcataacacgcagtgtgagtatacatgcttctcatgcctaagaggtaaaccacagtcatcttaagttggtgtattagagcttcctgtttctccacgtctactttgccagacttattgcactaaaactccatcttctagttgccattccaggcattctgagattaaatttcccaggaagatgagagggttttatgtatttcaaaattttatgaaggtattccatttttctgaaatcccctatctccatttttacctggagaacatctactcatattttatagctgagccccattatcaccttctctatgaaaaaaaaaaattaaactcttctctaggttaaatttaaccatttcctcttttatgtcttccctctgtccttttcatatctttaccacacacctccaatgaatctcttatagtgaagctcatatgtcattcctctttgttcattcaacccccagtgcctagaatagcacctggaatacagtggttaattaatattcttcgcttgcacaaatgtctgaataacttaacaaatgaataactgtattaatagtgaatacaaccatgacatgaattttataagaacatgggtctgtacataagaatttttatttttattttatttatttatttatttatttatttatttagagacagagtctcactctgttgccaggctggagtgcaatgatgccatctcgactcgccgcaacctccacctcccgggttccagtgattttcctgcatcagcctcccaagtagctgggactacaggcacgtgccaccacgcccagctaatttttgtatttttagtggggacagagtttcaccatgttggccaagatggtcttgatctcttgaccttgtgatccacccacctcagcttcccaaagtgctgggattacaggcatgagccactgcgcccagcccatacataagaattttaagtccagcatgctaccataatataaaaaacatctaggaaagagaatcagatattttcgttgagtgcttacaatgtatgaatcctttagcatcattatctcatttaatttgcaagcaatttttaagataggcatcatggaacacctacaacatgcaaagcagttttcattcatgacttcatttaatcttcccaatgaatttatgaagaaagtattattttggcaaatacacacatgacaacactaaaactcaaattagagaattttctaaagatcaaacaagtttaaagtgccaaatttaggattccaactatttctctgtgtcaggcctttgagcccaagctaagccatcatatcccctgtgacctgcacgtacacatccagatggccagttcctgccttaactgatgacattccaccacaaaagaaatgaaaatggcctgttcctgccttaactgatgacattatcttgtgaaattccttctcctggctcaaaagctcccctactgagcaccttgtgacccccactcctgcctgccagaggacaacccccctttgactgtaattttcctttacctacccaaatcttataaaatggccccacccctatctccctttactgactctctttctggactcagcccacctgcacccaggtgattaaaagctttattgctcacacaaaccctgtttggtggtctcttcacactgacgtgcatgaaatttggtgctgtgactcagatagggggacctcccttgggagatcaatcccctgtcctcctgctctttgctctgtgaaaaagatccacctatgacctcgggtcctcagaaccaccagcccaaggaacatctcaccaattttaaatcgggtaagtggcctcttcttactgtcttctccaacctctctcactatccctcaaccactttctcctttcaatcttggtgccacccttcaatctctcccttctcttaatttcaattccttttattttctgttagagacaaaggagacacgttttatctgtggatccaaaactccagcgctggtcatggacttgggaaggcagccttcccttggtgtttaatcattgcagggatgcctctctgattattcacccatgtttcagaggtgtctgaccacgcggggacgcctgccttggtcattcacccttagcggcaagtaccacttttctggggggtaagaaccccccaaccccttctccttcacccttagcagcaagtaccacttttctaggggacaagaaccccccaaccccttctttctgtgtctctaccccttctctgcttttctgggggcaagaaccccccaatccctaatttccataccccgacctcttatctctgtgccccatcccttatttctctgctgtgacctctaatctctgcgccccaaccccttatttctgtgccctgactcctttcccgcttttctggagggtaagaacccccggaccctttccctctgtgtctctactctctcttttctctgggcttgcctccttcactatgggcaaccttccaccctccattcctcctgcttctcccttagcctgtgttctcaagaaattaaaacctcttcaactcacacctgacctaaaacctaaatgccttattttcttctgcaatgccgcttgaccccaaacaaacttgacagttgttccaaatagccagaaaatggcactttcaatttttccatcctacaagatctaaataattcttgtcgtaaaatgtgcaaacagtcgaaatgcctgacatccaggcattcttttacacaacagtccctccctagtctctgttcccgatgcagctcatcccaaatcttccttctttccctcctgcctgtcccctcagtcccaacctcaagcgtcactgagtctttctaatcttccttttctacagacccatctgacctctcccctcatcgccaggctaaggtaggtcccaattcttcctcagcttctgctcctccaccctataatccttttatcacctcccctcctcacatttggtccggcttacagtttagtcccacgactagctcttcccccacctgcccaacaatttcctcttagagaggtggctggagctgaaggcatagtcaaagtacaagtacctttttctctatcagacctctctcagatcagtcagcatttaggctctttctcatcagaccccattaaatatatacaggaattccaatatctaactctgtcctacagtttaacctggagtgacttaaatgtcatcctgacttctaccctctccccagatgaaagagaaagagttttttctctagcccaatctcacgctgataaccgctggcttcacgagtcagacctccaggaaggcattagagcagttccctgagaggatccccaatggaactatcaggcaaattccccaggtatagctagacaagattacatgatttcctgcctagtttgagggcttaaaaaggcagcttacaaacctgttaattctgacaagcttaaagaaactacccaaggtaaagacgaaaacccagcccagttcagggcccacttagcagcaacccttagacgctttaccgccctagacccagaaaggccagaaggccgccttattcttaatatgcattttatcacccaatccactcctgacattaggaaaaaacttcaaaaattagaatctggccctcaaaccccacaacaggaattaatcaacctcgccttcaaggtgtacaataataggaagcagccaaacggcaatgcatttctgagttacaattacttgcctctgctgtgagacaaaacccagccacacctccagcatacaagaacttcaaaatgcctaagctgcacacgcctaagccgcagcagtcaagcattcctacaagacttcctccatcaggatcttgcttcaagtgccagaaatctggccactgggccaaggaatgcccacagcctgggattcctcctaagccatgtcccatctgtgcaggaccccactgaaaatcagactgttcaactcacctggcagccacttccacagcccctggaactctggcccaaggctctctgactccttcccagatcttctcggcttagcagctgaagactgacactgcctgattgcctcggaagcctacaagaccatcacagatgctctaagtaattctcacagtggaagataagtccgcccccttcttaattaatatggaggctacccactccacattaccttcttttcaagggcctgtttcccttgcctccataactgttgtgggtattgatggccaggcttctaaacctcttaaaactccccaactctggtgccaacttagacaatactcttttaagcactcctttttagttatccccacctgcccagttcccttattaggccgagacactttaattaaattatctgcttccctgactattcctgggctacagccacacctcattgccgccttttcccccagttcaaagcctccttcacatcctccccttgtatctccccaccttaacccacaagtataagacacctctactccctccttagcgactgatcatgcaccccttatcatcccattaaaacctaatcactcttatcccgctcaatgccaatatcccatcccacagcatgctttaaaaggatgaaagcctgttatcactcacctgttatagcatggccttttaaagcctataaactctccttacaattcccccattttacctgtcctaaaaccagacaagccttacaggttagttcaggatctgtgccttatcaatcaaattgttttgcctatccaccccatggtgccaaacccatatactctcctattctcaatacctccctccacaatccattattctgttctggatctctaacatgctttctttactattcctttgcatccttcatcccagcctttctttgctttcacctggactgaccctgacacccaacaggctcagcaaattacctgggctgtactgccgcaaggcttcacagacagcccccattacttcaatcaagcccaaatttcttcctcatctgttacctgttttggcgtaattctcataaacacacacatgctctccctgcctattgtgtctgactgatctctcaaaccccaacaccttctacaaaacaactcctttccttcctaggcatggttagatactttcgactttagatacctggttttgccatcctaacaaaaccattatataaactcacaaaaagaaacctagctgaccccatagatcctaaatcctttccccactctttttcattccttgaagacagctttagagactgcccccaccctagctctccctgactcatctgaacccttttcattacccacagccaaagtgcagggctgtgcagttggaattcttacacaagaactgggactgcgccctgtagcctttttatccaaacaacttgaccttactgttttgcttagccctcaagtttgcgtgtggcggccgccgccgccctaatacttttaaaggcccttaaaatcacaaactatgctcaactcactctctacagttctcataacttccaaaatctattttcttcctcacacctgacacatatactttctgctccccggctccttcagctgtactcactctttgttgagtcccacaattaccattgtttctggcccagacttcaatccagcttcccacattattcctgataccacacctgacccccatgactgtatctctctgatccacctgacattcaccccatttccccatatttccttctttcctgttcctcaacctgatcacgcttgatttattgatggcagttccaccaggcataatcaccacacaccagcaaagccaggctatgctatagtacaagccaccagcctgcctcttagaacctctcatttcctttccatcatggaaatctatctcaaggaaataacttctcagtgttccatctgctattctgctactcctcagggactattcaggcccccccccccctttcctacacatcaagctcagggatttgcccctgcccagaactggcaaattgactttactaacatgccccaagtcagataactaaaatacctcttagtctgagtagacactttcactagatgggtagaggcctttccacagggtctgagaaggtcaccgtggtcatttcttcccttctgtcagacataattcctcagtttggccttcccacctctatacagtctaatagcagaccggcttttattagtcaaatcagccaagcagtttttcaggctcgtagtatccagtgaaacgtttatatcccttacggtcctcagtcttcaggaaaagtagaacggactaaaggtcttttaaaaacacacttcaccaagttcagccaccaacttaaaaaggactgcacaatacttttaccactttcccttctcagaattcaggcctgtcctcggaatgctacaaggtacagcccatttaagctcctgtatggacactccttattctctctagtcatactcctattgaccgttctcaactacgcatacatgccctgctcttgattacactgatggtttacgctgcttctccaagccatcacagctgatatctcttggtgctaaccccaaaccgccactcttaactcttaaagtaaataaataatctttgctggcaaggctatgctgaacctccttaggcactctctaatcagatgtcctgggtcctcccaattcttagacctttaatacctgtttttctccttcttttattctgtttagtttttcaattcatacaaaaccgtacccaggccatcaccaataattctaaatgacaaatgtttcttctaacagtcccacaatatcactccttaccacaaaatcttccttcagcttaatctctcccactctaggttcccacgctacccctaatcccgctcgaagcagccctgagaaacatcgcccattatctctccataccatctcccaaaatttttgccatcctcacactttaccactatttcattttatttttcttattaatataagaagacaggaatgtcaggcctctgagcccaagctaagctatcatatcccctgtgacctgcacgtacacatccagatggccagttcctgccttaactgatgacattccaccacaaaagaaatgaaaatggcctgttcctgccttaactgatgacattatcttgtgaaattccttctcctggctcatcctggctcaaaagctcccctactgagcaccttgtgacccctactcctgcccgccagagaacaacccccctttgactgtaattttcctttacctacccaaatcttataaaacggccccacccctgtctcccttcgctgactctcttttcggactcagcctgcctgcacccaggtgattaaaagctttattgctcacacaaagcctgtttggtggtctcttcacacggacgcgcatgaaactctgctcaccagaataaaagttccacaagttaaattttgaagtgtaacctatatgtgatattcacaggtgttttgaaatgggcatatgagttgctagtatcttagaattgctacagaaacaaatatttcctaaaaaggatatttgcagagatttcaaaatagcccatgtcatcaacatatcttaaacatatataacacagcacgagggaaatttgcatattttaatgcttggcaaaatagcaaagtttgcttttttaatgttatgtgttctttagttggtcataacagatttattataaatggacattctccaaaagtcattatgcttcctgatttattcatttgttttaatcttagagagatttgaattgaactagaaatgcatgtaattaaaacattaaagttgagctctgtttaaaatgggattgaaagaaaaacggctttggcaaacaccaattattgaacagattcacttagtatttttggtcttgattatttatagtccttttcaaaaagtatgtcaaggaaaagcaggcaaagaagctatgactggacatacacatgcaatttcaatgtccaaaatatatggttacaagtgtgagactggagttagatggacttggtctaaggtcccagatctgtctgtcttacgctgtagccataggcacaggcttctctgagcctcagtattattaccatgtttaacactgtagaaataatacctatttcacagggattttgtaagactttaataaagtagacataaataaataaagggagtgacacatcattgagatctcaatagatggaagccacttctaccattattgttttaaataataaatcgtgttaaattagccataaagatgggtatttcccatatcttttcaacatgtccctacatagatatgttctgataaatttgatccagggagagacactgaaaagattgaaaaagacataaagctgtctttgatgtccactttactccagagactttcagcatctttggtccccagtcctggtttcaccccctcatatgtgtgccctctttcatcttcctcttccgaggcagccagtgtctaaaagacaagacttctctcttctccagttttgggtctattcctaacctagtctcaactggctctttcttcactttttttttttttttaataattcaccaacataattaagtctatgttgtaaaaccagattcaaatattactttatcttttctttgtattgtagaaaatagaattaaatcttacagaaacagttgtataaaaactaacttgtgagctactatctcttgctaaagaaagctgtagctaattcgtgcagttcttattcatgatttttgcacaaatcataactattttcattgctatgcctattgaaaaatgccctactgaaaataatttgataaaaagaggaggttttttttgtttttttttttttgttttttttttttttttgctactacagtatttcaatgctaaggaaaaatagagctgtagctgagactcaaaaaaggctggaagaaggaactcaaattcagcaagagtgcttctctccctctcttggttagttgattacattattctaattgtgcactgacacaattagacgccctggcgtttgttagaggccactgatgtctcctataaaaaagtgtttctctgatctactttgaaaacaaacaaacaacaacaaaaccacctcagagaaggtccttgagaggaaagcttggatcaggtaattcccccaccgatcagctacagccagtaaggctggattatatcatacaaaaatagtctttgggagactatttccaaagtttttccaagaatgtcatttataagcaggtttattcaaactttaaaaaaaaatacttgacttcttatagaaaacttgtgaaatttttcaacaatgcaaggaaaggcagatttgggagtgtgactttaaatacaaactctaataaaactcagcctttccattaatgtctttatttttattttagtctcaactacacatgtaactgttttagatgtattattaaaaaaatagaaatctggccttacacgatggctttagtaaaacaggctgaaattatcttagtaaacaacatgatcatgacattgggcagcaactatttagatgccgcttttcaaaaacagcatctggagaccgaattcctgtttctctttggcttgcaaaaatcattattttgctgttaaatataggcctatggataatacacatttagagtttgggtctttaccttataaggtaaaagtaggtgtggaagtgtcataaaatagatagtgctacaaattccactggcaccattaacgagacccagctgtgcgtgttaaactcctcaaagaccaaacttcaggcactgcatgcatttagccaaaactcattatttctgagaacatttcagagttgccagaagttctattttggcatattgcagatatatcaataaatgctgagctttacaaatagcttgttgtatgtacttttcaaaagttaataagttacaaactcaacatttctgacatgatttcagtttcagctctgcactaatgtgcatggtttatgtctactgttgtggaagttcctacctgaaaccatctctccatcacaacactattgtcttcttgagaacaaacatccaaataattaagaaatcagacatgctaatttttggttccatatcataaatgtttattaatattaaatataaattaagaagaggtgttctgaagtaataattaaaactgatactatcacagaccacttatccatataaccctctctgaaagtagcttcttgggaacatacttcatgcatgtaagtacattttaagaacttcttgaaataaacaagtcatctgaatctatgtagctctgtatgtgatgcagaatcttctgtctactaaactattttttactgctttcagttttcttggtttattttcaagtgcttattgttgaattgtcataaagacctgaaccatgtttttgcagaccagtaaaccaacaactgaggcagtcagtcctgcccatttcctgctcctcgtatagttgatcatcaaaaaaaaaggcaatccaacataaccaccaatgccaataattgcataaacttagctttcaatcaatccataactacgagaattccattccaagcctgcacctttgctaagaaagtttatcacgaggtctgatggtgttctcttcttattatcttccagaaaccagaacatatattagtaaaaatgatctctgacatttcctagacaatcactgtattccacgcactatactgaatgatttgcaaacataatagaatttaaatctcacaatggagacactattcttactctttcttttacccagaggatatatcgaggtaaaatgatttgcataaggcttctcaggtaggtaaatggccaggagtcagcgttcctgaagtccatgctctcctctttcccagactcctttccttgcaaaagggcatgattctttcctgtttcttgaccagaggtttaagtggaaggctgttagcatgaaagtgttggaatagtcacccgccttgtacaaatgggttttcagggcatgaaccagcatctaaacttcagaagaactaagatagctgatatttcattgctctaacatagacagatcttagtccccaaatcttaatggcaactattagttacagaaggggaaatctatgataatgttctcttaggaaaataaaggccacctaaagaggacatacgttacattatgagatcaagctgatgccaacaaaatattggaaatatcaaagaatattctcacatatgtatagatggataggtgcatctaccatgaccagaccttatacatttatctttccttcttctccctatgtcctatagatgactgtttgggaagataaggccctgtatattttggtcctcttatttgtatgctatgaggatttctaataatcaaaacaattcatggtttggagcctaaaatatatttgctcatgtcacacaattgagacctttgagtgattatttctgttgtcagtcacttccagaaatgtgtcataacaagcagcagagtgacaagtacaggaaatgaatcactaaccttttgaccttcatcaacgtctgaacctaaaatttatagctgatgaacgtttaaataggactgagtttctcaactgaaaatgcctactttggatgccacttcatcttttgttaatggcctagaacttaagtaaatttaatcactataaaaaatgatttaaaagtgagaggttggaagatgttttttgttatttttaaattaagcatttgacatattttgggaaatactttggaagttcttcttaaatgatttggtgaaaacgtcactaagacaatggcattttgtctttgcttcttatccctagagcaaattcagcttttccctagagtaaaggtaagaatagcattgttctcagacttgatcttctcttgacttcagagaagctgtgttatgtctggaattctgaaggaaaaaggccagttgtatttttctggcaaattcattggcatttatatattttagattaaaaaacttaaatgtgttgttagggctaattttaagccaaacacattgttgatccctccagtggtaaacattttcaggaaagacattcctcttgaaaacgaaactccttaaaatatcatattctttagctaattttacaccaaaaaaatagtatcatgaaaaaatatgtacaaaatatttggtaacaatactgaaaccaccctgtgataaataaagggaatgaaatatttcctaagtgtacctcttagtggaaaatcaaaatcaccaaatatcaggttacttgcttcttgatataagacagtggttaacagtacagctttaaaatatgatgatagtataataaaatatgaagtaagcccccactcatatatataataaaagtgatgtcttattcctccaaatttttataaaacattaattacttgtctaatttgcttgcatacaaatgattaaatgtacctgtattagtctgttctcacactgctaataaagacatatgtgagactgggtaatttataaagtaaagaggtttaattgattcacagatccacatggctggggaagcctcacaatcatggcagaaggcaaaggaggagcaaagtcacttcttacttggcagcaggcaagagagcttgtgtaggtgaactctcatttataaaaccatcagatctcatgagacttattcattatcatgagaacagcatgggaaaaactcacccccatgattcaattacctcacaccaggtccctctcatgcacatgggaattattataattcatggtgagatttggctggggacacagccagaccttatcaatacctgagtaataagaacacttttcttacaaatatttgactctatcataagctatggattattccttgtgaatatctagattaatgaatggataaagatactggaagaacagaaattgtgacagtctaaatatgttacagctcttgctgtggacgaatttcatgcaaagcatcccagtaatgataatcattcactgacttttccaactaatttggaattggaaaaatatgaatacacctatatcaggttcctgattgtcaaattcacctaaatatcaggtctactttcttgccaaattgtcaaaaagcggaaatttgtcttaaatttatcatgagtacccaactttgttctagttcctagacacagacttcctcaacctcacacccccagatgggtcaacttgtactcttcttatataatttcaggcaagcccagtcactgtgttaatctagaacaagacaggataaagttcaatagtccagccctcaacctacctcagctttggattctctgaacttactcaagcatctagatctaggacctgagggctcaatgatcccacagtgatgcttgaatctcaggcgtctactatgagaagtagataactaggtaatcaacaacaacctctccagagaagataaatagatagggatgtacttatcttatatactgatatggtttgcctctgtgtccccacccaaatctcatcttgaattgtactcccacaattctcacatgttgttggagatacctggcgggaaataatttgaatcatgggggcagtttcccccatactgttctcatggtactgagtaagtctcacaagatctgatggttttatcacaggtttctgcttttgcatattcctcattttctcttgctgccaccatgtaagaagtgtctttcgcctcctgccctgattctgaggcttccccagccatgtagaactttaagtccaattaaacctcttttccttcccagtctcagtatatctttatcagcagcatgaaaacggactaatacagtaaattggtaacagcagagtggggcattgctgaaaaaatacccaaaaatgtgaagtaactttggaactggataacacgcagaggtggaagagtttagagggctcagaagaagacaggaaaatgtgggaaagtttggaacttcctagagacttgtcgaatggctttgacaaaaatgctgatagtgatatgaataataaggtccaggctgaggtggtctcagatggagatgaggaacttgttgggaactggagcaaaggtgactctcattatattttagcaaagagactggcagcattttgccctgccctagagatatgtggaacttgaacttgagagaggtgatttagggtatctggtggaagaaatttctaagcagcaaagcattcaaaagtgacttaggtgctgttaaaagcattccattttaaaagtgaaacagagcataagagtttagaaaatttgcagcctgacgatgcaatagaaaagaaaaacccattttctttctcctccattttttgaggatacattcaagccggctacagaaattgacataagtagcaaggatcctaatgttaatcccaaagaccatggggaaaatgtcccagggtccccatgctgtgtgcagcaagctagttatttcccagatacaatgtgggtaaaggcattgggtaaatacagccattccaaatgggagaaattgaccaaaacaaaggggcttccggccccatgcaagtctgaaatccaaaagggcagtcaaatcttaaagctccaaaatgatctcttttgatgccatatctcgcatctgggtcatgctgaggcaagaggtgggttcccatggtcttgggcagctctgcccctgtggctttgcagggtacagcctcgcctctggctgctttcgtgggccggcattgattgtctgcgtcttttccaggcgcacggtgcaagatgtcggtaaatctaccactctggggtctggaggacggtggccctcttctgacagctccagtaggcggtgccccagtagggactctgtgtgggggctccgaccctacatttcccttctacactgccttagccgaggttctccatgagggcatttcccctgcagcaaacttttgcctgggcatccaggcgtttccacacgtcttctgaaatctaggcagagatttcccaagcctcaattcttgacttctgtgcacctgcaggctcaataccacatggaaggtgccaaggcttagggcttccaccctctgaaggcacagcctgagctgcatgttggccccttttagccatttatttgtgcattcatccatgcataaagtttgggctgtttccacctattggttgttgtgaatggtgctgccatgatcatgagtctgcaaatacctctattaaaaaatagaactgccatatgattcagcaatcccacttctggatctacggagaaaagaattaaaagaggtatttgcagacttatgataaatgtggcatatacaaacagtgggatattatttagccttaaaaataatataatttagcctgtcatatgctacaccattgatgaaccttgaggacattaagctaaataaaacaagccagtcccagaaagtcaagtacagtatgacttcatttgtatgagatttctaaagtagtcaaattcatagaagcagaaattaaaatggtggttgctagggattgggtggaggaagaaatggggagttgttctttgtgttagtccgttttcaggctgctgataaacatatatctgggatagggtaatttacaaaagaaagaagtttattggacttacagctccacatagctggggagacctcacaatcatggtggaaggcaagaaggagcaagtcacatcttaggtggatggcagcaggcaaaaaggagcttgtacaggacaactcccgtttttaaaaccatcagatctcgtgagacccattcactatcacgagaacagcacaggaaagacctgcccccataattcaatcatctctcactgggtccctcccacaatacatgggaattatgggagatgagatttgagtggggacacagaaccaaaccatatcattctttaatagcaaatttcaaatttgcaagatgaaaaagttacagagatctgttacataacaatatagatgtatttaacacaattgaagtgtacacttaaaaaatggttaagatgttaaattttatattatgtgtttttttaccacattaaaagatactcaaggaattaaccgcttcttggatttcccatttctatattctgcctacctctctgcagggtacttggcacctgttaccttggccatgtccccctcaaatgccagctttgcattatctgctgccctcataagaagtaagtcgcctgtgcatttcccatgagattctgtgagtaattttctttggataattcacagctggtaaagccatttcagaatcactttcttcacggatagcaataattgttctctctagcagggcccaaaagagaagaagcaatttgctatacatgcatcactaaaagagataagcaaaaatcgccttatgaaattggcatggctttgcaagccccagatgatccctcgctttgacaaaagcatgccatgactcttggcctgaaagttaaattgttcatctaatgtatagtaaataaacactcagtaaaatcattgtttccctttaaattttcatacaaatagttctattcccctacaattaaatctcaaagcataatcggaaactttttacagattttggcagattttgattaaaaggtatttccattaccagagcttaataattagcagaaatgaaatttaaagtatctcattgattaagtacagttgttaaaaacaaaagaagaagaaaaaaagcctgctgtgggaattctcctttttggactctcctagcacattctattctgtactacaaataacttttactttctttaaaaaaaaaaaaaaagtacctctcttttatttaccagtaaatagctaaagatccaagtttctctttctttttgctttctaacctattttgactatttcacatctctttggacacttcattcaggtatcaaaagaatggaaacaaggaaaggtaaaaattaaagaaaacaattagagtcacagaaaatacataaactcattataaattatattccatatgaaataacaactccccaaagagtgcattacacatgataagactgtgctgacatacagtaatgatagtgttttctccattactgagtggcctaagaataatttaataaatacagtgtgcattgacaaaccaagacggcacaggtccgactgccttcttagactggaatttctaatatcttttcaaagttgttacaaaagttctgtgaacagttttaagaagtttgtagaccaggttacactcattttttgttttactgagattggtgaaaaaaaatatgtcaaagaaaggaatataaaaattacttaagttataagtaggaaagcaaattattgtctaattttaattaaagtagaccatagcctaaaatagctgaactatgttgcttttctcagaaaaaaagaatgtatcctgtctgtttctcatattttctataggcagaaaagaattaatgaagtcttatttctagttacattaaacctatcaaattttaattacatcagggaatgaagtgtaatttggtaccatcaagcaatcattgataacgtttcaaatgtcagattctctcatttaatcacacctctaatttatgagtgacattttagttatagaagctgataagatgtatcagataagttgataaagcagaaatagtgtcttaatgagcgttttaacaggaatagcgtccaaatctaaaatattcaaattttaccacttttaaagaataaatgaattttcaaagagccccttaggtatgggtcacaggattgcaaacatttggcaaaactcttcaagctgcagttaagccctgtccatttcactgtacatacattatacttaattaaaaaagattctttatcatggatccagatagctacagtcacttaatagaaaagaaaactcaagaaatagaaattctcatgctgtttgctattgacttttgcagtcactttaaaacttttttattctcttacttcaaccactatttgatcattgaatctggtcccagaggaatatgtggagaaccagttgaaccaactctttctgtgtttttcgcacaccttgtctctcagcattcatgatttagagagttcaacataggttttgagggcacattcatttcaagaggattacatgaaagtactaacttttttgtgtggctaaaagggcttttctttgttctgtcaccaggcgaaaaggtttattttgggaatgctccccatggcaaacctctttgagaaatgaattccgaattgcattaaaccctgtcttcaggaacttctagataaagcatttaaaggaaatactgggacattgtctatcttcaactttctaactttgagaagtgatcttagccaatctggaattttgatagatttcctagacacttcataaacgtttaaaataagcaactttgtaaaagactccacatttacctagccaaaaaaaaaaaatcctctcataaatgcaaaattagttcacaagtttgcaggtaggaattcttaaaatttgatacaactttttgctcatatatagaagtgaaatttacatagtagttagttgctagtgaattcataaataaaatttatcgataacagattttaagtaataagatgaaaaaaaaactatatccatagcagtactgctcaaggcatgagtaatgaaagtaacattaaaaaaaaatattggcctagaatctgtttccacttttctgcactttaagacactcctacagaggcagtttgtcagtcggactgatttattggagcaagaagtaactttaatccttttcttccattttacaaaaggggaaactgacacccagtcattcatgaagatcaatgaacaattctttacatttcacatggttgtctttacatgttaaggtgaaatatttaaggttaaacttcaattgcatattactgatgtctagaacactgtttccccaaaataagaaaaaaatttgcttaggctttctgcaattacaataataaaaagcatagtctgtgtaaccatttagacatgcattcaaatcctagctccaaatcctggtcccacaactaactagccacatgaccttaagtgaattactgagactcagtttcactgcctataacatcatagaaaataatacagagctggaagacaaacatcagagaatcaatgaggtactgtgaaaaggtgtctaatgcaggtggtagaccctgtaaggagtagctgatactgtgttttaaattccaaatgaggaatgtgtatatttaccttaaaattgtttggccttattcttgagcccaatgaccagttaataaagtataactgaatactttaaaatatcattatcaatttataaaaaatatttcttaagctcattttgtggcaggtagtgggatggtgcagaaagaacatataactcattcaagtccctgtcctgtaaaagaaattaagtcacacgaaatcaatagtgacccatagatgtctcttatgtgatcaagtgcttgctaagttgtggttaacagtccaaaagtgctccaagaaaagtaaagagatagacctcagtgaggattagagcagacttccaggactcagtggaggaaatttgaatggagatggagatgatgagaaggccagtggggagagagaaaagtcaccccacaggagccataggcatgaacccaacaaagcttgtataggaagggcagatccaacactgggtggagtcaactaagcaaaatattcatattccaaagcttccatataattccttattcagacaacattgtatattgttacttggctcagcaattgaatgttgacctcgttcttacgagacagggaggataaggactgcaattcaaaatagccagatttggaattagcactcacaaccctagaccatatttctcattcctttagccttactccgtaaccatgttcctaaccacatttcacacttaaagttcacctttttaaatagaaattgattttctacttccactgtcccagaaagcattgcctaagagccaaaaatccaaggttcttgtcccatctattccattaactaacatgaagcaaaaaacgagcctcctgtctctgggtgaaactgctacatggaatgggtgcttctgggtttgaagttccacagatccagtagggattttgctgattggaggacggcacagtactctccagtgcatctccaagcctgacttcctgacctcttttatacaatctctgggcaaaactaccagtcgctgttattttcctctctgcggtaaacatggagctcaagaatggatagaaagaccttattgtattgctctacctggtaaataaatatcatgttgaatttgcatggcagctttctgattattttcatgtctccgataagcatcaagtctgtcataggtacagtataaaaatgcctgagattgcctaacaccgatactgtggcaggaagagaggagaagagctgtactggggaaaatgaggagtacttgtaatcctctctcggggcagtgagagggcctgggaagaaaagatcgagctgttccgtgttggggttaatgttggcttgaaatgaaacttcagggcaaaatgaagcagagcaaagagcagcgcccacaaaccaaccttaaatatcacagcggcggaacatttacctgaaagaaaagtgacacttggcattaaaagttcaattatcacgttcagtgcagagccttgttctagtctggagctgccgggtgtcacatggtgcgtgataacttgcccttgatttgggttcatttgaagagcgtagaactctaacaaataaacagccttttgggacctgtccccggacgaggactgcccccctccctcgggcaactactactgatgctgtccaggcatcgcccaaggggaaaggttgcagcggggtcggaaggcgcgggaggagtctggcggtgattgatgggaagggatgaatgaataaaagtacttgtctgatggcagcagagaccccgagcaaacggtggaggctacactgtctggcattctcgcagcgtttcgtcagagccggacccgcctgcagctcaagggaggcgtgctcctctcccagagcaggctggaacccagctgggttccgcctcccgggaaggtggtctccattcgtcgctctgcatctggtttgtcagatccgagaggtaaacattcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaaggtaaagggcgcctgctgaaatcatggtgggcttgaggaagggggcctggttggagacggggagatgagaaagcttgtagagggagcttccctttagctccctcttaaggttctgcccctcctaaaagtcagtaatctttggaaccaaattccatttggttctgtccactcataaaagtcagtaaccattggaataaaattccattcaggtcttcagtagacctctgctaagcttaggacaagcgtagtccccagtctagcaatgttagtatcactttgggaacttggtgcacatgaagatttttctggcctcaccccagacctactgaatcagaaactctggagtggagcacagtaatttgtattttaacaagccctttatgtgattatgatgaactgtaaagtttgagaaccactagtcctgaaggatctagtccctaagtgcacctaatggggtacatcctctagtcaaaagtgtgtggtccatggacagtcagcatcaatattacctgagagtttgttaggaatgcaaggctacctcagacttactaagttagaatctgcatcttaagatcttcatgtgattgatatgcccactaactttgggaaggactgttttggaagactttgaaagtagcaggtacaaagtaggtatttaggaaataaatggcctggaaaaaagagatccagactggtgagtaggaaaaacacagttcacctgctgtgacggactgtagctactttgtattaaatatctacagtgggccaaggactgggtgagatgtgttacttccattattccttccagcagcccacaagtagatattacaattagtttacagatgactggtaggatgatcaaagtaaatgaattagaggtggagctggggatcagacccaatctgtcaggttccaaagtgcaagctatatgatggcaccccatcaattatttcatggacaagaccaaggagcactcaaaatctgtaagggtttcggtagttaacattattgtgtgattaccatgggcgtcagtagaaacacacaaagagccaggttgctccaggttgctttggaactccagacacatcccagcacctctgggcctcagtttcctcaattccacaataaggctgccagtgcccacttactgaggctttatggtgttaaaaaaaaaaaagcagtctaaataaaacagttggaaaatttcaaagacatatgaaaatatttaaaactttcccagcagcagcagcagcagcagcaatagaaagttgcacataaaaacacaatcacagtgtaaggaaatggaattgtgctttgcagatttgcctatagctagccctgacttcagtacttcagtacaaggggaaaaaaatggaatgtaaagttgggaaatgttgtagggaatgctttgacctattggcaggagtagttaccataaggcatgcctgtaaatttcccttcataaatctctaaaaatcctaacccaatagctatattttaaggggaattccgaacatttctgaggtttagcggtgagagtggattaggatatagttttctctaaagggaatcacccccggaaatgggggaatcgattgaagaaatcctaaaatcctgtatggcaattgattctgatgaactgtgaggatttacttggtaagagctgaaattgaatctctaaatgcagccacaactccatgagggccagaagtgacccttttacttcttaaggcgtcccacaaactaaatcttcccattctaatttggcaaaggaatttcaattcaattcatcaaaaccgaattgagaacttttcagtacaaggtgttgtgataaatttaaaataaatctaacaagatctcttcccaaagggagattaaaatctagttttgctaggttggcacaggattttatgaaagttctgtttagggggtcaggaaaccccacatgtccagcccagttagaaacctttctaaatcagacagtagctgaagtgctgtgtagaaggtgggattgagaacatttttttagttctggtgtgctgcctccaggacagatataaatcagctcttccagaaccatcttatttcctctgtctggttaaatgagtatttgtaataaactagagaatttctgactccccaagaggtcatacagtttccctttcatttcaaactcccatatgatttccctaggaagttacatccttttccctgaagccatccagtcttaacatgactgtgtttttacttctgaaataagccaatgagtcattataaatctgtccatccattaatctacatgggtcacaaacacattcatcacattacgtcccatcactaaggtcatcattattgaatcctaccttgtggccttaggtttagcttgagacacaatatcataataatggctaccagttaatgatgcactaggcacttggtttatttcattaagtcactataacaaccctgtagaggaggtatcgttatcattcctgctttagatctaggcaaactacttgtcagagaggtgaagaagtaacttgcctaatgtcataccactacaaagtaatgaaactggggcttgaaagcagatcatccagcccaagaccctgtggtccaccccatcccactgcacaaagcatgctcaggcactgcatggtcatctccaaccttgagtattgttttaggatctcatttgggagcatttggtggaattatggcaaataatatgctatcccacagtagaatacttggtaaacattttcagaaattaatttgagtcaggatttcggtctcttgaaacccccttcagctggtctgtagtgtgtaatatcagtggaagttattctaatggcttaatttaccaaaatatcaaatccaggaccagttaaaagccatttattctcctaaataattgtggcaacgtagtttttttaatgcatttagaatttcagagtagtcaggtatgatcattcagaaaaaagtaatttaaatgagttatgaaggctatatttaatatatcctaatatgagaggcttaaatctaaaccagtgatttctaatttttttggtggggttttataattctctttgagaattcaatatacacaatttctgggggtttgtgaaattctcctactctcttgttggcacactaagggcccagaggcccagaaatgtcaatgtgaatctattccattaatctagagtttaatgaatatagagttcagtaaagttgacaaatcacaaaatgtcatagctcttattggaagctacagtcttcaggctgtggaattggtgggactttatctggagttgctgcagtgggaagctgaaaagcattgggaaacatgtctgatctgcctggacttcctcaaggagctgggtccctggaaacttttaggaagaatcataccactctcacaggtctcctgtgttgtgggtgaaatcctgtgttgaaggctagggaagtgtctgaggacacttagcaagttgaggctgctgaagaactttaaactcatgtaaacatgcagaaaataataagcgttgcttacgcttctcataggcacacactagggctatgcctacattacacaacaccaaccagaagaacaatgaaaacttcaggcatccaaaggagatatttatttaaatatatatgcacgtgtacatgtacatacattaaaatgttaagttttataagaatatataagtaaaaagatgactatcatttggcacagggcatggcatatagcaagaaatgataaatgttattaaaatgtgtgtatgtgtgtgtatgtgcgttttgagtattctttgttttccagcttttgtcgtgacaaacatgactacaaacgacatgtttgtacatatggctttgcacacatgtgtgactacatctgaagggtaaatttttataactggaattattaaatcaaaatgtgtgtgcattgtaattttgaaagatattgccatattgtgctagaaagttattcttgtactcttggtattaatcactattttatataatatctcaatatggatgtaaatgcatattaatgtttatctgtaatatgtatatgggccaccatgcttaatatttacatagtctacatatacatcagaaccaaaagccagtgcttgactacctgacgttaggatgaatttctccttattcacaagctacttattttgcccttcctatatatcctaaaataaatggggtaatctagatatttgttcacatgagagcctggtgttccactactaagttgtagaagcatagatatcaaagctggataaaaagcaagacagccgggtatacttggggatgctatcaatgtgtttatgttgttgtttggttggttagttgatttggcttggtttgctttggcaatgatatttaacaaaacttggttgtaggttgggagaagttaaaaattcttgagcaaatagtgagttcttaaattacttctgaattttattaactctctttatgttatatttacatggataactgagttaaagaagttagctctcaaatatagcttcctttatgtgtaaagaaattgcatttaaaaacaaatctacttgcaaactgataagacaaataccaatatccacattaactagtttggtaaggatccaaaggtaatcaggtgtccagtggtgatggagagctagaaattaggctggtgacccactggagtgcttctagatggttttacagttaagaactgtaggctactattagaggcaaagaggctgcattcatagttctgaaaggcaaaactgctgatctttaacgtttaactagttaagggtgggaacatataacattaaaatgctggtatgtcaaaatgcggaattgcttcactgaacccacaaatgagtttcgagtgaagtgaccttggcaggtaatcagacattttctgcttgtgacacaatcaggattatctttctgaacaaatttaccttttgcactatcctcttagactacttctggtacttaacaagtttatgtataattaactagttttgtagttaaaagtaaaagttgatggaacaccaccaacttttgaagttataattttccagtcagtaaactgaagtatattcacatattccaatcagtaaactgaagcatatgcatatatagcaacacaagaagtaagggtatcattgggagaggagtctaatttatcccagtttaataacaatgttctcatttccagtcaagtaactgaaatattttagtaatatttaaagatattttaccagcataagcattctgaaccaaaagtggaacctgtatgatttatgtaaagcaaaataatttttaaggagcaccaattaagtgcatttaaagtattaacttttaaaacgtgttaattaaaagccaggcttttagcttgaatgacctggaatcagttaacaatacagcaaataccctgacacccatctatcatagtggctgcaactgtcaatactacacaaatgcttcagacaaatgatgttatacagaagacataagagtagtgggctttttccactcatatttttactgatgtccaaatgaaaaagaaaaagaaagcttgattccttctgtattaaagtattgtcatagtcagataacaggttgatagcagaattcaaatcaaccagaaactcagacttcatattcccaattcactgtttcacatgttggtcatagatttctgtgacaaaatggtcagtaagcacttggccttgggcaatgcaaggttccctaggttcaatttgatggtatttcttgtgtgtgcctttgatctgccacttggtcactccgtaaatccaagcctctacaaatgtcaaggtaaggttttctttcaatatggtaaggcttatctatcaaaaggtttacatttctcagtttgctcatttaaaatgagtctttcaagattgaagatatttccatagttgtacaaaaggataacgtagccaagaccctgttgtctccaggccagggagccatgttcttcaattcacaaagaaaaccatataagggtatctctgtgtagctaatatgctatagttgattatttttagagaaacatgccaaatgctaataaatgattaagttctttaaagggtgttgacagataaagcctgagctgaaataagattcaagatgtaatttatgatgtgaaacattctctttcaggactttgcacagttaaaaagaagttggttatgtttgggagatagctgaatgtggtgtgtgggtataccttagccaacaacttctctaattttagactttttattatttccaaggcttttattttagagagttatttatccttccctgtagggcctctggtgaaaatgtaaaggaacaagaaaatggccaaaatgtggtggtggatgggagagagggagagagagaggagaaggcgtgaagggagaagatagaagaggatcattcttgaatcagaaatttattagcaaaattgattgaagcatttctcaagcaagtctccccttttgaggctcaaaactgcactcatgcctgctgacctgtgtcttttccccacttctgtcttcttcagtttcattgtagtttccagaaaggaggaaaactatcctcagaatgtttacactgtacgctgtcttcttcccactcactcagtgtgttcagcctattttaatgagctttcagattccatagtaatcagacattttctgatcacagcttattagtctcccataagatattccacagatagaattaggcttaggtatggcatgaagttacttaataaggtttgttgaattcatgtagtttgcaagtctcgttctgagccaggaggccctcaggttctcattcttctgtgtcttcagatatcaccagtgatcttagaagatccagctcagataagtgaactaataataggccaggtttgtgaatggggtttgttatttcccttagttggatcttttcaaaatatgtaatatgtcggtgatagttttaaagctcaaactatggatatatttttaaatttagataataaaagagtacaatcaatttctttcctggcctgttacagactcagaaataaatttctggtaggaaaatatatttgaggtaaacttcaatttctcttaagaaatatttttaaaaaattgttttctatctctatgtttctcttagagattttgtttcaagaactttaattcattttcataagccattgttctatttcagcaagttagaggaatctttccagagctgtgaaaaggcctctgttttgtggatgtgtgtgaaatagattcccatggacagaaccgctgccttgcacaactctagggggcactgtacttattgtaatctattgagatggcacccctgggggataagctaacattatttctgacccacatatttctaactcacataggctaatctttaagtgattaagggcattctgatggatgcagggtagaacttgtaatttatatttgtccttcagggcacggtgcactgtatgtcaagaagaaaatatttccatgcacttgatcagcatattgactccaaattcaaagcttactttgaactatttctttgtgtattaatacagaaagagttctggcatggaagtcctttagtgaaggtgccctatctcattaaaactctagttcaaacacagaaaaactcttaactactacaggaaacagagacaaaaacagaatacaccctttcctaaagttgtgaaatgcagccattccattattttccttttttgactcttactgtgaaaacatttatataatgccagtcgtttaaagaaacgttcacaacttatcacaggatggaatagactgcagtctggcaaagtaatcttggttgtcctcttaattacaccactcactcatcctctaaaacaatcatctcttacaatgctcctatgtttactgcatctacttccacgaaacttaacaatcctctccacagctgaagctcttcatagactcccattacatagtgagaaacagtaggttctgttttgtatcagtcattgccttgacaagtttgagtaggagagagagggtgggagaggaatttttgtcgttaccttttccgccctgcatggaagagcagaactccaacaagagtccagcccactctcaagcctcaattctagagtttctgactctatgtgccaagaagacctgatcatcagtactagaaaatataaatagtaaatatacagtcatgtcaattatctaaagaatatatgtagagtatgagaactgaaaagctcatgacaaatgttttgtcatagatgatttctgccgtgtgatcaaattcattcatccactcatccgttcatcgttacttaacaaacattgaatgagtgaccactgtgtgccaatcactgtactaggcattataaatgttgtagaatattctgaaacaaataaacagttaaagctcaatgtacatttgtaatttaataaagtagaaaaagaaaatgctatctatgtttaatgaggtgagtgaacatttgcttgtacaagatggttaactttgacatttcctgactttatggggcttgactccttttggcattaacaggggtgtgtgttaacaggattttttttcttcatttattatctcaagtatgtgatttttaattaaaaagagaaatgaaacatgtaaatcccctggttagagagattttgtaggattcacttcacaaaaccctcaaataagtaaagaatatttgtttcttattcatgctatttatccttttagaaaaattttaaactataatatcaaaatgactttataatgtaatagaataatttatttggattctcttgccttgtttctttctcaagcagctgttccaaggtaaagttataaaatcacggtctttcttgagtagaaatcttttagccagtatggccacaccttttttcaatctagtgtttatttatttgtgtttatcatccaaaagaaatgttctagagaagcagtataagccttagggtaaaatgggtcagcacaaacataggctatcattttgtcaaatggataccatattgccagcaggacttaacactaacaacagctattcagttagatgagacatcatgatatgaaaaccagtgccagttatgtgagtattgccaactggctcatatttgatcaatgttaggtaacatatattcaactgaattttaaacaggatttaaaattttaatttatgtggaagcgacatagtgtcaatattaaactctaaacaccctttttgcgatcagagagacagccttttgattacatgtttgaattgtcttcactgttcagaccttgcccttaagttatctaatttaatggggtaaagtccaaagaaaaaactaaaaatagggaataaggaatgtgttattgctgggtttaaagttagagttgcttcctcttgcaataaagtgaatccatttcctcttcagtggggaaagctgtatccttagacttcaaattattgatgttagatgttgttatttttcccaaagaatgatgaagaaatgaatgtctaagaatcatacccatctataagaacaatctctcaccaaattttaaagatggcatcttggttgagagtgaatttttttttttttttttttggcaaaacttcatagtttttccccaccagggatacctttatattttaggtaagcttcaagcactagcttgcctaaagactttcttgctagaggccattaagatgacagagatgagcatcaatagtgggcatggtttctgtcacagagtatcaggctttgctgggtctccacaaagccttctgatcagtgaggcagaggttaagatttttaaaggaagagcgtttagagtctcgccaaagccatccttctcactacaaaataatggaagcaacagtgcatgctcttcccacatcttctatggccttccagagccaatagcatccagttctaaattgaaagcatgaaatgctgaaagctgataaaggttaatgctctctctctctttttttttttttttttttttttgcagtctctttcccttcaaaagtgtagactagaaaactgtaatctctccgtggtgattacgtgtctgactatctctctgttgagcttgaagagcattgttataattttcagtttgtgtttccctgttttctgtgatagcttgggtcagaggttgggctgcaggcctccagtggtatgaagagcaataatccaatttctaggctgagccaaaaacaatggaaacctcaaaacatggcctggattcagtgcagagctcattttcatcagccagacttctttcccttcaatggtctggacgctcattcatcttgattcttctgatagccatacctacaggataacaatattaacatatttggaaataatttaagacagaataaaatattttaaaatatccaaatgtttgtacattatttgaataaaataactagggggattagtcagggttctccagagaaacagaaccagtgggatagatagatggatggataggtagataggtagttagtagacagacagataaatagataatgaggaattggtttatgagattatagaggctaagaagtcccataattggccatttgcaagctgcaaatataggaaagccagtggtgtaattcagtccaagtccaaaggcctgagaaaccagtctgagggccaggggagatgaaatgagacattccagataggaagaaaaaggggcaaattccttctgcctctgccttttgttctattcaggccctcaagagattggataatggccacccacctagggtaaggcaatctgctgttctgagtccacaaattcatatactaatttcttccagacacatcctcacagacacactcagaaatagagaatgtttaattgagcaaccagtggctggtcaagttaacacataaagttaaccatcgcactaggtgagcagaagattttgctctgcatctagatattttactattatttgacacatagctataggtttaaaaaaaatttgatttaattctaaacattttgttttgtacaatcacctccttcaaaccactgtcgggcaggtattatagtggttgtaagcataggctctagaccatctgggttcaaatgtggatctattactcacttaagtgagcaaacaaatgcaagcaggcatgtgggtttcctaatgaataacaaattaccctacaatttagtggcttaaaacagtaaatattttttaaatcacattgtgtctttggtttggcaattaaggagtggcttagttgggtggccctggcttagggtctctcaagaaggtacatttaaaatactggctggggatgcagttgtccaaacgtttgtctaaagctggaggatcctcttattcacagacgtggcaaattagtgcttgatgttttcaagaggcctcagttctttgccatctggtttctccacagaggtgcttgagtgtcctcatgacatggcagctggcctcccccagaataagtgttccaagagagaggaagccagttctttaggaactagtgtcagacatcacacatcatcacttttgtcacattgtattcattgaaaacaaatcactaagtccaatccacattcaaaggcagggaaattaggcttcatgttttgaagggaggagtaatcaatagcagaatattgtctgaataagttgtaccaggctgggtctagcataatccttgaaaccagttggataatttttattcttatttctaagggtaattggcagttcttttaaagctacatgggttcaaagctggttcagacctgtggtgcactgagtctcccccatttcagtaaatggcttcaccatgcacatggtaaacctctgtgagtgtcctgacttccaacatcatgtgtccaacccatcagcaagtcctgctagctacctctacccttaaaatatatacagcctataacccgctcttcacagcctcagggcgcacaggatccagctcaccactagttctcatcagtgcttcctttcttggccctacattctattctacactgggcagcaacagtgatctcttgaaaaatatgttagatcatgccatttcccttcttcaaaccttgcaatgaactccctcaaaaaaagcattcaaattcttccctctacaacttcattttccatgcatttgggctgggtcagtcttctccagctttagtagctagtagcctcattgctgtacctccagttcaccaggcttgttttgacctcagggcgtttgcacatgctcttgcctctgcctagaatgctcttcgcatggcttactgtcttatttcagtcaagtctctcctcaaatgctgtctcttcagggtgaccttactgagaagcttatcaagaaaacacctcaaatcccaccctcactcaatatgatcacagcctctgtttaacaccattttaagtatgtatgtgttttttgtctgcctccctcactatagtgtaaactccatgagagcaggagtgctcagaatggtgtctggcacatagtgaatgctcaataaatattcattgaatgaatgaatgaacaagcagaattaatgagtcagttgattaacccagaagtcacaagatagaggctatgatggctcacagatgtattttgataatacaatgttatatgagagttttttaaaaatatatatgaattggactttaataaattgtgagattcatataaaaattccaatctgggttctttagaaaaatcaagagatttttgtatttggagccccttagcaaaaagtatgtgatgtctactagcagctgctcctttcagacaaagtttaccccagaccccaccccactccctgtcatcttcctgacaccaatgactttctgagacctggcaccctccacttctctgtgttacctgcctggccctgtaggtcttcaggatcctacattaagcatatatatgataagtctgccaacttttgtcctacatgtctgtgtaagttttgatatctaacttagaaatgaagttggtcctatgttgaatctccaagtcaaattcattatgagacaaacattttagcctttgacgtcattctagttatagaacaatcaactcagcttgacaaactcggtagagtcttcactactagtgaaaggatggaaagactccattgtgtctcaaaataattttcacttttgcaaggttgtttttcaaactatttttaagacccatggatttgaaatacttttattttcaaaacctcatgaacatttgatccagatgttcacctaaaatgattcatttaccagtgtgggacacaccatattgtcctaagaaagaaaataaccacatttaataatagatggtttcatagtctgcagtcagataaagagaaatatatacgtgtacatatatacacactatatatatataacatactatgtgtgtgtataaatatatatctataatagcaataactatgtcttcttgctccttatacagccagtcactgttatattttagagtctatgaatcaagcactgttaatattaaacatctgctatgtgtcaggcactgttctaggcagttgtggagctcatagtctgtcttacactccagggatccagacagaaaaaaatctaagcaaacaaataagttaatgtgttatgccacaggaattgatagactatggataaaaaggaaaagagagtagggagatagggatgtctgaccggttacggtatctaatagtgtgatcaaggtaagtcatgttgaaaagatgaaatttgagtaagacctgaaggagataagcgagttaaccaggtgaatctgtggggaaagagccttctaggataaggaaggacctacagcgaaagccctaagtaggaatgtgcctggtgtgtttgagcaactgtgtagctactcctactgaatgattgttcagttaggtaaactgactgcaatgaagaacaagtgcctgaatgcacatgctgttctgcatggagtactacttcagtagggaagtctggtctcctcagctaaggactgtttatcattcaattttaattaacccatattttgctttggccatgatctgggcatttcagactccatgacagtatacaggttcaattttcaggaggaacttaagcgactggctcaagtttgctctgatgaggtgagctgaactctaagctactgtatacgcatgatgacttcttataagctggctgcattttcatcaatcccaacacactttcctgtcccatacatatatcaaacaatggtgcttttcaaagaagtagtccatgagaaaaagaatgacaaccagagtttatcctactctgcatgttaattactcttcactaagtgatacaattcagagggcatcttatgaaaccccctaacagagcttcgtgtcttctcaatgcagctgctggcagaggactggccatttggagctgagatgtgtaagctggtgcctttcatacagaaagcctctgtgggaatcactgtgctgagtctatgtgctctgagtattgacaggtagaagcttctatttaatccaagtatattctgaatatatactattgttttccatgttacttagaaaataaactgtgcaattcaataaaactaaggtatgccagcttaaaatacaattctatttttatcttcagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcaggtaaatttcactttttttattttcctttctgctcttgccttataaatatttagctatttttcccctgttccccactccttgggaaactgttgatttatgactgtccttggcataaattaagagtatagatccaaggactgtggagttaatggtgatcaatgactcaagctgcaagaagctagatcactacttctctaagaatccccttgatctcagtggcatagataaaccaggtccacatgaaagaattgatgtgaatttatagctttctacctaaagccatgttagaagtaaaatgtttggtgccacaaagtgaaaatagcactcaggcaaaagttttctcagcaaggcaatttacttctatagaaggttgtgtctcacaatggagcaatggcgagagcacaccagacaagggaggggaagggggtgttatccctgatgtagctagttcccactgctgcatctttcccctattgggtagggttggaccgcacagtctaagttaattccaattggctattttaaaaagagcaggggtacgagctggagtggtggggtgagtagtttcagcgggaaggacagttacagagcaggtggctaaggatgactaaggtcagagcaggtggctaaggatgactaaggacagagcaggtgactaaggatgactaaggacagagcaggtgatgaaggataactaaggaaagagcaggtgatagaggctaggagggggttgtttactgaaactaggggcaaggagatgtaaagaatgagggagttaaactttaaaatggagaacaaagaacagggaagctgaacacactgacatattggttctttgaagaggaatttactgtatcctacagccccataaggactgacaactactacgtaatctgcacaagatagcccagtagttgtcagaggaatggatggtccagcaaatattcagatagaagtcaccctgatatggatggagtctgaatggcaagactcccctctctctgtctttgatgccaaaaagaaagctgccattgcaagaaacttttcatcctggtcatttattaaagaacatttgattagggaatagaaaaagaatgatgatactcgtttccagaagatagatcctgagtgtaaaaggctcttcccaacagaatgagttaagagacattaatgcaaagggggctggcttaactattcccaatgattattttctattgaatatataaggagactaaataaaactttatgaactgtatatatcatgataagtaaaagaatcaaggacataatgtgaaattgaaaatgaaattgctatttccttgtttcctattagtaaaaagaaaaaaaaagtgctgcctaggttacataatttcctctccaacacagatatatctaaagcaatatgaaaaagataacagagaagaaaaagaataagagatacgacataagtcaaaagcagattttgtctttttgcgaggttagatttatatgttactgagctaaatggttaacctagaccttttcgtatctgttgttcccattaaacaaacttgctaaaaaatgagaacttcatctaaacactaagttatctttacatatttaggtgttatatttcacacaaaaaatactctaaggataagtttcttatgtgaagacaaagcattgaattaccaaatatttcaaattttgcctaactacttaagtttttgtgcatgcttataacacattgtcttagagaactgaaatatttttgggaaaatttgttttatttaacatgactatttatttgttcagtaagtgtggcctgaaagattctgtatgatatatacaaactggatctaatttagaagataatcattccctgatgaatttttttaagtttaacatttgttatataagattttcttacagaggagtattaatcgtaaaaattctctcatccctatagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcaggtaagaaaatacaaatatttgataactcgtggttgaatttataattatgaatatgaaaattatgatgatgatgatgataaactaacattattatataccagagcatatttcctttttcttgtttctggtagttttaaatagataaagaatatttttatattatttatttggagatattctatataatctaaaaggatctagggagaatcagaactttttaaagatgaatctctagtcacttcggttccacttcacattaactattccatataaagctcagtgtcctgagtttttacatatgccactgactttttgtagacaatattaaatgtcgttttagaagatagaatgctatgagtaaaatgagccatcttttaagggtcaaactatggatttatttcagagacgggaagtggccaaaaccgtcttttgcctggtccttgtctttgccctctgctggcttccccttcacctcagcaggattctgaagctcactctttataatcagaatgatcccaatagatgtgaacttttgaggtaagaaaggcaaactagaaatggttttgtaaataaatgccactcagaagtgtttccatcgatcttttttataggcagaaagacagactaccatttttctaacccttaggaagtcatggagactcccaatttttatctgaggtcctgttgagagggacagggaagggggggtatgaagaacactgggtacagagagtcagagttgtcaagatgatgagtgagtgccaaggcggaaaatgtcaggtccgattctccaacgcgttttctaaatttcttcttttcagccagcttcagtacttccaaatgagattttattttaaaagagaagaattgggcctgggaaggggaaatggaggaaagtcagtagaaatgctagagttagagggggacacagacagagacaggcagagaatcattgttagcaaagacgagtgataaatttagaaccattgtatattggcattttttttccttacaaaagcacagaagctacaatgactacatgttcagaatagcatatttttcagacacattttgggttattttgttgcagctttctgttggtattggactatattggtatcaacatggcttcactgaattcctgcattaacccaattgctctgtatttggtgagcaaaagattcaaaaactgctttaaggtaagagactatcccaaaataaaaagctctttgtaatatggctcaaatataagctttcaaaactgctaatatatctatccagacagatttagtaaattatcttatagtttcccttttattacatcatggatgatttttttaaatacaacttttgcttgtaaatcactataattgttttttcctataaatcctagtcagccactccctactgcctcagccaatcagttacactcatggaattgttgaccaaaaagtaataaaaattacatgcattgatgtctgataggcatcacataataaaataagggctaaacatgaattaaaggccctgttccctgtttttggtagattctgaacttcgcagctgcaattattattataactaaattagttcctttttcacatggactgtgagaatagcaaggtaaacaaaaaaaaaatagtttaggttttacctctttcttccttttttgtataacagtgatgtgctgttcaatgtgaaatacatataattccttcttcagctgcttgcattttatcatccttctattcattcactccttcaacaatctaacatgaaataaaatatcccctcccctaatgtgaaaatcatccatttgtccatggtatttcactactggaaagctaagaacgtagctcccgcgtaaacactaaggcagcctataacattcttcgcccactcataactcaaattttagagttggaagagaacttccatcaggatcaacaccctcattttataagacataaaacagtggacttctcattttcttttacaaatagaatgaacagaagacaagcagaatgaaaaaatttttatatttaaaaaaacttcaagaaaaaaattgaagaaaactgagatgcttttgtactatataaccttattgtttaccaatattgaaaagagatatgagaatacatggctgaaaaaataggaaagcagtattaaattcattgacatgagaagatatttatgtcactgtcaagtgagaaaaagcaggttaaatcttctcagcaaagtggcttagaataacttgggatgaggtgtttgtgaaagtatctacaaggttatggagtatacatacagtacagtctcagtaaaataattatactcacattctccagcacatgcacatatacatgtgtataatttatttatttcatgtatgtgcaaatatttctgttttcatggggaaaagtcttgaattatatgtttatcaaatattatcaaataaccaagagtaaatatcaattaaaagtggctttctcttgttgagaaattttaactatgtaggtttttttcttctctgcatttttttagttaaaaaattatcatatgctactactgtgattatattcttttaagagggaaaataaaagagcactgaaagaaagggcccaagaactcctaatcatacaaagaaagtcagaaccctggagaggaggaagagttgggaaaggtgactgatgttaacatataatgagttactttgttttgtacagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccttttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctggg

SEQ ID NO: 36571 - DNA, 80049 bp, Homo sapiens; identical to SEQ ID NO: 36570
